United States Patent 6,812,339 (POLYMORPHISMS IN KNOWN GENES ASSOCIATED WITH HUMAN DISEASE, METHODS OF DETECTION AND USES THEREOF) - sequence listing, part 29

SEQ ID NO: 13157 - DNA, 107085 bp, Human
aatatcaacaaatatttattgagtgcggtctgtaagactagtacagttctggctgggtgctgtagctcatgcctttaatcccagcactttgggaggccgaggtgggcagatcacgaggtcaggagttcgaggccagcctggccaatatggtgaaaccctgtctctaccaaaaatacaaaaaattagccaggcttggtggcggcgcatgcctgtagtcccagctgcttgggaggctgaggcagaagaattgctttaacccaggaggcagaggttgcagtgagccaagatcatgccactgcactccagttgggtgacagagaaagactccgtctcaaaaaacaaaacaaaacaaaaaagactagtactattctaaacacatgggtacagcagagaataaagcaaagatcctgccctcatgtagcttatattctgagagtaatagaaaaacaattaacaaataagtatatgttagggaatggaaagtgtgatgaactctataaagcagggtaagggagatacaagatgagacaagagagcaatgcactgtcagataaagccctttgacaagttgatatgtgagtaatgatctgaagtgaaggatcaaaccagatgcaaatctgcaagaggaatgtcccaggtcacctttagccaatctgttttagattttctgaactccccagatgatattaaggtaggctgcagacactatgaagctagcttgttttctggttacccttactctttatgtgtcccagtccaaagaagaggggggtgcggtttactaaggtgcccaaccttggcaggtccccatttcaaattcttgtaacgctggctccaggagctgccaaaagcacaactcaacctatgaggtgctctttatgactggaaaaagtccccaggataaaagctccttaagcacattactctttttttttgaaacagggtctctctgctgcccaggctggagtgctgcggcaccatctcggttcattgcagccttcacctcccaggttcaagcgattctcccgccttagtctgctgagtagctgggattacaggcgcgctccaccaaaaccagctaatttttgtatttttagtacagaccgggtttcaccatgttggccaggctggtctcgaactcctgacctcaagtgatccgcccgcctcggcctcccaaagtactgggattacaggcacaagccaccgctctcagcctcaaattactcttttaaatggctgtacctatttacactcctaccagcagcccaagagttcccattgtttcacatcttcatttcacccttgatattttttagcttttactttttgtcaaactgctggataaaactcaataaacaacctttagccattctctctcctttcagattagcctttctaataccatttttcagggatagttgactgtgttaccgcctagcacttagaaggtgctcagtaaatactcattgaatgatgtaactttcctacttaacatgctttaatgcttttccaagtccggaggcggctccccttttctgagagcctaataatcacgtattcgtttctatattcccagaacctaacaaagagtttgaaaattatcctgcaggcaccgctaagtcaatgttttttcggatgaatgaataaccaataggatatcgtatacttctgcgatgcacgcatttctattatcgcacacaccgaatcataccgtatttattacttatccacgcagatggtgaggtctgtagcctcggcatctacactgtgtctgaaagtaggcactaaaccagtatttttttaattgaaccgtaaacttgaatcaaacttggaagcatttaaagccaaacgcaaagatacatgcgcagtgatgcagtagggtcgtccaatcagagtagggcaggacagggcagtgcagcggctaggtagtgcgcacgcgcggcgggctcgtccgcgattggcttcgccgaggcgggatccttgagcttctccggcggcgaggggatagctggttaccagaaggacttctttgcagggccagtggtttctgtcagattttcgccggtgcgtcctgcagggggaagctcgggaggctgcgacagcctgtaggctcgtgcgggacaaagcagggagtggcgccggagcaggccaacgagggaggagggagggaaggcggcaggagcgaccgaagtggccttctgcgggcctgcagctttggtctgaagtgccagggacgccctggttgctggccccgggggccttggagcgaagggcgggcggtgggggtttagggttgtgcgtttgtgtgggagggatggttctgggcagtggcccctggggccgccactgcggtcgctttgcgcaggctcctcttggcttttgggtctctccctcactcctgcactgggaatttccttccccagggccagggggtgaaggctctgcgagcgtcctggagagtgtcggtacgccttctttaggggcttttacctcttcactggtcaggtttttcttgtatttccttaaaaccttttaatcgattaccttatggaagattttctaggtaggaacagatgcttctcgacttactacggggttgaaaatatcccaaatggaaaatggatttaaaacacagctaacctactgagtattaaagcttggcctagcctacttttgttatcaaaaaaattattttcagctgtttattttagatttgggggtacatgtgcaggtttgttgcatcggtatattacgtggtgctgaggtttggatacgattgatcctgtcacccaggtagtgagcatgttacccaatagtttttgaacccttgctcctcctttcctctcccttctagttgtctccactgtctattgttgccatctttatgttcatgaatgcccaatgtttagctcccatttataagtgagaacatgcaatatttgattttctgtttctgctttaattcgctttggataatagcctccagctgcacccatgttgctgcaaaggacatgatttcattcctttttatggctgcgctagcctaccttaaacatgctcagaacacttaccttaatctacagttgggcaaaatcatgaacacagacggttgtgtggttacttgtacagtttctactgaatgctcatggctttcttaaaagtcgaagaattctaagtgacaccgtcctaaattaggaaccatctatatagccggagtctcaaaggagcaatttaaggcatgaagtgaaataattactacctaatgtagttggaagtcgacaagcagcaacagcagggagagaccgttgctggttcttggtagagttggtgtacttacattcttgcatcctcgacgtttgatggttgcacatacctctctttaaagcccagacgaacccaaagattctggtcattgtcctgtatgttgaactaccccttctctatctccttcacaggaccttcatcatttctactctccgataatactaattataacagataacattgagtgcttactatgtgtcaagttttgttctaagtgctttacatatttcatttaatcctcccaacagtccggtgtgtaagcatgattatggtaccccctcttaaagatgaggaaactgagacacatggagccaaagtaaactgtgcaagaccattagaaagtgtcagtccacatttatattcaggcatttgctttcaaagttgtgttcttatttaccacagtgtagtgccaagtacttgtggctatctggtgtattacagttgtcagcttggccttaccattttacttggaaggactgaaactaataggtgttatagaagttgtagcatcacatcagggctaccaaatggctttatttctaggacctggggaaagggctcagacagcactaattaattaattaatttattatggacaggacaatatgaacatacagaaccagtttaaaaagctataagggtgcaatggtcttttggggggaaatgtactgatttctgcattttactttgtatcaacaaattaaatggcttgatggatgcccaaggtcatatgtaagtagcagagttgggattctagccaggcagcctggctggctccagagtcagtctgttttcttaaccactgctctgtgctgatggttgtatgcttgcattatcatttttattagtttacaaaataggaggattgaaaaatcagaaatcatgtattagatgtagaaggatttagggtagtaattcttcgcatttagtgttgaaagaaattttagcatctagttcattctttattttataaatgagaaaattggtgtctagagagttaaatagcttccccaaagttaagcatccctgaaatagcagaatctgaactacactctggtttccttcatttctactgttgatgtttctaactactgtattttttaagtgttcctttttaaaaagtgtcagaattttcacagtattagaggggagtctgactaatgtagagaacagaactgattacatttcatgatgtggacatcatatttttattaatgctatctagaatttattagtttaagaaggctcattatcttatttcagttgagctatagtcactaaaatctttagttttaaatttcagcttctattgttctatttcatttgaccattaagtaactgagtctaagtgcaaggcctaacatccatgtcgtcctgtgacagttaccgttaatcaatttcaaacttgtgtcagttatatatttagaggcctgtagtattctgcttacccattataaaaaggaaattagtttaatgaagttattttggcatgacttgtttggtcagaatttgtactgacttctggtattggtaaatactgcttctaaagcagtcaaaaaccatctgtttcataatttgctttaagattaaagattatactaatagagatctattttgtccttgaataagaaacagaagagagtgatctctcctactcattcctcaaactatataaaggctggttatatataaaatatttacatgtttcattattttaacattgatgaaattgggaaatgtctaaccatcaatgatagtgtatcatggtttaattggctacactttttttcttggatacataaaataatggtacatcttacaatttaaaaaatttttatttttaaaatttttatttacttttaaaaatttcttttatatggactaacaatcaagagtatatcttacaattgatggcattttagatttgatgaaatatggtaatttaaaaaaatctaattaatgatacttttccctattacaaaggtaacattttcattgtaaaaaatttgaaatatacagaaaataactcagaatagaataaaaattactggtattctaaccagacctagaaataattagggttaatgttgtggcatgtatttttctagtttttaaaaaacgattgtgtattttaatatataacatgtatattatatctactttatagcagtataatttacagtgtgcagttagatgtgtacattttgatgttttcatatacagatgtatatatactcctgtaaccatactacaatcttatatagattatttctatcacctccaacaagttctctcatgctcctttgctttctagtcttttaaatgtacatacacccattattgtttttatttttcttttcttttgtaaaaattagaatgaggctggacatgttttgtggccatttttcctttgatttattaaaacatatttctcttgtcattaaacatttttttaaagtactgcccccccccgccacccattaatggtatcattcacataacaaatactgaacctcttctgtgtatttggtactggcgatatactgatgaattgtacgtaagatttcatgcctgagttaatagctcagagggaatgatagggcaaatttcattgcagtgtgaaaagtgcttgggtagtgcatatacaggaaggtctccagtccagtctttgggaggagatgaagagggctcatggttaagactcctagatgataaggtagaattaattaggcaaagaaaagtgggaaaaagcattcccaacattatataagggaaagtttgttcaaagcctagagaaaaagagaacatggctagcttggggaatagtactgactcgattttggtggtatatgaagagagtgttctgttgtgtgggtgtaccataatttatcttgtacttcattatagacatttgtttccctttttccccctactgtaattgatactagcatcattattctttttttttttctttgttttctttgagacagagtgttgctctgtcacccaggctggagtgcagtggtgcgatctcagcttactgcaacctctgcctcctgggttcaagcgattctcatgcctcagcctcctgagtagctgggattacaggcgtgtaccaccacacttggctaattttttttttttttagacgaagtttcgctcttgtttcccaggctggagtgcagtggcgctatctcggctcaccacaacctctgcctcccgggttcaagtgattctcctgcctcagcctcctgaatagctgggattacaggcatgcgccaccacgcctggctaattttgtatttttaatagacacagggtttctccatgttgatgaggctggtcttgaactgacctcaggtgatccactcaccttggcctcccaaagtgctgggattacaggtgtgagccactgcacctggcctcaaattcttatatttttagtagagacggggtttcaccatgttagcctggctggtctcaaactcccgacctcaggtgatccacctgcctcggcctcctgaagtgctgggattacatgcgtgcgagccactgtgtcctgcccagctgattattcttatacgtagttacttagtattatctctgatagttccttaggttaaattgccagaattggaatttctgggtgaaacagataacgttggtagtcatgttcatccttgctgatggcttatgttaaatagtgttttgtggtgttgctttgaattggaatgcttgctactatccattgcagaaacatgatgtatgtatgtaatgtccttgttttccatctgttcccctatccagtcctagtggaaataagattgagtgaaagttgggaaacctggttctagtctcttgatttatattttaaaaaattccactgttttcaaatgaagtaggatagtaaaaacaagtagaattataaaaataccttttaaattgccagatttcattcattcaaaatatttgttagtgatggtaatgtatctgtcactgttgccagacacattatagtcattagtggtggagaaaacaagcatgagattgctgccttcatgtggtttatggattagtggaataggaaaaaggcaacatgtttgatatttgtatgtgaattgtatttccttgcattttgaaatttttatttaaattgctttaaagaagatatcatgcttatagtattatcaaaattgacatatacttaaatttacaccatttgtattagtctgttctcacactgctaataaagagatactcaagactgggtaatttattaggaaagaggtttattggactcacagttccacatggctggggaggcctcacatttatgccggaaggcaaaggagaagcaagccacgtcttacatgggagcaggcaagagagtttgtgcaggggaactcccatgtataaaaccatcggatctcgtgagacttagtcactaccacgagaataggccctgcccttgacatggggattattacaattcaaggtgagattgggtggggtcacagccaaactgtatcaccgttcagtttaaatcttaaattcttttcaatagcccttgatgaaaaataaaatcttactagctattgaacttattttctttttctttttttttattaaaaaaaaaaaaacaagagatgggctctcttgggctcaagtgatcctcccactttggcctcccaaagtgctgggattacagatgtgggccactttgcccagcctgaacctgttttctcaggcttattctcatatgttttgtttttgttttttcagttgaagtcttgctgctatgttgcccagactggttttgaactcctgacctcaagggatccccctcacctcagcctcctgagtagctgagactacaggcatgcaccaccaagctcctcttatctttttttttttgagacagagtctcgctgtcgcccaagctggagtgcagtggcgtgatctgagctcactgcaagctccgcctcccgggttcacgccattctcctgcctcagcttccagagtagctgggaccacaggcgcccgccaccactcctggctaatttttggtatttttttttagtagagatgtggtttcactgggttagccaggatggtctcgatctcctgacctcgtgatccgcccgcctcggcctcctgaagtgctgggattacaggcatgagccaccgtgctcggcctttttttttttcttaattttaatttttaatagagacgaagctcctaggttcaagggatcctccggcctcatcctttcaaagtacagggattacaggcatgaaccaccacgccggccccttttacctttttacatatgtcatggttgtattaccaaaccaaacttgagacggcctgcctggcacagcaaagctctccacagacattgggatttgcagcaagagaaagtgaggcgtttattgcagggtgccaagcgaggaaaaatgggtagctaatggttaagacccaaactctgtgatggctttcatgtaactatttttaaagatggggaggcagaggttacaggcaaagtcataaatcaatgcatcattgatttggcctaaaaaggtgagacatcttgaagtgggggcttgcgagtcatagatgtattaaaagattctctgatttgggattggttaaggaagtgaagctctgtctaaaaacttggggtcagcagaaaggaatgttgagctctggcctgtgggtatgacttcctccaggcctctgaagaagaaattcagaacaaagaataatagcagttagagttcagtcctgtttcccctaatctgaggtctgtgtgccagtagacagtattttccatttggtggtggtctggatttctgaaaaacaactcaaggacatatgttaagatgttacctttagtttctagagggaaccaaacattttgtcaatctaacttccctcaccattattttaagctattaccttcttgctaatcatattgctcatgtacttttcagggctagctaagtgcctggaatttcctttgaaggaactgaagattttccttttgtttctatgcttggggggccaggcaggcccataagaggggtttctgttccatcttagttgtagttttgagctatttttatatttgggggtgattgtaattagattcgtggatagttaactgttttgggtatttttcaggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgaggtaaggcaaaaaaagactcatgatatagataatatagagaagcatgtatgtttaagaaaatgccatttaaagagttaacagtattttctgcctgtaggaattttcagtatctctgaaaacatcttctaaaaaccttggaaatgaagattacataatttttttttaaaaggaataacaggctgggcacagtggctcatgcctataatcccagcaccttgggaggcagaggcgggaggatcacttgagctaaggacgtcaagacctgcctgggtaacatagtgagaccctgtctctacaaaaaataaaaatttagtggggtgtggtggtgtgcacctggagtatcagctactcgggaggctgaggtgggaggatgacttgagcctgggaggtcaaagctgcagtgagctgtgattgtgccactgcactccatccagcctgggcaacacagcaagaccctgtctcattcaatcaatcaatggaataacatgtacttgagtctataaaataaacttttggtaatgataagtaagtacctctttgagggaaggggtggagattctaatcagtgttctttttaaagttaccacataaataagtgaaaacttctttaaggtcatttaaagaggaaaaaatacataatgatttgtatcactattccaaacattttttctcacttttatctgtaaaaagtgaatactggctgggtgcagtggctcacgcctgtaatcccagcacgttgggaggccgagacgggcagatcacctggggtcaggagttgagaccagcctggttaacatggtgaaactccgtctctactaaaaatacaaaaactagccgggcatggtggcacgcgcctataatcccagctactccggagactgaggcaggagaattgctggaacctgggaggtggaggttatagtgagctgagatcatgccactgcactccagcctgggtgacagagcaagactccgtcccccccaaaaaaaaaaaaagtgaatactggaagcagtcttaatgtgtctcatttactgttaagaaaaaggattgttttggtcttaggtctaagatcaaaggcgttagtatatatgaaaggtatataaagtataaagaaggcatataaaatggagaattcacactacctactactctgcaattccctgatccttttatgttatagggattaaagtctattaattttttccctcttcttttttattgtggttaagcgtatgtaacataaaatttgccacattaccatttttaagtgtacaattaagtggcattaatgactttcacactgttgtgcaaccatcaccacaatctgtttccaaaactttttcattaccccaaacagaaactctgtacccattaaacattaactccccattctctccactcagctcctgataaccacgattctactttttgtctctataaatctgactgccctaggtacctcatggaagtggaatcatacaatatttgtccttttgtgtctggcttatttcccttagcataatgttttcaaggttcatccatgttgtagtgtgtatcagaacttaatttttttgtatggttgaataatcattatatggttttaccacattatgtttatccatccattcatctatttgatgcatgcttgggcagtttccacctttttgctatggcgaataatgctgctgtgaacattggcatccaagtttctgtttgtgttcctgttttaattcttttggattataactagaaatggatttgctgggtattatggtaattctgtgtttagctttctgaggaaccgtcaaactgtttttcatagctgtaccattttacatcttcatcaggaatgtgtgatggttgtagtatctacatcctcaggaacacttgttattttccatttaaaaaatttttttattattggcatctcagtagttgtgaagtggtatttcactgtggttctgatttgtatttccttaatgactagcaatgctgagcatcttttcatgtgcttattggccatttgtatatctttggaaaaatgtctatttaaggtctttgcctggtttttaatggtgtctttttttgctgaaaaaaccttctaatttttgactgctttttttggtctgtatgtgtttgttttatcctatatttctttcccaagtagattgtttagcacttaccaatgtaaaaattctggcacactgtaaggagaaaacataggcttttgttttcttaataaggtttctttctttctttcctttttaaaatacagctttatttaggtttgatagagtttggatatttgtcccttcagaatctcatgttgaagtgtgacctccagtgtttgaggttggcctaatgggagatatttgggtcatgaggggcggatccttcatgaatggcttggtgctgttttcatggtaatgagtgagttttcgctctgagtccacatgatatctggttgtttaaaaagagtgcggcatctcccccctccctcttttgctctccctcttgtgattgagatgcagtttccccctttaccttctgccctaattataagcttctggaggctctcatcagaaacagaagctggcaccatgcttcctatacaggctgcagaactgtgagccaaaataaacctcttttctttataaattacctgtctcaggtattcctttatagcaatgcaaactaatacagatataatttaaataccatacagtctacttactacaactcagtggtttttattatattcacagaattgtgcagccatctccacaatcaattttagaacattttcatgacaccaaaaagaaactttttatcaggaatttatttcttattgctgaaatatcagttttctcttgctgctgaaacaaattaccacaaatctaatggcttaaaacaacacaaatgaattatcttatagttctgtaggtcaaaagttcaacacagatctaagatcaaggtgttggtaaggctatattcatttctggagattttaggggaaatctgttccctggctttctccagcttctacaggtcaccacattccttggctcatggtccccttcttccgtcttcatagccagggaagcacgtttgagttctcatgtttccttctctttggttttctgcagctagaactcatttgattaggttaggcccacctgggtaatccaggatcatctctccgtttcaaggtcctggtccttaatcacatctgcaaagtcctttttaccacataacaatacattcacagattctggggattagggtgtggaaatctttgggagccgttattctgcctaccacactgaataatctgttgttttaatataccacaatttatatatctattcattagttaatggtcatttgggttgtttccactttttagcaattatgagtaatactcatgaacgtttgtgtacaaatttttgtgtggatatgtgttttcgtttctctcttttttctttctttcttttttttttttttttttttgagatagggtcttgatgatggcaccatcatggctcactgcagcctccacctactaggctcaagtgatcctcccacctccatctcctaagtagctgggaccacaggcatgtgccatcatttttaaatttttttagagatttttaaattttaaattttataggctaatttttaaattttttatagagatggggtctgcctatgttgcccaggctggtctctaagtcctgagctcaagcagtcctctcctcagcctcccaaagtgttggaattacagatgtgagccaccatacttggccatgttttcatttctcttgagtgtattcctaggagtagaattgctggatcatatgataattctatgtttaacctcttaatgaactgacagactcttttccaagctgactgctccattttcattcttaccatcaatgtatgaaggttttaatttttccatatccctaccaacacttattatctttttgattgtggccatactagtgggtaaagtagtacctcattgtggttttgctttgcatttctctgatagctgatatggagcacttttatgtgtgcttattacccatttgtgtatctctttggagaactgtcttttttttttttttttaaggtgaagtctcgctctgttgcccaggctagagtgagccactgtgtccaaccaatatttattatttatttatttatttatttatttgtttttgagatggagtcttgctctgtcacccatgctggagtacagtggcacaatcctggctcactgcaacctctgcctcctgggttcaagcaattctcctgtcttatcctctggagtagctgggactaaaggtgcctgccgccacgcctagctaatttttgtattttcagtagagttggggttttaccatgttggccaggctggtcatgaattcctgatctcaggttatccgcctgccttggtgtcccaaaatgttgggattacaggtgtgagccaccatgcctggccaagatttgttttttgatgtaatgtctaaggactaattctaggcaaaaacacagatttactatttttttcttttaattctataaataaattaaatagttattttactttttaaaactgaagtggggcatttttgaaattatacagcaattttaagcaaggtaacatgagaagcctaaaagtattaggcttagcagtcaactctgccgtctttttactttgtctgttacattcttaacttcttgtttttaaactatttcttatcttagattgaattaacctatagtgagaaagtattgctttagtgacttcagtggtgtttacttgattggtctgataaatacaaaatctgggacaaattgaacatcaaaagaaatatactaatggattatagcccattgaataatacaggagtcagaatctatactaatatatgtaaataaatgaataaataaataaatgaagattaaactcttccttacagtggaatgctaaagcatagaagtagaagtaatgatggtgttagagagtctcaatggatgccaaaactagtgggtaaatgttcaatgaggaaataggatatttgaatatattcaagtatctcctcacaacatacttaaaaaaattacaaagggaaaaatactttggcagacaccaccttaatcagtgatcaaagttaatacctctggtaatggaacaaaccgatattatgtgcctcctaatatgatgaactgttgtattcttgccccaaattcacaatctgaaactaatcatagggaaacatcagacaaatccagattgagggatattcagcaaaataactggccttattttgaaattttgaaatttcaagaccagaaacgatgaatgaagttagagattgaaggaaactaaaggaacatactgactagatgtaatgtgtgatctaggattggatcctgatttggggaaaaatctataacagacgttattgcgataagtgaccaaatttgaatatagactgtggattagatactggtattataccagtgttaaataatcaattttgataattttactgtgattatggaagagagtctttggaaacacaccttgaagtatttagaggcgaaggagcatagcgtctgcagtttactctcacgtgtgtgtgtacacacatacacagagcaaaggaggagagggaaatggaagaaaatgtaaaccaatggttaatatgggtaaaggtatataggaatactatttttggaatgttaccatgaatttgaaattatatgaaaataaaatgttgcaaaaaagaaaatttgtgaccttcattagttgacttactttaatatctgatcagatataaaaaatataaaaaaaatttatcaggtttttttttggaaaatttatttactaaccatgaaatttattaagatgagtatttatggccgggtgtggtggctcacgcctgtaatcccagcactttgggaggctgaggcaggcggatcacctgaggtcaggagtttgagaccagcctcaacatggagaaaccccgtctctactaaaaatacaaaattagccgggtgtggtggtgcatgcctgtaatctcagctactcgggaggctgaggcaggagaattgcttgaacctgggaggcggaggttgcagtgagccgagattgcgccattgcactccagcctgggccacaagagcaaaactccgtctcaaaaaaaaaaaaaaaaaaaaaaaaaaaaagatgagtatttataataacatgacaactttgcctattattgtgagtttctatttaaaaaaaattcaaccatttactactgtggtagacagaaaaaatggccctttaaacatgttcatgtcctaatcactggaatctgtgttactttacatggcaaaagagactttgctgacgtgattaatgttaaggaccttgagatggggaggttaccctggatgatctgagtgggcccattataattataagtgtccttagaagtggaagagagagagggaagaggatcagagaaagagatggtgattagggaagcagggtcagagagatgtaacatagttgactttgaatatggaggaagagggctaagccaaagaatttgtttggcttctagaattttgaaaagacaaggaaatatattctctcctggagcatccagaaaggaactcagccctggtgataactttgattttaatgcagtaagacctaagtctgagttctaacttgcgaaactataaaatgataaatttgtgttgttcaatgccaccaaatttctggtaatttgagagagcagcaatagaaaacccatacatatacaaaaaaaagagaaaatagcacataatgaacttccttgtccatattacctaacttcaacaattgaaaatgtatgactgatcttttttttatttttattttttgaggcagggtctggctctgttgcccaggctggagtacagtggtgtgatctcagcttgctgcaaccttggcctcctggcctcaagccatcctcccacctcagtgttcaaagtatctgggactattggaacacaccactgtgcctggctaatttttgtattttttgtagagactgagtttcactatgttgcccaggctggtctcaaactcctgagctcaaggactctgcttgccttggcctcccaaagtgctgggattacaggtgtgagccaccatgcctggccatgactgatctcgtttcatctttttttttttgagacggagtctcgctctgttgcccaggctgcagtgcagtggcgcaatcttggctcactgcaatctctgcctcctgggttcacgccgttctcctgcctcagcctctagagtagcagggactacaggcacccgccaccacgcccagcttattttttgtatttttagtagagaccgggtttcaccatgttagccaggttggtctcgatctcctgacctcgtgatctgcctgccttggcctcccaaagtgctgggattacaggtgtgagccactgcgcccggcctaattttttatttttttgagacagggtcttgttctgtcgcccaggctggagtacactggtgcattcttggctcactgcaacctctgcctcctgagttcaagcgattctcctgcctcagcctcctgagcagctgggattacaggcgtgcaccaccgtgtctggctaatttttgttttttcagtagagacggggtttcaccatgttggccaggctggtcttgaactcctgacctcaagtgatccacctgccttggcctcccaaagtgctgggattacaggcgtgagccactgcgcccggcctcttgtttcatctttagttttccactccagctcaagtccctcccttcttattttgatgcaaattccaggaatatgctttcatttgtaaatttttagaatatgtccctaaaatataagagctttttaaggccgggtatggtggctcacccctgtaatcttagcactttgggaggcctaggcaggaagattgcttgaggccaggagttcagaccagcctgggcaacatagtgagaccccatctctacagaaaaaaaaacattagctgggtatggtggcacatgcttgtagttccagctactagggaggctgaggtgggaggatcccttgggcccaggagttgaaggctgcaatgagctatggtcgtgacactgcactcttcagcctgggtaccagaccgagaccccatctcttaaaaaaagaggtgggggcttgttaaaaaaacccaacatagtgagattaccattatctcacctaaaaatatttaagtattgattttagtattgagaaatttaacaagaaaaagagcattttattatgagaatggcatgttatgatttgtttaaaaacttctgatatgtttaaaatacactataattataagcataatttttcattctgtcatatcattcagttttagtagcataatttaaaatagttctaaaaacaagcaataaaaattagattttaattaattagttaattttttttttttagatggagtctcactctgttgcccaggctggaatgcagtggtacaatcttggctcactgcaacctccgcctcctgagttcaagcgattctcctgcctcaatctcccaagtagctgggataacaggcacttgctaccacgccaggctaatttttatatttttagtagagacagtgtttcaccatgttggccaggctggtctcaaactcctgacctcaagtaattcacccgcctcggcctcccaaagtgttgggattacaggcatgagccaccatgcccagcagatattaatttatttttaaatatctagttctagtttatatatataaccagtatgtcctgttttaaattagaatcttttatgtaaaaatacagaaaatacagaaaattaggtttgagttctgatttaaatatatatttgtttcttttagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacaggtaagactgctttttattgataaggtttatgcttgaccaatagtattacagtattctttaaatgatgttttaagaatgaatatgttatattagaaaattgttgatgtaataccactacattgttggtagttcaggttttttgttgtcataatttatctttagtgattggattaataactgtgtgattaaagtgctttatagtagatgtatgcttaagactgttgattataaacttggtcaaatgtgatcttttcctcaagaaccaagattgtgtttaaagataggatttatacattttttttctaaaaagcatgttaataggactaaaattggagagttgaacttgaaagtagttacttgttaattcattagagtctggagtacttcaaatcagagttgaattattatgatacatacttgcatgaaaaccaagcatttaacaaatgctccatccctctattgttgaactgagttaaaataatgattatggttctttttgtatatgtaagagaacactatttgttaggtaactaaaaaaataattaagatggttcatagatgtttatttggtcttgtgaaagccatcattagactgtatttttccaaattacattttattcatgttttggttgaatgaacagattcagccagccggccccatctgttgggctacagaatagtaactgccatccttatgataccagtgcaaatcaacaaagtgccctaagcaccattttgaaggaagttcttggacttcctgatgattaatgaattttacctgtgaatgggtttgtatcttgtccggacagaaaggaattctgtatttacctaactggccattatcttggtgccatttatgtgctcctcataacttttcaaaagctgtgactggtgtcagaacaaggtggagaaagactttttgagctgattcagtataggaagatccctaggaacagctctgggcatggcagtttagctctgctctatcttactgacttgctctcccttctttcctccctattttccccacttcctccttccttgcttccatccttgttaggtgactattctgttttcccagattttcttttctactttaagcccgaggtagaaaatgatccatgtatgcccagttcttttctaatttcttcatcagaaaatgacatttagactctggaatataataccttttatgttactaatcttgggctttatttgtattctaccatagtttctcattctcttccctgctaaatttgagaagggagttaagagttaagataaaataaagagggagttaacttactcaactcctaatcccgtaatcctttctctgattagtacattcagtggactggagaacctgtgccaacctcctgataccctcctgtttcttgttcagaaagaggttaaattggggaaaaaagctttgtgagaaatgttttgttctctatggtggattgttggagagggatgtagcatatagaaaagcatagagatgagagacctgtttagtatccactcaccctttcacatctttttcattcttgatctaatccaccttgaaatgaactacaaatctgtatgtcccagttaaataacatatgtcattttccccatcacctttttattttgaaatatgcctacaaactctcgagttgaaagaatgacgcaattaacatcctaaactcaccagttactaacattttgcctcatttgtgtgctttctctctttttctctatgtagatgcactcccctcaaccttttgaaaataagttgcatatatcatgccactttacctctagccacttaagtgtgtatttcttgaaataaatgttttctcctgcataaccacacattgttattataccaaacaggattaatagtaattcataatatttagttcattgttaatgtcatttttgcttaagctagtttcagtttggtttctctttcaactgaaagagccctgataagtacattttcactttcttgaattcacgggacactttgagtctcttcataacactgcgtgtttacagataatatcctttgtgtgagaatgaagatgtaggtctaccactaatgacttcccccaaagcttagggaatgtgatttctttgggggttgtggtagaatggccataggacccacttctatcttttttgatccaagctccacaggtgtttcttttcatgaacaatccagttcagtacttttgaccctgggctttcaaaaaccaaattctgggagaggggaaatgtagtggcttcaattgtgtctcctaaagatatatgttaaagtcctaagccttggtacctatgaatgtgaacttatttggaaatagggtctttgcagatgtaatcaagataaagtcatactggattaagatagaccctaaatttaatgactggtgtccttatgaagaaagagatagaaacacagagggaaaaagaccatgtgatggtggaagcagagattggaataaccacccatgattgctggaaaccaccaggggctagaaagaagcaaagaaagattctcccttagaaccttcagagagagcatagccctgctgccaccttgattttggacttctggtttccagactgtgggagaataaattctgttgtttaaagccacccagtttgttacaggagtctcagaaataaatacaggaagccccagatctcttgggtattcagagctatatagtttctttagaaaaagagaaagtttttttattctttctgattctttctcattctgaagaactgtgagaggagactatgccatcttctgttatctgtttacctgaatctccttcacaaaactgtgacatgcaaaggcaggaatgttctcttgttaaggttttaaatcaaactatatagatttaaaaatgttttgtgactgaacaaagagatcctgagaaacttacagttttctctagttgagtctcttggctgtctttggcttcagagtgcttcagggaagtcaagtagccacaaagaggctattggaacattatagtttgcaggctctggtaatatttgagagaataatttcacaagtgttttggaacaaaagtcatgctgtaatggatatgtgatgaatggaaataggccagtggaggaagtgaatgcgagtaagtatgtaaataaagtttgtaagtaaataaataaattcggtagtgaaggaagtagtatctcgaggaatggtagggggctagagagttttgttgtgtttttgttttaaggtagtatgttgtaggctgagaggaaaaaggtagtgaagagtggaagattaaaggtataacaggggagtgataaaaatctttccccattggagaagttagctaaatgtttcttaagtgggtcttaggtccttggagatggttgggcatattctcaagggtttataaattctcagataagttagacttttgtgttttcttttaaatgatatgaataaaagtgtatacgctcgtgctagatcttttggatagctgccttataattgagtgccattacaagattttatgcctgcagatgagaacaagtaaacaactgtataagtggtatactcttgccaaatgaaggtttcccatattcaaatagggatggtgaatgaattaagccatctcatcccctattggataaaaggcttgttaaacacaaaagatgtgtgtcaaatctgttggtatcatatttatattgtaattagcagtttaaacttagcaaaatattactatcatgaaactaatatattttaaaatattttattggttttatttgtattcataaatgtttgttttttaattgtgataaaatatacataacatacaattcaccattttaatcattttaaagtatacaattaagtggcatttagcatatttacaatgttgtacaactgtcacttctatctagttccagagcatttttctctaaaaagaaaccccagatcaattaaatagtcactctctttctctcctctctttccagcccctggcaaccactaatttgctttctgtctctatgggtttacctattctggatatgcgatgtaatgagaatcatgcaatatgtaatcccttgtgacttttttttttttttaaaaggtaatgcacgcacatggtaaaaaactcagaagatgttaagagtatagtaaaaagttggccgggcatggtggctcacgtctgtaatcccagcactttgggaggctgaggcgggtggatgacctgaggtcaggagttcaagaccagcctggccaacatggtgaagccctgtctctactaaaaatacaaaattagctgagtgtggtggtgcacacctgtaatcccagctacttgggaggctgaggccagagaattgcttgaacccgggaggcagaggttgcagtgagccgagattgcgccgttgcactccagcctggacaaaaaagagcaaaactccatctcaaacaaacaaccaaaaagggaatatagtaaaaagtctcccttccctgttacatagctgtctacttcccttccccagaggtaaccagttactagttttttgtatgtcttttttgaagtattctagaaacatatttgtatacatatatatttttttctccatctaaataattgttcactagcttccttgttctatacattgcatttttactgcaacagtatatcactgaaatctttttgtcaatgcatttagaactaccttatttatttatttatttttttgagacggagtcttgctctgtcacccaggccggagtgcagtggcgtgatctcggctcactgcaacctctgcctctgggttcaagtgattcttctgcctcagcctcctgagtagctgggattacggcacctgccatcacacctggctaatttttttgtatttttagtagagacaggggttcaccatattggccaggctggttttgaactcctgacctcaagtgatccgcccacctcagcctcccaaaatgctaggattacagacgtgagccgctgtgcccggccagaactatcttatttttaaaactaattccactgtgtggatgtgccaaatgtacttaaccaatgtcttaataatggatatttagtttgtttgggatctttcgttattacaaatagagctacaataaatatctatataatatatacatataggagactatgttcataaataccttggagtaggatactcatcacaaggtatatgcctttagcattttgatggataatgataaattgccttctacagaggttagtacaggtttatactctcatcagcaatgcgtgaggagtgcatttatcatgtattgtgatgctcaatctatatgtaagtatatattcatatttttgatatttgacaatctaagttaaacagtgttattttgttgtgctttcaatttaaactttttgatgttaaagattatttaaaaattacagaaaaaattaaggatagtaggctgggtgtggtggctcaggcctgtaatcccagcactttgggaggccgagatgggtggatcatgaggtcaggagatcgagaccatcctggctaacacagtgaaaccccatatctactaaaaatgcaaaaaattagctgggcgtggtggtgggtgcctgtattcccagctactctggaggctgaggcaggataatggtgtgaacccaggagcggagcttgcagtgagctgagatagcaccattgcactccagcctgggtgagtgcagactctatctcaaaaaaagaaaaaagaaaaaattaaggatagtataaaaaacttccacaaatttaacatttttgtgtgtattgtatgtatatgtgtaatgtttcagtactagttgagaataagatactgacatggtgctccatcacctgaaattcttcagtatgtatttcctaaacaaggacaggctgctatatgataaagtacagaagtacaacagtcaaaatcaggatattaacactgatacaatgctatggtctgaatgtttctgtttctccaaaattcatatgtagaaacctaagcactaatgtgatggtattaatattaggaggtgagggctttgggaggtgactgggccaggagggtgaagccctcatgaatgagattatttcctctgtgaaacaggccccagagagttgccatttctctttcaccatgtgaggacacaggagacagtgccatctatgaaccagaaaggaggcccttaccaaacactgaatctgccagtttcttaatcttggacttcccagcctttagatctgtgggaaatacatttctattgtttataagctacccagtttatggtattttgttatagcggcctgaatggactaagacaacgtcctttatggcagaaacaaatttaaaaatgaataaactttttttttttcctgctggaccaggatatgtgttgtatttagtcatcgtgtcttttagttgccttcaatctggaacgttttcttagtctttgcttctattttgtgactttttaacttaaggagtacaggccaatcatttgttgaatgcttatcagtttgggtttgtttgatatttccttataattagttttagtttacacatttttggcagaaatatcacggaaatagttcttagtatatcaatcagaaggcacatgatgtcaatttatcccattactggtgataataagtttgattatttggataaattggtgtcagcagggtttcttcaccataaaattatttttacctttgaaattagtatctatggagagttactttgaaatttattactataattgttgccaaatgttagttttctcattccatctatatttattagttggcattctgttgcaaggaagagctttcccttctcccccatttatttgttaattaatttttatggattcataaatgtctgttttattcagtgggttataatctgttatcatttattatgatgctcagattgtctcagatttggccaatgggaatccttttaccagggttcctgtgtccttttgacaatccccatcagtttttgagcgtttttgtgcttccggcacaataagatctttcctgccccagctgtagaaatcattcaagagccctagttcttttttggtggagaagtgtatttaaaaaccaggaactgaccactaggtgtactcattgatactgcagtgttattgcttttagctcttctagcagtcaaaactcgaaaatctatatatgattacatctatatttatctataaatattaaaaaccatcagctcataccaatacctccaattctaatatagtaccccagggttcattttagtttgcagccctttctttcatagtgaaaaatttggttattgttatcttaaatatatttacctattaatttctgtttaaccagtctatcaaaaagggaccaaatttaatagtaaattttttttttttttgagacagtctcattctggattcaagcaattcttgttcctcagcctcccacgtagctgggactacaagcgtccaccaccacactcagctaatttttgtatttttagtagagatggggttttgccatgttggccaggttcgtctcgaactcctggctccaagtgatttgcccaccttggcctcccaaattgtgggattacaggcacgagcctggctgagattttatatccttattaaaagtgcttatttgaatagaagttagttatactttttctcacagaaactatgacatgataaaacttcttttgtttgtgtatgactcttttagccccatcataaaaagggtttttgcatagtatttgtggattgcttaacttttcctaggggcctaaaattctttgatattcaggtcagtctctttccaagtacctatcatgtcaaccttttgcaagatttgctgtttcattttgtagttgattgtcatgcagtctcaaagagactttgatattatggttgaggtttaagggacatttgaatggaaactgatttttaaaaatttgtgaccagttgattggtgaatctgttttcttttctagtggctcttacttccttatataacaacctagacataactgcaaggaatcagatattgaatattcagagccactatatctttttccccatagaaaattctccacagacaattgagttttgaggagatcatcctttgtcctttagggctcttttatgaagatttgggtcagggaataaattaggttttatgatttttgggcgtatgagcattgtttctgatccacacagtcagtagtccagtctgctgaagaaggggaaacatgataggtgtatcctttctcctttcaaaaatacaccattgaagataattctcccctaactaatttgccttctagttcttgtcctagttgtcaggattaagaagggcttttgaggaaacctatacactgggactgttcttttgaattcctgccttggatggaagtgaataaaaaaggtcctaaaggtactaaaaaaggtcctggtcatttgaatattgactctctcatatgcatccttccaaatcatcctaaaggatgtttgaaactactgaggtgttatccagggctatttctaggaggttgggttatcaaattctctccagagtatagaccatttccttctttttttttttttttttggagacagagtctcactctgtcacccaggctggagtgcagtgatgcgatcttggctcactgtaacatctacctcctgggttcaagtgattctcctgtctcaggctcctgagtagctgggattacaggtgcccaccaccacacctgactaatttttgtatttttttagtggaaacagggtttcaccatgttggccagctggtcttgaactcccgacctcatgtggtccgtccgtctctgcctcccaaagtgctgggattacaggcgtgagccactgcacctggccaccagagtatagagcattattttttagatgggtcactcaagggaagaggcaacaacctgatgatatggatattgggcagtagttaattaacatgggttctagagggttgtctgtgtgtgtgtgtggtggggggcgggggggaagggtgtggtataagacctaatattaaagctcaatttaaaacattttaaaaataaattttattgtgcatacctgaggtttacaacatgatgttatgggagatatatatgtgtgtatgtgtgtgtgtgtgtgtgtgtgtgcatgcatgtgtgtatgtatatgcatgtgcacacacgtacatatatagagacagtaaaatggtaatatagtgaagcaagttaacatattactcatcacatatactgttttttgtgtgtgaccagagcacctaaaatctacttatttaacaaagtacctaatacaattttattaactatagccttcatgttgtatattagatccctagacttgttcatcgtacatatccactacttgtatcctctgacgcgtatctcccgatttcctctccctcctcccccaccaacccacctttctgttctagtaaccactgttttatttttaatctctgtatgtttggccttttttttttttttaaagtaacattccacatataacgtgagatgcagtatttttctttctgtgtctggcttaattcatttagcataatgtcatccacatccttccatgttgtggcaaatgacagagtctccttttttaaggctgaatgatattctattttgtgtatgtgtgtgtgctcccatgatgcagcgaacatgggagtgcagatttttgagatggtgatttcatctcctttgggtgtgtgccaagaagagggattgctgggtcatatggtagttctatttttaatttcctgaagaacctccataatggctgcaccaatcttcattcccactaacagtgtacagggttccctgttctccacacccttgccaacatttgttatctcctgtttctttttggtgggggagtggggcggaggagacaggatcttgcttggtcacccagggtggagtgcagtggtacaatcatagctcaatggaaagacaaaaaaaacccaaaactatagaatagttgaaataataatgacattcagcctctactttttggagaatgaactgtcttcctatcttgtctttcatttgaatcctcatttaaaaacaaaatgtcagagaagtggtaatttgagcaaggtaacataggcaaagaagaaaacacaagggaaagaaaaaaataaccaaaaagaatatatttttatatcagctaatatgcttttggttcaagtatcgataaaaatactagcttatataactgaaggtttttattggcatgtataactggaaattccaggcttcagggctgactggtctagcagtttaaaggatattgtcatgagcccagtttctttctatttattccatctgtcatctgcaggatgggttgcattcttagactggctccactcatgttaaatgatggatcccagcaactactgtggccacacgctttttctcatctatctcatgacaggcagatggttcctactcagaatcactaaataagatttcctaactttgtgctattgctgaccactttcctgtgaccaggggtttttctaatcccagtcttagtttgccatcgtgaagaggaatccttaccagtttctgagaatcctcagtgtacgaagcaggcacatacttttcatctccttccttagaagtgagagttatttcacccagattttctggctgcaacacaatgagtgagtggtgtagtgaatattgtgagacgccaccagcaaacataatgttgactatactgataaaatgattaagtgaaagaatggctaaaataaataagagtagcttagcaatgtttgcagtatacaaaattcatctaaagggcaggccagcttctgaggcagagaggctcctttagctcaacatatttttacaccaaggacaagacttggccaaacagagatccttaatagacagctgggagctattttgtgaagatatatgtaaatttagattatatagagtaggtctgtgattcatgtagcatgggtggagtaaattttataatttgactcctttggttttgtgagggttttcaaggtccttaaatcctaggttttgattgtcttaactgcttaacatcacagaatatcaccaccaaagcacagtgatgaagtgtgagatatttaaatgctgtaactgagaataactcttagagattggatttaccctagtttttgccctatttttatgtgacagatttttttttttttaagtcttatcttcctctcatgttgcattgtgattatatcaaacataatcttatgtgccccttcagagtcccttggcaccatctgcctcgtagaattttctgctgccactggaggctaaccagttgcttcatctgaggaatgagggccctatgccttggtggccaccatctagctaagtttatgaaccatactctgggagggtctggctcctcctgccacttccaatcttgggtataacgccacacaacatccttgtaggtagcaccctaagcatctgtgaaggccagatgacacaaaatgaagtgcagtgtacttcagggtggactttgaccagtgggaaataggagacaggagggaacctgccagataaatttcttttcccacatggactactctgaggtatggtttctttttgtagtctatcaggagacattccacaaagagtacaccaagtggatgcatttgttaagtgacctactattttttttatagcttgttgtaaaatggtagccagcactttcccttgctttatatattttcttgcctcagtttaccttctcttcacctttgatgccctgtgtatgcacctctcaagtgaaacatcagcattttaatcaggctctgtttgccagagaactgggccaagacaaagattaataaggcatataattcttatcttgactcttttggactacctcctaaaatacagaaaaaatttctgtaatcactgtactttttgtgccttaaaaagagtttgtggaaaaaatcacccctaccccacaattattctttactattatatctaatttatctaagttttagtaattcaactttgttcaaactttgcacatttttaatggctaaagactttaaaatacactacttgctatgttttctttttaatgataatttttgaacattttattatgatactttaaaaaatcttacataaatgttgaaagaattttgtgttgaacacccataaacctaccatctcaagtctacaattaaaattttgctatatgtgttttattatatatttatccatcaatctacattaattttaaaaaagagttctaaagtttcaaatatgagtacgttttcctcaaaataattcatgcaattcattaagattaatgtacttaagcctaagtgtggtggttcatgcctgtgatcccagagctttgggaggctgaggtgggaggatcacttgaggccaggagttcaagaccagcctgggcaacatagtgaggccctgtctcttaaaaaaaaaaaaattaatgtacctaaatacattcttttcataaaactatctaaaatactgcagatacaactcagctgttattgtgggtgctgtgcttcaaataaatggtgttattcagtatttatctgcttacaactttgacacttgtgaataaaaaaatcaagacaattaaagtggtaaaaacaaattttattcagtaaccactggcaataggggaaagagctgagctccatgatttgtgcagtcatgactgggccttttaaagggagaatgagggagtacggaaggggagcaactgagggctcaagtagcgtcaggaaagtgaaaattacaaagggctggtgctgtggtttgaatgtttgtttttcccccacatttatatgttgaaatcctaacccccaaggtggtgatattaggaggtagggccttttgggaggtaattaggtatgagagtggagccctcatgaatgcgattagtaccctttaaaataggcccaagagatctcatttgttccttctaccatgtgacgacatactgagatggcgtcatctaagaaccaggaaatgggcccttaccagacaccaaatctgctggtgtttttatcttggacttcctagcttccagaaccacgagaaataaacctgtgttgtttataagccacccagtttatgatactttgttatagcagctccaggctaagatagttggtcattgtaaatgtgagtgggtcaggtgtgcctgctcgctgacagttatcaaaattaggattctgtccttccacagagactgggacacagagatccaaaccttcctgatgattacatttcaaaggagtggctttctggttcttgagaaagacactgctgagttgtaggagatacatacacatctcaaagggacagaggaagaatttacaattgtaaactcttcttagtgctctaagaaaggaaggtcaggggcctatagtcaggtgttggctagaataaacagtaagcttcttttgatagccctgaacttctccagacagactggagctcaaaaggaggctgggtattccagggctgagtggaggtgggctaggctactagaagctttgctagagttggtcaaggctcttagagcaagaatttggatggagttgtttgccaagaattatttacagttctcattagtttgccttggatgttttttgttttcattttagaacacgtagatccaccttattctttttaattgctgcaaagtataccatggtatgaatacatcatagttgtttttagttttagtttttttttttttttaactattaaaacctctgcagtgaacatccttatgcatgtggtcttgtgaacatatgcatgtatttctcaggagttgtcagatcataatgtgtttgcattacactttaatatggtctgccaaattgccttccaaaatgactgccatcattagtgtatgagagaatttattttcccaacttcttcaacacatgttactaaactttttaacttttgccaattgaatgaggaaaacctactgttatcttttgtgtctccctgtttacttgtgaagttgagttctttatatgttggacatttgtgttttattcattaagttatctgtattctacaaccatttttctattgtatttcataagcataaaatttaatataaattttatatgatacaggagccttcataagtaaatgaagactcaaaaaattggtaaacttgtatattttttatttttacagtttatttttatttattgatacataatagttgtacatattttgggggtgcatgtgatattttcatatatgcatacaatgtgtaatgatcaaatcagtatattaaccaaaaatgtgactcaatcagaggtttattaagccaaagtttaaggatacacctgggaaaaacacaagtcacaggagcatctgttacctgtgctttccaaaagagggtttctggaactcagtattgaagaataaagagcaagcagaagggacaaaggaaggtaagagaggcagtgagacaaatggttacatttttgtgaggctctaattagtgctcagtaaatctgtgttttacataaggtaaggtaaacatttgaaaagatggagtagaggaaagagtcagttatgcatccatctcgggttagccgaaggagtgatttttttttttttgataatttcattttattcccttgggttattactattattatttttcttaaacttttatttcaagttcaggggtacatatgcaggatatgcaggtttgttacataggtagatgtgtactctggtggtttgctgcacaggtcatcccatcacctagatattaagccaacattcattagttattcttcctgatgctctcctgaccatccctataggccccagtgtgtgttgttccccacaatgtgtccatgcgttctcatcattcagctcccacttataagtgagaacatgcgatatttggtcttctgttgctgtattagttggctgaggataatggcttccacctccattcatgtccctgcaaaagacatgatcgaaggagtgattttttgtcttgtccctgttgtgtacctaagaaggtaagcttgtaattgacattgtcagcatgagatttaacagaactcagttttgagagttaaacttaggttgcacacccaaggttacaattggcatgtgctggttttaggggatatgtatcctgaaaggtttagtgactaggaagggattttcttatgagaaatttgtgagggaggtatatgtccttttgccattgcgggacaatgctgacttaacgtgtaatgctatgacacagggttgtgaaattatagctctggggggaaagaggaggaaggaaaggcagtgttgcatgactaattttctaggtttaactttccttttggtataatgagtttggggtcctaagattttattttcttttacaagagtaattaggacagccatcacctcaaacattttttatgttgggaacatcccaattcttctgttttgaactatacaataaattgttgttgactatagtcaccgtattatattactgaacactagatcttattctttctatttaactgtacttttttttttttttttttttctgagacagagtctcgctctgtcacccaggctggagtgcggtggcgcgatctcggctcactgcaagctccgcctcccgggttcacgccattctcctgcttcagcctcccgagtagctgggactacaggcgcctgccaccacgcctggctaatgttttgtatttttagtagtagagacggggtttcaccatgttagccaggatggtcttgattcctgaccttgtgatccgcccaccttggcctcccaaagtgctgggattacaggcgtgagccaccgtgcccagcttttaactgtacttttgtacccattaaccaacctctcttaatccccacctctccttcccagcctctggcaaccactaatcaagtctctacttccatgagattcacccttttagctcccacatgtgagagagaacatacggtatttgtctttccgtgcttgggttatttcacttaatataatgacttccagttccatccatgttgctgcaaatgtcaggatttcattttttataaccaaataatattccattgtgtatatgcagttcattttctttattcatctgttgatggacacttaggttgatttttttgcctttgtttattgactgtttcgtaaacattttgtttcacaaaaatctccaactgaagttaataataggtgatattgtggaatatatgtttggcctttgaccccgtttccctggtatacaactcctaaaatccttacgacctccaaagtaatgtctgtttgtgtgctagtgattgattgatggctgacagcccctaggtagtttcaggatgtgagttggttacgtgaaagaccaaggcaccattagagagttggaacgttcagcctcacccctatctctggggagaggagagaggctgagggttaaattgattaccagtggccagtgatttaatcagtcatgcctatgtaatgaagctttcttaaaaagcccaaagccctgtgttgtagagcttcgagatagctgaataagtggaggtttctgggggttgtgcctggggtgggcatggaaactttgtgtcccttccaccataacttgccctatgcatctcttacatctggctgttcatttgtatcctttgtaatatcctttataataaactggtaagcgtgtttctggagttctgtgaccactctagcaaactaatagaacccagaggggattgtgggaaccccaacttgaagctttttggttagatgttctggaggcccagacttgtgactggttgtgtagcaggacgagccacagacaaaacctctcagacaccgagttgtagaaggaagggctttattcagctgggagcatcggcaagctactgtcttaaaatctgagctccctgagtgcacaatttctgttccttttaagggctcacaacactaaagatttcacatgaaagggtcgtgattgatttgagcaagcagggagtacgtgacaggggctgcatgcaccggtggtcagagtgaaacagaaaagagcagggagtttcacagtgttcttccatacaatgcctggaatctatgggtaacatcgggttctaagtcatgagttaatttttaactactaggtttaggccaggcaggcccaggcctggttttggacctggcgccgggctgcctgtctttgatttcacttccttgtttttttcttaaaacaggtactgagtataaaacaatataaaacaatatgagagggtctctctcttccctcaggtggggccatggggtttgtggtactgagctcttaacctttgagatctaacactatctcctgatagtgttggaaagttgaattagaggatacccggctcctctccactgcagaacttaacttcttgcttggtgtgtggggagaaactcccacacatttggtcacacaagtcttcatgttgattgttgtggtgtgagagcagaggaaaaacagtttgagtttttcactctcagacagcacagtgattcttcataaaactctatgactacaccaacgagcattggcaaagaacaaaaaattattcgatgtcttttaccagttccataaactggcagtgattcatagcatttacacatatattcgtaatattcttaacaagtatatccatgataccttttcatagtctgctttagaaagtcctgcatagtattttccacttaattctgcatcagtagtatagcttcttttaatttaaaaacttgtccattctatttttaaactagaaagataattttattgtaatataatcaaacagtaataaatatttcagattaatcatcaattacaatttacataggttatcactaatttgtgctgtctgcattgaggactaagctctgatttttttttttttaatcttgcctaaattcctatctaaggggtctggggaatcatgctctgtaaaccatacattctcatcagatggttttatttaaccctgtatatcatgacttactttccgatctgactctggcataacatggaagaaaataaaaatattttaccccaaaacatgtttctctgccatatcttgaaatggtcgtgcaaagccatcccttgtgggaaaaatccacattctatagagaatccactttccccttgttttccttccttcctttctagatccaggagataatcaagtaagagccaggcactcttttaggtctgataataaacaatatacaacctgttctctctgaagtctgctatctgagagcttcctctgcacaataaaacttggtgcctacaatcctttatctttacctgaacatacatttcctttctattgatcccaggtcttcagataaactcaaccaattgtaaaccagaaaacgtttatagcctggaacaccgcccccgccgccaccccgcccccgccttgagttgtcccgcttttctgaactaaaccaatgtatttcttaaatatatttggttgatgtctcatgcctccctaaaatatataaaagtaagccatacgccacccaccttggcacatgttcttagggccacctgagggctgtgtctttggccatggtcactcatatttggctcagaatcaatctctaaaaatattttatacagagtttgactcttttcgttaacagcgtgatatattcaaacacactatgatctgcgtctttcattttaatgctgcctggagtagaccatgatatggatgtattgtatgcttttaactccaactgatgtgcttttagattgcttccactgtatgcaactgcaaagaatgcttcgttgctcccgtgtgcattttatttttctaaggtatattctgagacataaaattaccacaattttagaagatttcctactcatgtaaaatattagtagatacttccagatcaccatccaaaatgtcattttacactcccttcagtggtacagaagagtactctttcccttctatccttttccactcttggagtcttcttttttttctttttttgaggcagggtctcgctctgtcaccgaggctggagtgcagtggcatgattatggcttagtgcagcctcaacctcttgagctcaagtgatccttccacctcaggttcccgaatagctggaactacaggcatatgccaccacacctggctaatttttgtattttttgtagacatggggtttctccatgttgcccggtctggtcttgaactcatgtgctcaagtaatccttggcctctcaaaactgttggattacaggcccatgtgccactgagcctggcctcactcttggcattttaagtcttaaaaaattttgctaatctaggaatgaaaatcatttttagtatacatttccctgataactagtgagattgaacattttttcatattttagtagtgtttcattcttaacataatacctgtatttcttctgaaaataacaaaataattatctaaagtatataccctgtgttctgtaatacctgtatttcttctgaaaataacaaaataattatctaaataaagtatataccctatgttctttctttggttctcttttaatgttccaaaagctcagaaaatgctagaatgattttgagtacctgtggtccagttgttgttggggcaggtcgattttctttttgcatctctatggacaagaatcatttgcattactgatttctacaatttacagagctgtgaaactgctcaaagacaatgaaagggtagaactattatggaatcaaattactcagtagcgtataccagacaacatctagcattccgtagaacatccagcaatctttcactgttttctgaaagataatacacttaaagcttttaacacattggctcacagtgagagctcagtaaatgtaatttgcttctccattgttaaaagaatgaaaaacaagataattgagaatttatagcatttctgtggaactacagttccctggataggtgctgtatctagattcatttttgatttcattgggtcttgcacagtgcctgggagcatttatatacgtggtcagtaattaaaaacaatttatttttcctacctcttaataactatcacagttgttcagtaatagttttattggatagaactatgttcaagtatgttctaatttattcccctatctggaaaaatatgtatattgtgagaaaataggtttgtcttgcttacattattatgtatcatatattttcatactggggttaacaaatatattctaagcaccgaaactggtggccttgaaaatggctagactagctgtttcctttcatagtccaaactgtgtgaatatagctaaataaaaaatctggctctattataatagcaaatgtgattttgtatgtggagtcttaaggcgtgattatactgtttctcaccatgaacagtgattttttacacatgataaggcaggctagcaaattcacatacattacggctagaataatccattgctttaaaaacatgatttttacctgctttttagattgagtgttctataaaaattttttcttaagtgaaaaaaatatgcagaggctaatgtagactgtaaaatgaaggagaagcttagctttactgtggagtctgggtctgggtgtaacctaactagctagaggatatgcaattcctgattgacagcagatccagcattatgcagattttgtaagggagaacactcagctcagaaacagtgatgagaggctctgttaggaattactacattcactactcatatcttttagttttctgtctactggatttgtaaataaatagcacaaaacagttcctcttttgtttttattaaagtgatactgcaatgcagttcagtctgtcagctaggcatacatgtgtgaaatttgatattctcactaaattagctaatttttagctgtgttccatgcttatctctagacctttgtgtattaaatcctgtctcgagctgttccctttatacacaagtgtgttttgcttgtgccttcctgtcttcttcagtgagaagctttatgtaggtcaggcttggcttaagcagatttcctgaacctgcgtcagcttaagctggaggaattttaataaaccctcccctgtaggcgtgggcctaaatgaggctagcctagttaagcctgatctttttctgtttgtgaaaagagctgagcagagctgaaggctgcatggtggtttcagaaactgcctacttaatttgaaaagaacaatggtaggaaaggctagatcttccaattttaccttatccgaaaagcttgatttgctaaagcttgtgaagccatatgtgaaaattctcgaagaacacactaataaacattcagtaatagtagaaaagaatagatgttgggatatcatagcagttaactataatgcaattggagtagaccgccctcctcgaacagcacagggcctacgcaccctttataaaaggctcaaagaatatgccaaacaggagctattgcagcaaaaagagacccaatcagattttaaaagcaatatttctgagccaaccaagaaagttatggagatgattccccagatttccagtttttgcctggtaagagacaggaaccacatacaaaggtaagctttattttgttttgttatggaaaattatggcgcctcctatctattgggctttggcttagtcgtgatagagatatgcatagtaagcatccccacaacgggagcaatgaatagtgtctttgttttgcattttttaaaaagagaaaagtgaggctatgaggaatttttctgttgcatttaagctactttttactgtcttcccctcccccttccctcctgtagtttctaaaagtaaaggttagggaggaataagtgggttgaaatttgtgacatcacttcataaacttcttaagctttaaaattaaattatttagtttgcttctgagagatactttttttctcatttaagattacatttcactggaattttcaattttatataaaatttatataaagttagcagtttctagagaaatggaaccttgcttttttatgaattgtcattgtctacacttattgaatatatgttaactaacaaatataaacaaaatcaataagtaaacttgttaatggcatgattgtgtatatgaagacagtttaaattatttttctaacacgtttaaaataaagatgaacacaactaaagggagttaatgcctaattagggattcagtttacttaataaaattaaaagttttttgttgttgttgtttttattccttaatagtctagtttcactttgatcttgggtcgtataggaaagagtaagctttctcttactgctttgcaaggatatcaaattatgaattttaaaatacccctaagagcaactgggtttttttagagttagaagcaattttttggttaaacttgtcttctatgtaactatttgccttggaattttcaaaagtattatcttgccactaattcagattgtaacctctggcaaaatataaaaatggcagctacattcttattctgaaccatttagggtaatttaaacaaattgtaaactccttgttagtttgaggagcctttcaaacaaagctttacacaatgtgcttttctattggtggaagaggcattatataagcaaattattgattactatgaaatccctttgaaattaggagagaagcagaaaaaaaccactttgtagccaagtgcatatgttattttggtaatttactaggaaagtatttttgagcctagcttcttaccagatactgcttatttctacttgatagcacagtaaaaaaaatatcaccagtgggaatccaggacatgaatacacagtggattaattcttggggccactggttaaaatgttcactgtgatgacaaatgatgaaatcccaatagctagatatccagaaaactacgcagtaaaattgttttatactgtgctacttatgcagaattttctctcccttgaaccatggagaaaagtgttttttgcatcgcaggtataaaactgtaccctttggttagtaggtataggtttttataatttgaaaacgacatgtagaaactgtaattttagttagttgcatattttaaaaataacagtgagtagaagaaaaataatatataaatatacaagtatctggttacattttgactatttgtgtgtgtgaatatttacaatattcacacacaaaaaatcttttgggatatgaacatttctctgataaaaatgagttgatttgtacatttctatacctatggcttaaataataccaatttgttaggttttaaagggaagaatataagaaacatgccttttaaattcttatgttactgtgtctacattgacattttctctgtattagcttatttctttaatatatatatttaatgtgcttatatttatttgattgatatcatccttgaatcttaataatctcagaagtttataattattctataatcttaactatacttctacataaatatgcctgttaatcttaccaaactcttcctttttaataaggaaaatactagtgtttgcgttaacatacttaaaaatatatacctgttttgtaaggctatttattttctgtaactcacattgacttatgtctttatttttacctcttcctaatatcagtttatattttgtgtttttgtaaactgatcttcaaagttctgattctcaagtccttctctgtcatttttgtgacctgctctaaagctttttttctccctttttatattgttatgccttagttgtaatgttttagctaaaatggaaaggaatgttccagatatgaggcatatttttaatttacttggtagtattatgtctatgtttatactctctattttacatactaatttgaaatagtaattatgtggttttaaaaacttaattttcatatgcaattttagccttttcccattccaggttttagcagagctattaatagaagcagagcttgctactttgaattacatttataattaattgttttgtttttggaaataataaaatgacacaaacagagacaagaacaaaaatgaatttatataacctacaaatagattttttattatatactatatatgtttcattttgtctcttagataaatatctgatatttctggcaatttaatggcattagtaagtaacgtatgggtagttttaatctttttctatgcattctgcttgaacttgttccagcattttaatcatccatgtagaatgtattcttttaattatgtttcttattatatgtaaaatcttctctaaataatattaaataaagtatttccattcatgttcaatgatctaatttccctttataacttttatttttaagttaggcagaagcataaattaaaaaaaacaacctcaaggagcagatattcttaattcacagcttcacgttatacataaaattatgtttataaaacagaattttaaggtttattgcatttataatatcataacttgttatgctgaagcttaaattatgctaaagctgtagttgtctccattgggaatgcatatttggtggaaattatgtgtaaatttaataaacctttaatatatctgtataggccattaaaaatgtttcattaaaaaatcatttagtttgttttttttcagtcattcaacacataatgagcacctactaggttctaagtacagtacctgctaggtactgagtatacagttgtggattaaaaccattgctcttgtgaactttacctgaccagtgattgaaagacttaaacagcatctgagtcatatggttcagaataggtaaaacggaagtttttcctatcagataaaagcatctgaaataagaaagttaggataacctccagtagttgagcatatcccaaagccatatacaatctttatgttttattttttgggcaaatgcagaaatcagtacctcccatagatggcctttcactgtccttttataagttatgggccttcatggttttaagatcagtccaggagagcagaagcctgaggtctagggctaaggtatggggataacaagactgagaatgcattaaatggctctgtacaccatttgaaaaccttagggttgtgggaaagattggtgtctgtttgacaacatgaaaactggcttttctttttattttcttcattggccttctataatatttgtaatttcctgctcctttaaagcacaattttaaagttaaggatgggggagatctgtgagtatgtattattgaaatcccaatcttagtcactttaatgtatttcaagtgtttaagatttttttttattttgtaactttatagttttaaagctttatcatttaatgtacattaaattaaaattatgctataaatatacactttttcttcatttgatttacatattataatgcttttttgtgtgctatagtgcaaacttggatgaggaggcacaggctggtaccagttcactacaggtaatgttggatcaccatcctgttgctattacagtggaggtgaagcaagaagaagacattaaaccacctcctccactggttttaaattctcaacagagtgatactttagagcaaagagaagaacatgaattagtacatgttatggaaagatccttgtcgccttcactttcctctgttgatatgagaatgacatcgtctccatcttctattccaaggagagatgatttttttcggcatgagagtggtgaacactttaggtcactattagggtatgatcctcagatcctgcaaatgttgaaagaggagcatcagataattttagaaaatcaaaaaaattttggattgtatgttcaggagaagagggatggattgaaaagaaggcagcagctagaggaagagctactaagagcaaaaattgaagtggagaagctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggcatggttatagtttttattgtcttcttttttttttccctaagtttaattgttgaccttacaaaagatattttattctgatcactaagatatacacaaatgcatatacaaacacatattctttcaaagttctgagtcttcaacatttttagttagaactttgaaagctataattagagatttttaagtcagtctaatttaggagctatactaacctaataccaagaagcttgtctgtatgacattggtttttatgcttttatcttttgaaggagtaaatcctaggattttagagatggaagatatttggagaacactttttttccatctctgcagtttaggggtaatgaaacaggtccagggagaactcaatgacttacttagggtaacaaagctatttatggcagagcagagaccagcacttagtttttctttgtgtaatttccatcccgctattcgatagaagtaaatatccactaaaacattctctagatttaaatattagaagcatttctttcattaaaattgcctttaaagattgttaggttgtgaaatcaggataattacatcaattacccccattctctctctatttttgttccagcaaaatagataaggtattccattgaagctattatatattttggctgtgtgatttaaagacatgtcttaattcattttgaatgtcctgttctggaaaaaatttctttcacagtaaaaatcagaatgaacaaaattaaaattttatgtattttataagtattgttattttagtattcatggaaataaaacctcaattcttaaagcatacatattaaatttatattaaatctctaatatgtatgttacttaagaatttctatttttgctggggttttgttgagaagggatttttaagccaagttgtagaatggggtgggtgtaatttcagcagtgaaggggaccatgggtgtttgaagtcaagagtgagacgctggaaaaaagacaaaagaatgggaaaaagtggattgagtatataagcacaaatgcagtgctaagccattgattttaagtgaatgtagagagagtcaatttgggctgtagtatcctggactaggaaggacatctccctggactaggtagggtagctgctgtttagctccagcagaattttcacatgcggggataaaccagaaatctgcattttttaatgaggaatcttccaattttaaaatgtttgcaaataacacaaaatgcttttaaaacattatacagacaacatgtgagtgggcctcactgagccattgggcttccactttgtggcctttggagtagaccaatggttttccaagtatgggtcctgaccagcagcatcagcatcacttgagaacttgttagaaatgtaaatccatttccaagtgaattagaaaccctgggggtgtcagcaatctcttttaataaaccctttagcgattctgatgcatgctaaagtttgagaaccagtgaaacagagtattttggaacctcgcttggtgcctaaatcatactagtctcaaaatttttgtcgaagagtagttgaaagtgaactgagggatataaatttggatgatggttgataccagattatgaattacattaaatactttttttttttttttttgagatggagtcttgctttgtcacctaggttggagtgcagtggtgcgatgttggctcactgcaatctccgtttcctgggttcaagcgattctcctgcttcagcttcccaagtagctgggactacaggcgcaccaccatgcctggctaattttttgtgtttttagtagagacggggtttcactgtgttagccaggatggtcttgatctcctgacctcgtgatctgcccgcctcggcctcccaaagtgctgggattacaggcttgagccaccgtgcccagcctaaatactatttttaatgagtcagacttaacgtacaatgagaagccattgaatgctttgaattagagggctaatttgattatagttgtgatttaggaggagtggcatttagggacaggcattgtattggaagaacttaaatcagaaatttaagttatggctatagaaatagaaaaaaatgaactcaaggtactattttagcatgttgactacttaatttcattggttggattaaaaagagggtgttttatagctggtagagttaacttctttaattataaagatgtcctgaatatataacttgatatatccttttgacaatgttaccttttctctttaatctgtgctatgacttttctttgagtctaatgaatcttgtaattcttaatttgaggtaatgtttcccagtataattctagtaaacacatcttggcagtagtaagctttattttttgaaattattgaaagcacatatatgagatgtaattcactttacagtttcagcatgctactaagaattgataatgaatgttcaatttaaatgttggcttttacagcaaatcagagttttcccaagtgtgttctgtggaacattaattctgtgagatgtttctagaaaagagatctgtgttaaaaaaaagtgcagtatacatcttttttatttttggtggttaggttctaaaataattgtggaaggtaaaaattatgtatatacaaaatagcccttgaaaattcctttgctgcccataaaatagcataaacatagtctgctacaatcatatttttctgcagcattgtttaagattgctttttctttagtgtgttaggtgacacaattcattagcatttaggggctgtatacaataagaaacctatttttacatatttttaaacaccagaatcacactctttgagtttactgcagcaacttttccaagtcaatcttgtttttctccaagtcagtcttgtttacttttaatttgcaaaagtttaaatgcatataattctcctcattgtctacctccccttgtataaccatgattaacatagtatagtttatgagaattcctgtataaagaaaattatttatttgaccatagaatccttttccgaggctgtttattatcttacagagtatcttagggtaatttggaaccaaacctttttttttcttcttttttgtattgagacttttttgagttaggggactacttaccaactaacattagcagtttttgttgaggacaagtttcattaaggggaatatataggggaaagtttgctagtacaatggaatgtacacttggctttctatctgcaggtttcacatctgcagattgaactactgtggattgaaaatattcaggcagaaaaataaataacagtacaacaataaaaagtaatacgaaatttaaaaagacggtataactgaggtaggagttgggctaatccccagttttggggctcacttgtcctgtatcctaacaactatttacatagtatttacattatattagccattgtaagtaatctagagatgatttaaagtatatggaaggatgtgtgtaaattgtatgtgaatacaaacattttatataagggacttgagtatctgtggatcttgatggggtagggggtgtcctgaaaccaatcccccttggatactgagggatgactatacacttaagccaccagacatcttgcatatcatagacaattgtttggggtccatgagctttaattacaaaatgtaatgctgggagaacatagagaagagtgattttgttttttaaatgtagacttgattctgtagaaatatactacatttgataaatatactaagtatatagattatttcatccaatatattagtaatttagatagtggatagccactttcctatctttctcttatccatatgaatgtaatggatatgttgttacaacttatgattttctaaactagctgtgatttataatgacatcctgagaaaagtcagtgaaactcatttctaacgaataccagatttcttaaaatagtcaagtatttttcttttgtgtatgatgagatattaacttggtgttatttcatttttttttttaaggagtcattctaccctgttctatctttacttatgtgaaaatgtttaaactatgagtttttttcatgtgccttcttttggagtaatgtcaacttttaaatacacatgtttaaataacttagagtgtaataaattgtgtttaatatatactgtagataatgatggttaaatgctttgttaacacatgttcttttaaatacaagatactactttgtactgatttgtgtactttttttgtgtgccgttaagacaaataattcagtactgtagaggtaaaattttttgatgaggtataattgaaatacatttatttagatgattatgttataatagatggccaatgtaccatatctaaatatcacatttcatttcttttttcaaatgttaagagccacagcttctcaaaatcaaatatttgatggtgaatttgattgtaaacacttaaaagtaattagatgaaatatggttgcatacttaaacaagagtaagttcttagaatatgcaatctaattaaacattaacagtcaagcaaaatctttgtatacgattttgagaaattgttcaatatatttttataaatcttttatattgattaaagctagtagttataatttgaacatattatttatttttagtttccaattgctttgtaatagtggaaagcaaaataaatgagtaaataaaaataaaaataaaaatatcgctcatatcagtcctgacaacttaaactaaaaggatatatcattataattccactttgctagcaggtcttttttgttttaaaatttatgtgtgaattcacctctgttacaaagttttttttcccctaacattaagaaacctttcaaacatacagaaaaagtgaaaagatagttatagtaagtatccatatatctaccacatagattctgcaattaatgttttgctatacttggcttcatcacctatttatccatcaattcttttttttaaaggaaaaatgttacttcgaaacaagttgtagagttagaataatttacccttaagtacttcagcatgagtattactagagttcactatttatttgtgcatgtgtgttttttaggtaagatttgcatacagtgaaatgcacaaatttaaaatataccatttggtgagttttgatctacaactgtgtagctcaaacctctgtcaagaattagaacaatatcacctcagaaagtcctctcttgcctgcttctaatcagtcttcttgcacgtcaggcaaccattgtcctaatttaaaaaaaattatagataagttttgcctattctagaacttcatgtaattggaatcatacaatatgcatactttgtttctgtttttttcaccttagtgtttttaatattcatccatgtttatccatcctattagtagctcattgctttctgttgctgtgcagtattccattgcataaatataccacactttttatccattatcttttgatggacttcttggcaatttccatactttggctattatgtataaagattctatgaatattcttgtgcaagtttttcatggacataatgttagttagggaaccatacagacttaacctttaagaaattgccagacattttctaaagtgattatatcattttacacttccatcaacagggtatgagttttttttttttttttaatttttgcaaaaggctgggcacagtggctcacacctgtcatcccagcactttgggaggctgaggcgggtggatcgcttgaggccaggagttcgaaaccagcctggccaccatggtgaaaccccgtctctactaaaaatacaaaaatcagctgggcgtggtggcaggcacctgtaatcccagctactcaggaggctgaggcaggaaaattgcttgaatctgggaggcagaggttgcagtgagccctgatgacgccactgtactccagcttgggcaacagagcaagaccctgtcccaaaaacgaaacaaaacgccctttgcatgttcagtgactggaatgtcagaagtgaaattgatgaataatttttgtaatatttaagtgcattcaaaatgttggacaggtaatttagatatctgggaatattgtagtttactggtttttttttttttcattttagtactagttgcatatatgctctgacatgaggtattgaagaaatatgaaatgtgtagtctctgctacgcttataaaacataattctgaaaatgatctttaatgcaaagaaatatcttctaggtttattttatacttattgatacttatatttagttcacattcaatctcttagatataagaaaactgtgagtgattatcagtttgaagggatttgtatattaatgtttgtatgctttttagtgtaataaaaactgtttcaatcttaaatttatattgcagttatatgttaatgcatattaaacattggtaggttttggtaattttaaaactcaaaacatgatctgcaagagtatttacattctttattgaatttgattatatgagacattttaaattttcatttgtgccattgaaaacaatgtgtgtatttagaattgttaaacaaaagaatattaggctgggtgcggtggctcatgcctgtaatcctagcactttgtgaggctgaggcaggaggattgcttgagtccaggagttggagaccaacctgaagacctctttaaaaaaaaaaaaaaaaaaaaaagaatattaaaggcttaggtttatgggttgtacaattaagtcattcaactccagagtggctatgcttaggaatcattcactaagacgataatgcccactattaatattaaatgacattatttccctttatcaaaacatgcccttatgaattttttttttttttttttttgagatggggtctcgctctgtcacccaggctggagtacagtggcacagtcacagctcactggagcctcaacctcctgggctcaagcaacctacctgcctcaacttcctgagtagctggaaccacaggtgtgcaccaccatgcccagctaatatttgtattttttatagagacagagttttgccgtattgtccaggctggtcttgaactcctgggcttgagtgattctctcaccttggccccgcaaagtgctgggattacaggtgtgagccactgtgccagctgccttatgagtcttgcagatagaccttcaagtctcttgtttatgccgaccactttttggtattgatttggcaagcacattacagggtcaaggggaaaatagatcagaacccagtttacagttaagaaattatagactgggattgttaggggtggttattctgggacatagcaaattagtcaatattttctgtaatacaagtagtctagatataggaggttatgttccactattccatgttcccaacgatcttgtttttaccttttggaattattcaccctctctattccatgctgtatggcctacataattttaaaaatgggagtaattgagaaagggacaagggcaaatgttgatggtgtaaacattaagggagcacttactatgtggcaaatactgttgtgttttacatatattcactaatccttgctcacagtaggtttgcgaggtaagtattagtattatattcattttatagatttataaactggcacaaaggtgttaagtaacttatatagggtcatagagctagtaagaggcagacttaagactctgacccagccagtctgtctccatagttcatgcccttctgctgttctgcaaaagaaaagtgtatatccgagaatcttatggtatttcaaagttacttataagtaatttctgaattatcagaatttagttatcttgttcattgttttttctgggagctggtgggatggtggcagggagggtcttggacataacatccattctcttagaccctggtaatacaatacggtattttactccaggatgtttttcccagtcttttgatgaagacattctttttacccgctctttagggtaaaaggggaagtatgtttttctcttggataacctaataaaaacagagaaacacattttaactatgcagaaagattttgtcagtttttaattcaatgcacagtgactgctactggtagaaataatacaaaaagaaaactaattaaaattgactaaaattgcacacagcaaaatttgtgtgaaaagagttcaaaagctaattgaagtattctgtcttttgttaatgctaaaaacctcaaaactttatctgggaagatcgggcttggtaaaacaacgaaaataacccatgacagctacaaatttatctaaaaactggttaagttttcttgactaaaatttgttggattaatacgatcctgataatatttagctgtgcaaaatttgactcagtaaaacttcatttggtagaaattatggttatgaaagaacatgttcataaaagctttcaccgatcaatgaaataatatggtacataaagaagtgactgaatctttgctacaaaatttacttggaaaatgatcctgatgataacaagttttttttgtttgtttgtttttgagatggagtctggctctgttgcctggtctggagtgcagtggcgcgatcttggctcactgcaactccgccttctgggttcaagcaattctcctgcctcagcttcctgagtagctgggactacaggcgcctgtcaccatgcccagctaattttttgtatttttagtagagatggggtttcaccatgttagccaggatggtcttgatctcctgaccttgtgattagcctgcctcggcctcccaaagtgttgggattacaggcgtgagccaccgtgcccggccggtaacaagtctttgtcaatgaaaataaaaattgggtaataatggaaatgaggacagagttatattctaaagcaactcttaatgaaaatgaattttaagataaatatatatgtatatttatacatattctctttcccaattagtcccatttttaaaattatgtaggccatacagcagggaatgaagagggtgaataactccaaaaggtaaaaacaagatcattggcaacataggatagtggaacatagcctcctatatctagactacttgtattatgaaaatattgactaatttgctatgttccagaataaccacccctaacaattatatatatatatatatatatataattttttgtggtgagggaggctttctagaaaattctgaaactggatttagaattggcaaaaactggaaaattctgaaagagctgtaacactgataattttatatatatatatatatatatatatatatatatatatatatatattttttttttttttttttttttttttttttttgagacgaagtctcgctctatcgtccaggctggagtgccagtggaatgttctcggctcactgcaacctccgcctcccggattcaagcgattctcctgtctcagctacccaagtagccggcactacaggcgtgtactaccatgcctggctaatttttgtatttttagtagagatggagtttcgccacgttggccaggctggtctcaaactcctgacctcaggtaatccgcctgcctcagcctcccaaagtgctgggattacaggtgtgaaccactgcacccggctgataattgtattttaattaaatgtttttataaacatttagtcaaaatgtacctagagtcaaaatagcagtttttgaaaagtatcttgttctgtgagtatggtgatgaacaaatcaaaacatactctcaggactttataagttactggggaaggctgacattaaataatttgttacataactaattattgagataatgttgaggtaatagggtaactagatctaatttggcaatcggaaatttaagttgtacagagagtagaagttaatttagataagggcattagaagaagacaggtaaaagtctatagctggaaatagcatacttccttcaagattactaggactcatggattttaagcaagagggatactttatcagattcacatttaaaaatagataactataataaatgtggaaaacggttttagagaatagaggtggcaaaagacgctgtcagtagacttgttgggaagcccctgcagtaataccaaaattcagatcagagatgagttgaaaaaagtggaggcaatggagaaggatacaatacatagctttgaaaacctggtagggggcagaattgtctggattttgtggttgattgtctgtgggactgaaaaagtagagtgtcaaggatgatttccagttttctggcttgtataaggacgagacatggggaaaccaaaggaggaacaatttttggagaaaagatacatggacatgatgagtttgagatgtttatgagatatgtggacatgtctgggaggcaattggatatgcagatcaagagttgtaatctgggctagagaaaaaaaggtttttagtacctgggcagcactgaatccgctcaagtggacaggctacttaaagagaagtggtgcacagtgagagaacagggcctagaagtcagttctgaagaactccaatagataaaaggtagatgaagtatgaactggcaaagatgtctaagaagaagcaagcaaagaggtaagaggaaaatttgaaggatgttagagaatctacaaaagtatagttcagtatttctaggaggaagtagtcaacattgtctaatgcttttgagaactttgattaggactaaaaacacaacctgtgggtttatagacaaagagttcctggtaacctttaacagggcagtttagggggaatgactactggaagccatattggagcagttaaggagtgattgggaatttgaagaagcagaggcagtgtgggggtgggagtgtttggatacttgaagtggaaacaatggggtagacagcttcttatggtaggaaaacatctcttttttttttttttttgagactgagtctcgcttgattgcccaggctggagtgcagcggtgtgatctcggctcactgcaacctccacctccagggttcaggtgattcttctgcctcagcctcctgagtagctgggattacagacgcccaccaccacgtctggctaatttctgtatttttagtagagacggggtttcaccatgttggccaagcttgtctcgaactcctgacctcaggtgatccgcccaccttagcctcccaaagtgctgggattacaggcctgagccaccgcgcacggccaaaaacttctttttttttatgtatgtgtttcttcctgcaatacatgtttctccctgaaatataacatattacataataatcttgactttatttttccatgctatgttttttccccatgatttactgtggagaaaggagtttattaagtaggaagtcaaagagtgaccttgttaagagctctttgggaggctgacgtagaccagacgcttaagctcatgagttcgacaccagcctgggcaaaatggtgaaaccctgtctattgaaaatacgaaaaaaaaaattagccgggcttggtggtgcatgcctgtagtcccagctactcaggatgctgaggtgggaggatcgcttgagcccaggaagtggaggtttctgtgaaccaagatcacaccactgcactccagcctgggtgacagtgagactctgtcttaaaaaaaaaaaaaaaaaaaaaaaatcaagttttctttggcgcttttactacagcatgtcgatatattgatttagagtacaatcatgttgcttaatgacaggaatatgttctgagaaatgcattgctaggtgatttcgttgatgtgtgaacattgtggaatgtacttcctcaaacctaggatggtatagcctgctacacacctaggctgtgtggtatagcctatggttcctagactgtaaacctgtactgcatgtgctgtgctgaatactgtagacagttgtaacacagtggtatttgtgtatctaaacatatctaaaaatagaaaatatacagtaaaaatatggtattaagatgttacgggaccaccatcatatatgtggtctgtggttgatcaaaaccttgttgtgtggtacatgactgtatactaaagtgtttaataatttctagtaagtgtgagtgggcttatttcaacctcttttattttactctgttaaattgttcatgttgctttttttttttttttttttttggtgggggccaggctgtgagagaagagggaggagtttttaaatgacctgggtttatttaaaatattgtaacagccccgtaacttagtacctcctattaaagaaaatattaaatggattcttaattcttccagcacagtcaacacttgtgttccatgtattttgtagcattttacatattaaaattcagtagatttattttttgctttaattttattttcatttatttatttatttttttgagacggagtttcgctcttgttgcccaggctagagtgcagtggcatgatctcggctcactgcaacctccgccttctggtttcaagcaattctcctgcctcaacctcccgagtagctgggattgcaggtgcctgccaccacgcctggctaatgtttgcatttttagtagagacagggtttcaccatgttggtcaggctggtctcgaactgctgaccttgtgatccacccgccttggcctccgaaagtggtgggattacaggcgtgagccaccactcccaacctttttgctttaattttaacagttcttactaattgaaattcttttatgcctattttttacttaaatattttaagtaaaattcagggattagattctacatattggcaatatgtcggctgaatgttgagggttttctggtcagattaaaactttaaagatatgagaatcttttctttttttctcaggtaccttctttaagtgtagtgtgaaattaggagagtctagcaaagaggaaatgaagatacatttaaaaatatcctatcactaatcaaattcaaattgcagcattaaggagatatcatttctgccaattaaattgataaagatgaattcacagaaaaagttcatagaagctttatgatagtcaaagctatcaaaattaagctgaaaactcaactgtctgtcactatcctatataataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacaggtcagtaactgcaggggttttgggtaaggggagggtgtgagtataaagcaatagcatgagggagtctttcgggatgatggaacgattctatatcctgattgtggtcatggtggttctgtgaatctatatatgtgttcaaatttgtagagctgtacatcaaaagaaaaagtctattttactgtatgaaaatttaaaaacaatagttaaaaatggataaaggtgatgttttgtgctaatgtaggtgtaatgggtgtaatgaagtggacacccttgcttggtgggaatatcattgatacaacctttcgtggagaaaaatttgtcagtctaaatcaagaatctgaaaatctttaaattcattggactggtaatttcatttcttggactttatcttccacaaataaccagagatgcacagattgaatatgatagagcttaaaaaaaaagtccagtaataagggactaataatatgtagaaatatatccacaataacatatgaaaagagaagggtaaaaaactatccactacatctactgggacatttagaagcacatttcccccaaaaaagtatctgaaaaatgacgtgttatccatacactctcattagggaaggaaggtcagaaaactggaggagctgcacttaagtcctttgtcttcttggttcctgctgagggctctagcagactgaatcctttcaggaactgatcagagttcattgggtcatgccagacagagctgactcaagctgggtatgaatcatttgttttctcagaaaacaactttggtggttctgagtataatttactggttgaagatagccaagactcactttctaaatccatgaatgccagtaatgaagatacaatttatctgaattctagtagtgataaattttcaggcatttggcaggttgatttacctggcttggagatgtacaagtttttttttttccagacatatgtcttctttttctttcttcttcttcttcttttattttggtgaatacctagcagtgtaatggctggttatggtaggtgtatgtttaacttttaaagagtctgcgaaaccattttccaaactagttgtactgtttgacattccttccagcaggatatgatattttcagttgctctatatctttattagcacttactgtggtcagtttttttttttttttaattttagtcagtataatcaagatgtggtgttatttcattgtgtgtgtgtgttttaaacagctttattgagatacaattaacataccctatgattcagtcatgtaaagtgtacaattcattgttttttaatatagtcacagttaatgtgcaaccatcagaacagccagttgcagaatattttcaatacctcagaaagaaactttttacctttagctaccaccaccctgcttcctaaccccatccttaccctccagcctaagcaaccattaatctattttctgtctctgtaagattttgctgttctagacattttatatgaatggaatcctaaaatatatggcctttgtgactggcttctttcacttagcataaatgttttcagggttcatccgtgttttagcatgtattagtactttgttctttttctatgatggaattatattccattgtatgcatatgccacattttgtttatcctttgtcagttgaatgcacatttgggttgtttctacctgtcggctattattaataatcctagctataaacattcatatgcaagtttttttgtggacatatgttattattcttttgggcatatacttaggagtgtaattgctgtgtcatttggtaactcttgtttaattgtttgagcaactgtcatgctggtttttccaaagtgctgcaccattttatactcctaccagcagggtatgagggttttgatttctccacatacgcatcacacttgtttattatctgactttgcgattccagccatcctaatggttgtgaagtggtatttcaggtttttaatatgtattttctggatgactaatgatgttaaatatctttttatgtgcttattggttgtttgtatatatcattttctgaattgtctaagatttttgcctgttttctattgatttgtttgttgtcttatttttttttctttttttttattattattatactttaagttttagggtacatgtgcacaatgtgcaggttagttacatatgtatacatgtgccatgctggtgtgctgcacccattaactcatcatttagcattaggtatatctcctaatgctatccctcccccctcgccccaccacacaacattccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctacaaaggacatgaactcatcattttttatggctgcatagtattccatggtatatatgtgccacattttcttaatccagtctatcattgttggacattttgggtggttccagtctttgctattgtgatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaagtgttcctatttctccacatcctctccagcacctgttgtttcctgactttttaatgattgccattctaactggtgtgagatggtatctccttgtggttttgatttgcatttctctgatggctagtgatggtgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatgcctaggttttcttctagggtttttatggttttagatctaacgtttaagtctttaatccatcttgaattgatttttgtataaggtgtaaggaagggatccagtttcagctttctacatatggctagccagttttcccagcagcatttattaaatagggaatcctttccccattgcttgtttttctcaggtttgtcaaagatcagatagttgtagatatgcggtgttatttctgagggctctgttctattccattgatctatatctctgttttggtaccagtaccatgctgtttcggttactgtagccttgtagtatagtttgaagtcaggtagtgtgatgcctccagctttgttcttttggctcaggattgacttggcaatgcgggctcttttttggttccatatgaactttaaagtagttttttccaattctgtgaagaaagacattggtagcttgatggggatggcattgaatctatgaattactttgggcagtatggccgttttcacaatattgattcttcctacccatgagcatggaatgttcttccatttgtttgtatcctcttttatttcattgagcagtggtttgtagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttatacattgattttgtatcctgagactttgctgcaaggctggttcaatatacgcaaatcaataaatataatccagcatataaacagaaccaaagacaaaacccacatgattatctcaatagatgcagaaaaggcctttgacaaaattcaacaacgcttcatgctaaaaactctcaataaattaggtattgataggacatatctcaaaataataagagctatctatgacaaacccacagccaatatcacactgaatgggcaaaaactggaagcattccctttgaaaaccagcacaagacagggatgccctctctcaccactcctattcaacatagtgttggaagttctggccagggcaattaggcaggagaaggaaataaagggtattcaattaggaaaagagtaagtcaaattttccctgtttgcagacggcatgattgtatatctagaaaacctcactgtctcagcccaaaatctccttaagctgataagcaacttcaggaaagtctcaggatataaaatcaatgttgtcttatttttaaactataagaattcttaggctgggtgcagtggctcacgcctgtaatcctagcactttgggaggcctaggtgggtggatcacttgaggtcacaaattcaagaccagcctggccaacctggtgaaaccccgtctctactaaaagtacaaaaatcagctgagcatggtggtgggcgcctgtaatctcagctacgtgggaggctgaggcaggagaatcgcttgaacccaggaggcagaggttgcagtcagccgagatcacaccactgcattccagcctgggctacagagcaaaactctgtctcaaaaaaaaaaaagaaaaaaaaaaaagaataattattctggatacaagacctttgtcttattcatatgctgtgaatattttaccccagccagtggcttcccttttgtttttttaatggcatctttcaaaaagcaaaagttttaaattctgataaaagttgattaataatttttgatttttatgtttcgtgcttttgtattctaagaaagctttgtatatcctgaggttacaaatattttatcctgtgttttctattagagattttttgttttaggttttacatttaggtctatcattcattttgagttgaattttgtatatggggtgacttaatggttgatgtttatcttttccaaatgtgtatccagttggtttagcaatgtttgttgaaaagactttcctttcctcattgaatttgcttccctacctttgttgaaaataatttcgccgtatatgtgtgaatagttctatttcttgcttctcttccaatgcattggaatgtctatatgtcttttttggagaggaagcgcagtaccaaactatcttgattatcgcagcattattgtaaacatccaactttgttcttttcaaaaattgctttggttagtctacgttacttttatttccatatgaatttttaaatcaacttgccaattttactaaaaatgtcctgggattttgattggtattgtgttaaatatattgatcgttttggggaaaattactatcttaacaaaattgaatgttccaattcatgaaataggagctgtgcttatttataagagctttgttaattttttttcaacaaagctttttaattttagtgtagagatctgggttatcttttgttagatattttcccaagtatttcacatgtctgttttttggagctactgtgaatggaatttaaaaaattttatttttgattattccttgctagtctataagaatacagttgatttttgcatatgaaccttgcatcttgtgactctgctaaatttattcttctttatttttagattctctggggatttctatgtaaatagttacattatctgtaaatgctccggttttatttcttcctttctgatctttatactttatatgcttttgttgccttattcctatttaagtaagtaggaaaatagtaaaaaggaaaaaaaattacttcattttgtttttaaaattttattgttttgatagtttccatggttcaagtgtgtatgacgtaaaagacatagtgaagagctcttcagtaatggcgggaatgagattttgctgtcttcagctaaaccaccttttatccagccactgaaaatctagtgtgtgcaagttaggtgtaagaagcaggagacaacgtaattttaataatatttattctcatttctactttgctgttttatacttgttcttatttgaaaaagtaacatatcatatgatccaacactttcacttctgggtatatagccaaaaaaaaaaaatgaaattggcatgttgaagagatatctgcattcccatgttccttggagtatttttcacagtagccaagatgtgaagtcaacttaagtgtccatcaatggatgaatggattaaaaacttcttggtataggtacacagtagaacactactcagcctttaaaaagaaggcaatcctgtcacttgtgacaacatgggtaaacccggaggacattatgctcagtgaaataagctggacacagaaagacaattattgtgtgatctcactcatgtgtggaattcaaaaaagtcaaactcttagaaacagaaagtagaatgatggttacctagagttggatagaggtggggcattggggagatgttggtcaaaggatccgaaatttcagttaaggaggaataagttcaagaaatctattgtataacatggtgactatagttaataacaatgtatacttgaaaaatgctaagaaagtagcattttaaaaaatgttttcaccacaaaaagtatgtgaggtaatggataatattaattagtttgatttagccatcccacagtgtatacatatatcaaaacagaatgttgtgcacctacatatatataatttttgtttattaaataaacaaaaatttcaggttttactttcagagaactctgtaatctttgcctttcctcagtttgtcatgttacttaattaaatcagttttgtcaaaatgtgattttagatatttttccatgctatagacattgaaataatttcttaatttttagagttttaaaatgtttacagtgattattatgttattctacttcatttgagtttatttgacttcggaacagtaagacatttgtagtaattatactcatctggtaatattaacacctgatatttggatttcttagtttataaaatgctaacatgagtatgatcaaatattctttcatactatttcttaatataatctaattttcttgtgccttttggttttgtttgaatgaccttactacttagacattaaagtcatttttaataatgtgtgttttttttttaattgtagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggtattatgatactacctaatgtttacagtttggcctgaaattagtatgtatctccggttacataattgaaatgtaattgggttttataaagagatgataaggtattctttaatggatgttcatgcctcaactgtgtataatacataaaataatctcataatggttagtgagcctgacaatcttatggtttatgctagctcagtgaagcaaatcctatcctatggtttcattttctccaaaaatggccagccagctatatatagttattttggtacttttctgagcttaaacactaaatttgacttggtatactttctctctctctctttttaagaatgctaagtggttaaaattgaaaaatatgttgatatcaagttgaatgatatgtaatttcagcactactcaataatgttttgaaaaacagagcaaggagataatggttaggcctgacctagattaacatatggaaattggaggttgccattgtttctgttacaaaatgttgccagcataatttgtagtaatacaagttaggctacaaattaagaatggctaacaccaactacagtgtctttgcattgtctcagttcaattttgagtgtgacctataactataaaatctgttctacatgtttatttacttaaaaatatagtttatagtttttaataactattatgtgccaggcagtatgctaggaataccaaagatgattataatttataatttagtgggaacaaagcaaagtaattgatgattaggaagcaataatacagttgtttcaatgagaagttttactaaatgcagttggagcataaaagaaccatttaatctgcccaggaagcagtgggagcataaaagaaccatttaatctgcacaggaggctaggggtaagcttgataggagttaccgtttaagatactatttgaaggatgaatagttttggaggttataggtaagggccatgtgcaagagagaatagcacatgtaaaggcacaaaagcaggaaggaattcaaactagttcagtgtttcaggaatgtagtgtatgaaaggccgtgacagtgttaagagttgaagcaaactaaattatctacaatagaatgttttatttattataaaaatatggaacaactgtgtatagtgattggggaagtaaaaagaaaaatatatagtacacattctatgttggttaaggtcgattggggctagatttttggagaatttgttcatgcattggtattgcctctttagtgaaattctaaagtcagtgagagaggaaaaattatcacaattactttggaatatcttttacccctaaggtatagtgtgcatggttttgcatatgtgtagtttataataaaatgatctttcagttgcaagtaacaaaaaatgaaaattaggcttaaaacagtgggtttttaccctgaccatgccagtagaatcacctgaggtgcttttaagggtgtagtggctcacgcctgtaatctcagcactttgggaggctgatggggaaggattgcttgaggctaagttcgagaccagcctgggcaacttagcaagaccttgtctatacaaaaaaataaattaaccaggtgtagtggcatgcatctgtaactctaactacttgggagactgaggcaggaagattgcttgaacccaggagatcgaggctgcagtgagccttgatcctgccactgcactccagcctgggctggagagaccctgtctcttaaaaaaaaaaaagaaagaaaaagaaaagaaatgccgatgcccagactctgacctttctttgaggctctgatttatttggcctgtatggtagggagagggactgaacataggtatattttagggttttcaaaatgaaaatatccaaacataggacttggttgcttaattataacattaataaatgtattaacctgaagttaattttgcaagttactgtctataagcagtttttcttttaaataactgggatatacaatatgtaaatttgttaatgtaaagatagaggtgctaagaaaactgaaagctggaatgctaaaattgctaatagcttgtgataatgcatcaggctcagttggccatcattgcataatacctaggaaaaaaaaaaaaccagtatgtgaaacaaagtttaagagtaaaagaaaagcttctagcgactgagatgtttgaaagagtcacctttggatcaagatcatctatggatctaaatgaaatgagagatcttggaattagagctactttaaaggtacctcaaagttaaaaggttattcttgtcttccatttccatgtaaaactgagattaacagtaattggattttatgtgaagataaaactataatcttcattaatttggataagtgaagaccaatactgatttgggatggagtgatgggtctttgacattgagctaagtaatttcttcctatatcagagcattacaattaaaaagtattccaccataaataatttaagactatatattaaatacagattggcacagattataaattttaggccagtttcagtagagaaaattttagtaattttcaactacttgaaaagggtcatcatattttctaaaatgtggcagtcttttattattatttttagagacttaaaagtttctggtatacacagctcctttgcttggtaatggcacaataactacacatttaatagtttaatgcatttaatagacaagcatggaagtctaaaatgccatctatgtggttagtgaactcattttaagcagcccatgactgacttatccatacttatatttcatcagcacctttacacagcaacacttaataaatgttcatcaaattaataataattcaaacaagcttaatattacaaaatattccatgttttattaaagagttagaacatggaatatctgtgacctcttgccacaactgtattttaactttgctatctcatgtggaacagtcagtactagttgtggtagcagttgcttttattgctagttctccttcacatttctagctgtttctaagtgaaaatagaggtaccatgatgtttctgtagtttatttacaagaaaggaggatacatatagcctatcaaactattttcttggcttaatttttccggacaagagatggcaaaactatagagtacaataatctatattttcaatagtaaaaaaattcttgctttctctaaagcatggctaatttgatagctgtattatttcttttgattttcaatgttttttttaaccaaaatgttaaattatgcttccattttggctaatgcattatataagactatttacattcaaagtgcagtttttttgtacagttacgggaaggtgaccgtggtatcatagagtgtcaattaatttttttctttcttaacttaaaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaagtaagattttaaaaataatttgaattttctgtttttactgtcaaaatgttttttgtgtgtgaatttgaagtttaaattttgttttaaaagttttaggtgaaagtatacattattcttgagatatataatctgacataagagataatgttgaagtcaaataacaatatagtttgggaattatttcatatgtaaatgaataattctaagaatacagtaataaaaatactgtacatgtgttgaaggaaacatatctaaattgtatgtgtatacattacacatacatgtgtataattttgaataaaatctgactttttagtaaggagagaaattagtaaatgtattaatctggactatgattatacttctaatttgaggactgtatgccttgatcacaagcattagtgtgtaaaaatattgaatggtaagatttcatgcaaagtccaaattttactagtgaaagttccattcaatcagttaattttcacactgatgaatgcaattttaaaaatcatgttaaaaaaaaagaaacctagattgtatctgattgttcttttgactgttcactcagcaggtatttcttgattgccttttatgggttgggcctaaagataaaactgtcatcacagagcttctcatttggtgaggggaaggacaagtaatccgaatcaaagtatagtgtagtagatgtgaaagttgagacatagaggtgacttctttcctcacaacagcaagtatataaagtaatgattatttttccccattgcaagtattatggaaacataagttttgaagtaaagaggcctttgagatcatttagattcgtctcttcactttgcattggagaaaactgaggcccaggaagatgaaccgacttacctaaatacaaataatcaacggcattattgggacaaaaccccacaattaaaaattcttagttctatattagcttatcccaaagacttagttgaaatacaggcagtggaagctgatgcagctgaattttctctttttgtccaaatattttgtctgtcccaccagctcttttaacaatccccctcctctttattctcctttctctttgtacttttactattacacaatacagggctgtggggaactgaaaagaatactgtgcttattcagagatctgagtaagaatcatggttttgccactgaactaactggttctttgacctcttgggggtagtcactaaccttcctaatgttttgcctactcatgtgtaaaacgtgggtcctaataaccaccgtagagatttagagtgtctagtatatactctttccaggaaatacttgttgagtgagtgaatgaaacattttattgtggcatttatgtgttgtgtgtatgtgatgtaaatgtatatatatgtgtacatgtgaattttatatatatgtgtgtgtgtgtgtgtgtgtgtgtgtgtgtgtaaaagcacttcaggtaaatagtaaatggttaattattcttatgtatttatcttagccaaggatagaattaggttgtagactttaatgcctcagacatgttgttaatattaaatgatcgtcttcatcattgtgaagataaagaaacatcttaaaatttgaactagtgttctatgattttgactgtttaggtttctctttcttgaagatgggccttttattaggtgatttataatcctatagtcctttttgcttgggcagtatgtgatttttcacctctatcttctctttttccttgttgtcctttttaaaagatagaaaaataacggggccatttcttgactggaaatccacaaggagcacactcttactttgctacagtgatatagaggaaagccaaggactacatttcccatttttacttcctagtctcctacctaacaggaattgacctcaaagatgaaagttcatttcagttactcagaaacctaggaagatccacagaaaacttaccctctgggtatttgttaatggtaaacatgactaaactcttattcctgtgacagtatagttccacactgatgaatatttacatagtctactggagtctatttctttttatctcctcttctcatctcctcattcttttttctttttttatctaattcaatttttataaacatgatgtaggcatgcaaatatatccccaaaataattttggtgggtttattatctaatttcagatttatcaattgagacctgccttctagttatatttgattttgcctttttgggtgatattttagtaaatcttttaaattgtgttagcatagttttgaagaattacattgttattctatgatgacttcatgctgctttaaagaggttcatgaggctgggtgcagtggctcatgcctttaatcccagcactttgggaggctgaggtgggcagatcacttgaggtcaggagttcgtgaccagcctggctaacatggtgaaaccttgcctctgttaaaaatacaaaaattagccgggtgtggtggcgcgaacctgtaatcccaggtacttgggaggctgaggcacgagaattgcttgaacctgggaggcggaggttgcagtgagctgagatcacaccactgcactccaccctgggcaacagagtgatactctgtccccagaaaaaaaagctttatgaacttgacattcatgaatgtagtaattaacttcaagcaaataatggtggctaagtcaatggagaatttatcattttttctcagttctaattaataggagtaatgatcattgttagtgtgtttaggactgaaaagatagaaagcctgtatgttaaatttggggagacttttcagaatgagaagctgtgaacattggcaaatgcatcttggcaaaattccaacctgtactttcagttggaaatagttctctttgctctgaatactgaactattcaatgttgtggcttattgaattccttactagacaatagtgaatttcattgctttcgaagcacttttgggtatatgaagtttggaaggctcttcgtaattctttgcatgaaatcgttcatcagtaaggcatgagattttctttttaaattttgtgcccttgggtaacattactgtgactaaattttggacttttttggccacaaatgatggcaaacatttctatcttagggtaatgaaaacaagataatgttggttgctgaaaaagtgaaattacaatacttgtacttttatcattttttaagattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgaggtaggaaaataaatcatttgtttaatctaatctgaattttgatttaacctgtaacacaataatggttttctaagaagatcctaatataatgagtcctgagggtacactatgaatttcaattggtaggaaaggtgaatagtgcttactgtgtgcatttattccaaaagtggttcttgatagatgccacgtgccaaacactgctaggaggtgggcatatgggaatcaggaccacggtccttacttttaagtggcttttaaagtatttgagtaaacagataaatgcaattgaccttaatgtggtataataaaagcttaccgactgctagtgtggtaaagggtcataagagcaagtgaaagaggcttttaattctggttataagaatttttttttttttttggagacgaagtcttactatgttgcccagactggagtgcaatggcgttatcttggctcactgcaatctccatctcccaagttcaagtgattcttgcatctcagcctcctgagtagctaggattacaggcgtgctccaccatgcctggctaatttttgtatttttagtagagacggggtttcaccatgttggccaggctggtcttgaactcttgacctcaagagatccacccacctcagcctcccaaagtgctaggattacaggcatgagccactgcacctggttatgagaattttggaaaaagattttcttctgtctctacatctgaaaatagaaaaaagtttcttcttcccttttgcattttctgattaaagaatagtagtatcttaaagatattttagaggacacaaaaaaacaggagaaaaaaagaatcaaaggcccctgctaacatttcttccagtcttttttgtttatttgttttggttttgttttgccttgtttttaaatgccaagacccttgattttaaaatttgtcctttaaaggtagttggaaatgaaattctccccaactctaagaactccttgaatgatgacaagttaagggaatactgtcttccagaaactgttaactagactcatatttcctcccaaatctgctttttctttcgaaggtcttatctcagttggtctgtgaatcatctttgatttcttctctctcacattctgaatctagtcaaacctgaacttttaattattttaacctcctaaatattgtttcctaatcttttctgtcattccactgcagcatctctagtaaccgatgtcataaaaatatcatattttatctagactattgcaatggcttctaacctgtatatttgcttctgatgcttctcaaataatgtattctacttaaagccaccatcttgagttttctgaaaaacagttctgaacatggcattcccttatttaaaatcattcagagactctcagaacttagaacagtgtttcccaaactgtgatccctactccactggcagtatatgggaccattttgaggtggcaagtggacaagcctttaaaaaaatttgaatagtagcatatttagttaattattggaaaaataggctgggcatggtggcttacacctgtaatcccagcattttcggaggccaaggcaggcggatcacttgaggtcaggagttcaagactagcctggctaacatggtgaaatcccgtctctactaaaaatacaaaaattagctgggtgtggtggcaggcacctataatcctagctactcaggaggctgaggcaggagaatcacttgaatccaggaggcggaggttgcagtgagccaagatagcgccactgcactccagcctggatgacagagcaagactccgtctggagaggaaaaaaaaaaaaaagaaaaatagcacattaaacttttggtttcacagataaattatgcttagaaagagttttcttttcaaatttaagttaaaatgatttgaagaaaaatcataaataacatatagtatcacagatatgacaacaaatcgtgatggtagtcatgaaatactggtgtttgggagatgctgatatataagatacagtctaaactctcaaggttaagtatcctcatcttttgtcttctacctgccgtgctagcttcatatttttcagttcaagctccaactatattcagctgcctaattagtgtagtaattatttaccctttacaattttgctcaaggtacatctccataaaggcttcctgtttgctcccttctctttatcgtgaaaggatgaatctggattttctctttgctattcactgtatctcattgggctgacatttggtcctttgttgccaaagtattgatctaaaacagccacctaaatagtagccgtaatttatgttggtaatttttttctctataccttgaaatggaacacatatataaaattgcatattggttcttaatttctactaagaagaaatacaattaactgacaaactacagttgactcttgaacaactcaggagttaggggtgctgacccactgtgtagtcaaaaatctgcatataacttttgcagaaacttaactaataaactaccgttgactggaagccttactgataacataaacactcaatttacacataatttcatatatgtattatatactgtatttttacaagaaagccagaaaaaagaaagcatgaagaaaaccataaggaagagaaaatgtatttactattcattaagaggaaatggatcatcataaagctcttcatccttatcatgttgagtaggctgaggaagaggaggaagaggaagggttggtttggttgtctcaggagtggcagaggtggcggaagaggtggaggagatagaagggaggcaagagaggtaggcacactcatttataacatttattgaaaaaaacccatatataagtggactttcacagttcaaacccttcttgttcagtggtcaactgtatacttatgtatttttgtaatatccttaattcccttggactttcttaactttaaaaatataaaacatacacttctaaggtctttaaaaatataaagtggcataaaaatacatggtcttactaataatatctctaataacatttaattttaaattatataacagtaggtctgtaggataacaacttttactaaattatgtgtattatatcaagtgtttagtgtttaatttttttatgatgcagggagctatttttgttgaggacttcatttactgacagaatcataaaatacagctcagtagatcttgctgattaaatataatacaacaatatattttaaactgttttgatatctgaaaccaataaaaatcactcaactcttagtgatgagaaacacagttatagttaaattatccatatgcagatataaaattggaattcatttctagcctctaaatatgtacatgtaatagtagcagatgatttagattcaactctctaatttcagatttatgttttggtaatttagttgacaatatgtaatggatataattatcaaagatgcaaaagatgtgttgtaaatcagctaatgaagtactaaaagtcttcagtgtcattacaaaatatcagtttctggttcttgatgattttaagagcataaaatatttttctattgtgattaaaggaagtaaaattatttctaacagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggtaagaaacttaaaagtttagccttagtcatttaaaaaaaatctagtttttcaaatcagtaattcagtttttacttgttaactccctaacccttttgcacaaaaatggagttttagcttacattttggttttgagttgttatggactgaatgtttgtgtcccccagattcatatgttgaaaccctaactttcaatatagcagtattaggaggtgggcttgggaggtaattaggtttaaatgaggtcgtgagggtagagccacgtgatgagattagtgcctccgtaaccagagcaagagacaccagaacttcctttctttaccatgtgaggatacagtaaaaagcattcttctgcaagccaggaagagggctctcaccagaacccaaccatgctagcaccctgatcttagaccttccaccagaactgtgagaaataaatgtctgttgtttaagccacccaatctatggtattttgtttatagcagcctcagttgactaagacagaaagagttaacacattccagttcttagtaagtgactgtcaggaataggctgcttaaatttgatttcatatagtttctgttcctgatttttaaaatactatcttttttcctcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtcagtattcagtttggggaagatattttggaatttttgcctagtgaacatacagacttgtactatgatgcttaacattcaaataactggtggtgttggatggaatttatactaataaacctgtgttaattaactcttggtaggattctgaatcttcaaatccatgtgtaattttctgtagcccagactttggagttttttaggaataaacacaatgatatcatgataaggaatttaggagatcagactggattgcttgtgcttggttcccgagtctgacatagctgtacaacttggagcaaattatttagtgtctctgtgcctcagtttttttaaatctctaaaataggaatgataataccatctaactttgtagagttctcatgagggtcagaggagttaatcaatgtaaagttcttgggaaactacctgacacgtggtaagtgtttaatatcagttatttataactacctgacatgtggtaagtgtttaatataaatatcagttatttttatatgtatatgctacatatgcatggtttattgttggacagagcttctggacccaactgtctggaaaggtggaatggatggtaaatacgagaatcctcttctacctttttatttaaggcctagactggagtatgatctaagtagctcaatgtagcttttctcccatatctcatcttggtcttgtatggcccttccactttgccgttgtgtcagcagaataaagaagagaattgtattcattactaatatttacaattcccctattttctacttggggcttcattttccctaccatcttcagcccttttggaaggaatggtcaggatatgattattcttactgtgtcatcgtcattttttccttcatgtgtcgtttatgcatgtcacagctctctgaagttaaatgaagagagagaaggagtatgaccaaaaacttgtacctccttcctatactgatagggtggaaatatgccccagaacaacagagaggagaaaactcctcctcttctgttcttactgtgttggggtggggaagactatccacctttaagaaattcctcatgatttgacttccaatttgtataggaggattgtattaaccattatcaaaagcgatttttaaagtgatctgtgctttaaaaaaatgattttgggaaatgctaaatgacctttttattttttgaatttaatcacgatgataaagacaaaaggactagggtcaaatttcatagttatacccccaagattttctggatgcccaatgaatgtttgtcaataatagtgaagtggaaaccaaagaataggaaaactagtgttgaatatttataaaatgccatttttaaaggaaaaaatgagtcagggaaataggaaccatactctgaatgattttcatatctttggctgtttgagaagctgagtggattcgttatacttgatttccagtgctgcagttcagatttctttactggcctttgatcttgagatcactggagccagaaaagtaatgaaaaaaaaaatgagttagctgaatttagtaacactgagttagaagagaaaaagactgtttcttcttactgcttaaggatgggggtcagtattgcttatttaaagaatagttgcagatataaagtaaaaatgtttagcactagaagggagaagaaaaataaataaaaaagaagagtgagaaataaaatatactgaaaagtactgaagataagaaataaaagtagttcccttcctcacttgaaaatcataattttctgtagcaaaaatatataattttattgatatactcaatgataagcaaatactaatttaacattccaaattaaatttaatctgcagtagaaaattgatctaggatttcattcaacaagaatgtcttgatagcaaccagtgagattgtttcatttgaggcattagtattgtcctctgtatcctttgtcaatcttagcttgtttctgttttgctgtccttatcactcttatcccctgagctatgaatttaggtaaaaactagccctaactaacctttttaatttagaaatactcatagttggtttctgtattcttagaattgcctgaatgaagtctttgcttttatgggcaggacgttttaccccaagatgatttgttccttattatgaaagtacatgtttgtataggagtatgtacagtgatatatacatgataggtgctcaataactaagaatcaaatgaaaataattttgattttgtttcctcatattatctagcccagtgctgtggagttaatatttactggaaaatggttaggattcagtttgattgatagaggggtattagtcttgtagcactgccatagcaaaagaccacagactaaacaacagacatttattttctcacagttctcgagactggaagtccaagatcaagatgtcagcaggtttggtttctattgaggtctccctgcttggcttgcagagagctgccttctccctatgtcctcatgtactctatcctctctgcaaatgtattcgtggagtatctctctctcttcttagaaggacaccagtcatattggattagggccccatccttaggacctcatttaaccttaactgccttcttaaaggtcctatctccaaaaacagtcacattgggggttagagcttcaacataggaattttagggagatacagttcagcccacaattaagagctgaatgattattataagatcttcaatgccctttcattatatcatagaaaagataaatctgagattaattctttactgttataaataatgtggtgatgaatatctacaagcatatactctttgtgtatagattcctagaagtgggcttataggattaaaaggaaaaatataaatgtgtataaaaagctctcagagctttctgtggaggttacaggaggatataggtgtaggttattgacagtgttgggttgggtggtagatttatttcttttttaaaaaaacaaaccaaaaaacaaagaaaaagcttttttttttttgtagggatagggtggaggtagggaaaagaaagagtcctttcattttctcagaagtttctttcccatactcttgaaaatagtcttagtaagtacaccaacttgacttgaaaatctttagttttttttttttcttctacaggttttacctagtctagaattagagcactgaaatagcaaatggggatctaaattaccactagaaagcaatgtgacaaactcttacaatgatgctatactatacaattggttctgtcttgtagccatattccccttctcatctttttccccccttccttactctttttccttcttcttttctgccctaaatcctttttcctattcccttcttgtgttctgcttttcttcttttgtccagttttgttcttgcctcttccctttgtatatcagttgggatgatttcagatgctggtaacagatgatctgaatcagatgtgcttattcccccatataactggaagtctaaaggtaggccaggctacaacaacccaacgttgtcatcaaggattctggttatgtcttctgctctgccatatttggtgttggcttcatcctcaggctggtagcaagtgactgcagcagttccagacatcacagctagatgtgatgatatccaaaggagaacaggactggctcttcttgtttctctgtgtttaagagggactttcctcaaagcccctctgtgatgacttctcatgtctcattggccaggatgagtcacatgctactgatggaacttcttggtgccctttctagctctccttttctgggctgttgtatccatcctttagctgctggtactattgattaaacaacttagaaccccttccttttctggagaattatctttgattgaatgagagctgtattctcctctatagtttgcaatcaacgactgactgatttaggggtaagcagcaaatggcagctcccttgccttagagtgatttcaggaccaacgttatggtgcagtttatgctctagagctccctgtaatttagctcaagctaaattatagctgaggccattcttgcttagtttcttcccctaccattttctgattccattattccctttctcctgagagctctccctctgtaaatcacatgcaaacaaatcactgtcttaggctctgcttccagtgaacgcagtatgagacaagaacccttgcgtatgtcagtcatttgcaaaggaggggacagaattaccatgattgacttaatcatttggggtttgatgaatgtctgaaagccaaccacagtgatccttctaccgttctttctcgtctttcctatactccccaatctttgtcatcatcatgcatattcttttagaggcttaactgaatatataccaacataaatgtatttttcccaactctttcaatgatgtgtctaaaaatttaaaactgactagatgtgttaaatttaaaaaaattagcaattgctggtccaacctgggggtggggaggacccattaagttttagggaggtgattattaaattccttgacattaaaaaagttatgtcatctatcttaatgaaataaatgcatttttatttacttttcacattatttatatctttggacaacattttctaatctcttatttgaaagccatctgatattacattgtttgtgctgatttatatgttcttttggcactattataattattgaaacatgctaatgtttctttgaaaattagcctaaagctattgcatactatatgtaatatatagaaggtatatgaatccattacagtctgtattaaccctttggatggtgaagatcttaatttgatctgataactttgaaaggtagtaataataggtgccattcaatgagtgtctactgagtgtcaggcattttgctgggtacttcatatccattgtctctactttccattataattattctgggaatttattatctttatacgtttataaatgaaaaaaaaaattctgagtttaaaggacttaagcagtttgtccaaagtcacacagctataataacagtaaaattactaaagttatagaacatttattatgctgtaggcaccattcaaagtatattatatggattgactactttgatcctcacaaccctaggaacgactgttattatctgcattttacagaaaataaactggtgtaaataactttctcagggtcactcagggagtaagtgatgcaggtaggatttgaacctaagcagtcagactccactgagcctgcactcagtctctatgctatactactatgtaagaacttagtatgcaattaaaaccagagttaaaagtttatgtggtgattaatatgttttaacttgctttgactgctctttcttagttttaggcaatttgcttgtatttattccttttagggaataaatttctccaaacttccattgtggttttgctataaacctgagattgtgattgtaaaacacaaacttgaccttttactcatttttgtctctctttaggtactccaattcagaatgatctgcaagaattttttgcattaattgattttgtaaatccaggaatattaggctctttgtcatcttataggaaaatatatgaagaacccatcattttatcgagagaaccttctgcttctgaggtataatttactctaataaataggtttttaaaaagccgtatgtctgaggaaatcatccataacttcatattattttgatttagaaaaatcaatagtgtgaactctttatttttctccacaatccttcgtttcttgcattccttattttagaatatgacatcacttgtctaaaattcatgaataggaacttcacaaagaattatgacaataaacatataaaaatgttcatctttactagttttgaaaaaagtagaacaaaataaccaaagtgacttttgtacttttctattggtgtgtgtttgtttatttagagatggtgtcactctgcgttgcccagtctggccttgaactcctggagtatccttttgcctcagcctcccgagtagctgggactgcaggtgtataccacctccccaacttggatttactagtagtagcaagtgtagacaagagtctcctatttggaatgtaaattgttggttggaatgtacgttggcacaacttggggaaagtttggcaatgtatatcaaaagcattaaaattgtgtatatcttgtggcctggcaatactccttttatgaatttattataaaaaaaagtacatttatttaaaaacttagctggctgggtgtggtggctcattcctgtaatcccagcactttgggaggctgaggtgggtggatcactaggtcaagagatcgagaccatcctggccaacatggtgaaaccccgtctctactaaaaatacaaaaattagctgggcatggtggcacatgcctgtagtcccagctactcaggagaatcacttgaacccgggaggcagaggttgcagtgagctgagatcatgccactgcactttagcctggtgacagagtgaaactccatctcaaaaaaaaaaaacaaaactaaaaaattaaaaacttagctatagggtatagggtgaccttatgtctaccaaaaaaaaaaaaaaaaaaaaaaatcagccaggtgtggtggcatgtacctgtggtcccagctacttgggaggctgaggtgggaggattgcttgagcctgggaggtggaggttgtagtgagctgagatcacatcactgcactccagccctgggcgacagagtgagactctgtttcaaaaaaataaaacgaaataaaaacttagctgtaagggtaaaaaattagaaactggctgggcacagtggctcatgcctgtaatcccagcactttgggaggctgaggcaggtggatcacttgatgtcaggagtttaagatcagcctggccgacatggtgaaaccccatctttactaaaaatataaaaattcgccagatatagtggtgtgtgcctgtaatcccagctactcaggaggctgaggcaggaggttcccttgaacccgggaggtggaggttgcagtgagccgagatcgtgccactgcactccagcctgggtgatagagcaggactctgtctcaaaaacaacaacaacaaaaaagaagcaaactaaaggaaacacaaatgggaaacaaacatttttaaaggtaggacaatggttaaattatggtctacgtgttgtatacagactatatttcattgactctaagattctaccaattataggatatatcattattttgttatttaggagactgtgacttcacttaattaaatggttatgctaaacatataaatagatcatggttggtttttctgtccctatactcatattttatttcttttaaaatttgttgggaagcaatgagtaaatggtttatcattatgaaatctttaatgttcattttaagtgtatttttgtctataacactttcatttaagtctgctatttttccataggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggtaagtgcatagtatctgaaactgtgtcagggatatgagggttctatagtatatgaatctaagagggcagacagggctaatttctgaggttgcatttgtgggttttcaaaaagctctgctggctatctagtatggttctgctgtagagcttatccagcctttcatttgttcttcagagcatgtccacactcctagagctgaagtagggaagagatgagtttgaggtactgccttctatagtttgtgcccaatcccctttggcaccttatctaatacttggcgatcgtctcccttcctattttatgttaatatagtctgtcagttttgtttgtttggtgctgacaaatacaaaatgtgccattaaaaataatttatttttttctcattttgaaagtgatacatgattgtgcataaaatttagaaaattcagaaaatcacaaagaaaataaaaatcatcttaagctcaacccatggaaaatcacattttggtattaataatattagctaacagttattaagcactaattatatacaggttgagcattcctaatctggaaattagaaattcaaaatgctccaaaattcaaaactttttgagtgccaacatgacatcacaggtgggaaattccatacctgacatctttgctttctgatgttaagtgcgcacagactttgtttcatgcacaaagttattaaaaatactgtataaaattaccttcaggctatgtgtataaggtatatatgaaatataaatgaatttcgtgtttagacttgcagcccatgcccaagatgcaaatattccaaaatctgaaaaaatctgaaatctgaaccacttctgttcccaagtattttggataaaggatggtcaacctgtaccaatcactaagtgctttattagtgttattttatttattatttacaaaactctggaataagtactagtattaccatccccatttttttggtgaggaaataggggctcagatatatatgtatatatgtatatatattatatataaaatctatatatataatctatatatatataatcttattctggagaaacttaatgatgctgtttatttatttgtttatttatttattttttgagatgaagtcttgttcttgtcccccaggctggagtgcaatggcatgatcttggctcactgcaacctccacctcccacgttcaagcgattctcctgcctcagcctcccgagtagctgggattacaggcgcctgccaccacacccagctaatttttgtatttttagtagagacggggttttaccatgttggccaggctggtctcgaactcctgacctcaggtgatctgcctgcctcgacctcccaaagtgctgggattacaggcttgagccaccgcacctggccctttttatttattttttttaaaaatatttattttttaaaaaatagagatggggtctcactctattgcccaggctggtctcgaactcctgagctcaagtgatcctcccacctcagcctcccaaagtgctgagattacaggtgtgagccactgcgcccagccgcaacttaaaaaaaactgattctatatacagtgataaaaatcaaaccctttgggcatgaagcacggtaaaaatagccaaaaatttcttcattaaaaggaagaccttatgatggcccagagtataccagttaatttagaatatgtttgtacattcttgaagaaagcagcagggggctctgagtgtttctccattgttgccatgcagtcactaataataggcataggatacttcaaatagggtacataatttatagtctgatatttattcagaaaagccttttctctaacttcatagcaaataaggattgatataaaagggcagaaatgagccttctacatgtataaataacctttaagcaatggtttgtaactatgtttctattgaaactaaattgtttcccaagttcaattaagatgttaggtctttctttaggaaatgtgagtggaacgtaaccagtaacaatatcataactcataattgaagtgtacatggagtcagaagagatagtgtcgcgattagcttgagatgagaagtcaaactggtaaatctctatgatggagatgctgcatcaggctgtcacagtataaagatattatctattggtcaattattaattagtggtacatattataatatcctgggaagctcttaaaattacattagtccaggcctcaacacatatggattaattcagagtttgtttgagagtaggacccaggcatgagcatttttaaaaaagccttttcaagtgattctaatacgtgttcttggttaagaacttgtgcattaagatcgcccgtcttggccagggcggtggctcacgcctataatcccagcactttgcgaggctgaggcgggagaattgcttgaggccaagagttcgagaccagtctgggcaacataatgaggccctgtctctttaaaaaaagaaaagatcacccatctccctgtactctgatttaatattcaccagacaccttctgttagtggtttgactttccctggggacgttctttcataggacagaatgcacgtgcatagactgattggtctaaataggcaggtctcataggtcaatacattttcattctgacttattcagtctcttaatttggttaatatgaataatttccctagagcttaagcatattcaagtttctgaagatgaaaaactgtatactagaccctgggcctgtggtcctttgatgatctttccaagttgtaggcagagctaacctaaagcagccagcagctacttctttctcctcatatgtcccagtgatagaaatattttagagttcctagtatttttaatcaaatgactacacctaaatattgctgtattttgacagtaagccaaattaaaattagtactctgtgcccagcatttttatacatttcacataggattcactgcccttaaagtgtttctagtattactaaagagggggtgcaacacacaggaaaacatttgtgaagtataaaaaaaagtcattcgatcttaaacaaccctggggttaggggggctgacccctgtgtgtgctgttgaaaatccctttataacttgtatgacttttgactcccccaaaactgaactacgaatagcctactgttgaccagaagccttaccagtagcattaagtcagttcacacatattttgtatattatatactgtatttttacactaaagtaagctataaaaagaaaatgttattaagaaaagaatgaagaagagaaaatatatttattattcagtaagtggaagtagatcctcacaaagctcttcacattgagtaggctaagaggagaggaggcagaggaggggttggccttgctgtatcaggggtggtggcagagatgggagaaaatctgcatataagtagacttgcgtagttcaaacccatgtgttcaagggtcaactgcatatcattaactgctcaattagataaagtcaaacctgaaatgtactgtgtaaccataaaggttaaaactcagtgcaaacaaaggctatgaataatcaggtataatttgcactgggtcctcaagtgtttataggattgggataattgagcagcaaaataaaaaagtattccagacaaggggtttaggttgaacaaagtttcaaaaacagtgataaatctggtaaatatgggagagagttaagagacctgccaatcctaggaatttaacccaaaaagtgatgtagtcatgaatatctctgatctctagttatatgttcacatatcagctaggcagttttggagggggaatttcagaggtgctgataatcaccttggaataaatttattctacaactattggtgaaataaaaagtattgttgtaagtaagaataaatttctctgttaatttattggtgaaattcttccttcttacagaagaaactggtaagattaagtaaacgatagtgcttgtttttggatgtaaaggtgttgtatgaagcccacaattcagtagagaatactaacagggagggaaggagagaggaaaagagaaaaagatgtatcaaagatgcaaaatgttagggttttggagaggatggattttgtatcaccatttgccctttatttctctctcctttctttgtctgctcctacttcctgtagttacatgtgggaaatattaatactacacttgcagggtgaaggtagcaggcatgagactgcgttagaactgctctgtaactaactcagtagaaggcatgttactttttaaaaaaatgatcaaatcatgacctataaagatttacctaacagtttcttggacttttcagatagccgttaatcttcacctttttccttccataattttagcattttcccctcctaattaaaaaaacaaacttgagccagcattaacaatcatcattttgaataggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaagtaagatcgatttaacaaacttataagtgctcatagagttttagtttgcactatttctttacttcctacttcccttttaaaataagaaaacattaaaaataagttattttcttctttgggaatatggttagcttctagtatttcataaacttgtaattaacaatgtatctgtaagttttaagaaaaactaaacatatgtatacttttaaaaacctagtgatattttctgatatataatgcttgtttctcaattttcttcagaatcctttcttcttttactgtttcttaaatactgatacaccttaggattttctctttaactttctcactcttaacacacttcctgagtgctatactccctgtactttcaactattgcacacacacatgcacacacacacacacacaaccataccatgtggtccagtgtgtgtgtgtgatgactatatatattttatatcttcttggataccaaacacatataatattgaaacaaatttatatctctagttcagtcctctcttctaatttctacatctttatttttaagtgttgaatggacatctaaatctatcttgatgtcctatagtacttcaaacttcccaggtccaaaaccatgtgacaaaaccatcattttgttattgtaagcctcatcttgtcccattattccttggtaccataatgcaagcaaaaaccctggaaattattatagactcacttttcttctttatttatcccacagtgtcagtcactaaattctattgattttattttttaatttcaagaatccatcctcatttttctggtaccaagatttttgttttgattcttaaaattactgatttgggttatgatgatctcttataagctacttccctcttactttcagccccctgacatactcaacattgccctgaattatatttctaaaatataaatatgaacttgtcactccttttcttaaaaaatcatttgaagactcccacttgtcttccagaaatttctaaattctttagcacattaggcaggacccttcatgacatggttaatgcctcgttttccagcctcatctctcatcactccttcacacataccatgtggtccagtcataccaaaccacctgcagagcctgtaatttgccccacttctgctctgctcttacatgttgcaggtttctgtggctggcttacctctgcttctcattcttctggccaactttttctctttgttaagcctcagctcaacagaccaagtgcaattgtttatacctataatcccagcactctgggagaccaaggtgggaggattgctcgaggccaggcattggaggccagcctaggtgatagagtgagaccccttttctacaaaataacaacaacaacaacaagactcagctctcatgctttctcctatctcagattgagttagactcccctcctctgtactccatagcatcctgtacctacctctaatggagctcttctcacatgttttattagataatatttgatatgtgcaaaagggcatgtgagatgtacatatgcagattgtgacccagtttaagagtgcaaactttcactttagcttctattcatatcttattatctttttttttttaactggacttttttttttctctgaagggtgggcgggataggtggctgtcattggacaaaggataatgagtgaaaagagttttggaagaaatgagaagagatacagtttgaatatagatgtgagaatttatctttgaagatgtcataggggaaagtttccctcttgtggcaagaaggaagaaaggaatgaagaaaaatataatgattaagaaaaataaaagtaatatttggggattgaagttggggtggtcttttctctttatcttgagatagggtctcactctggggcacaggccggagtgcagtggtgtgacctcagcccactgcagccttgacctcccaggcccaagtgatcctcccacttcagcttcccatgtagctgggattacaggaatgtgctatcaagccctgctaatttttgtatttttgtagagacggtgtttcaccatgttgcccaggctggtctcttaactcctgagttcaagcaatctgcgtacctcagtctcccaaagtgttgggattataggtgtgatggtcatttgactccttgtgggtccttaagaaacctaaaccctgccatgttgcattgaaggagaagctacactttcataagtggcacaggctgggtctttgttctgttgcttcacattatctgaagagatcgccttttctttaaaaaaaaattgtggtaatatagacataacatagagttaccattttaaccatttttttatgtataattctgtagtgttaagtacattcacatcctggtgcaaccaatgttcagaactctttgcatcttgcaaacaaaactgaaatactatatctattaaacaccaactccttattttcccctcccttaacacctggactacccttctactctctgactctgactattccagatacctcatataaatggaatcatatagtttttctttctttatgttactgaccaatttcacttaacataatgtcctccaggtttatccatgttgtagcatgtgtcagaatttccttcctttttaaggctaaacaatattccattgtatgtatataccacattttgtttatccattcatctattgatgaacacttgggttgtctctactttttggctcttgtgaataatgttgctgtgaacatgggtgtgcaaataacttttcaaaaccctgctttgaattctttttttttaatttatagatatatttttattatattctaagttctagggtacatgtgcacaatgtgcaggtttgttacatatgtatacatgtgccatgttggtttgctgcacccattaaattcttttggatataaatccagaagtggaattgttgcatcatatggtaattctatttttaatattttgaagtactgccatactgtttttcatagaggactgcaccattttcatttccaccaacagtgcacagggttcaaattgctctatctccttaccaactttgttactttctatttttttgataatagtcatcctagtggatgggaggtgggatatcattgtagttttgatttgcatttctctaatgattagtgatatcgagcaccttttaatgtgctttttggctatcttatccttgggaatccccatcttatccttgggaataccttccaagaccaggaatggatgcctgaaaccacagatactaccaagccctatatggattttgttttttcatgtatattcataccagtgataaagttataaattaggcacagtaagagattaacaacaataaccaataatagaacaatcataacagtatactgtagtgaaagttatgtgaatgtgcattctctctttctttctcaaaataccttactgtgtgtaatatttttgaaccgaggttgaccgcaggtaactgaaacagtggaaagcagatctgcagataatggggtaccactgtggtctctaggtgcctctgtattttctttgtctttcctctgtgagtcctctgtcttcctgctacaatttgaactgatctctaatcttgctacatagctgtcatcttggggcttttttttttttttttttttttgagatggagtcttgctctgttgcccaagctggagtgcagtggcgtgatctcagctcactccaacctctgcttcctgggttcaagcaattctcgtgctttggcctctcgagtagctgaaattacagggggatgctaattttttttatttttagtagagatggagtttcaccatgttgcccaggttggtctcaaactcctgacctcaggtgacccaccccccttggcctcccaaagtgctgggattacaggtgtgagccacagtgcccggcatcctgggacttttaaaaagccatcacctatgcattagtccgttttcacactgctataaagaaatacctgagactgggtaatttataaaggaaagaggtttaattgactcacagttccacatggctgggaaggcctcaggaaacttataatcatggcagaaggcaaaggggaagcaaagaccttcttcacagagtagcaggaaagagagagctagcaagagcagggaaaactgccttataaaaccagcagatctcgtgagaactcactccctatcacgagaacagcatgcaggaaaccgcccccgtgatttagtcacctcccacctggtccctccctgaacaaatgggggttctggagattgtaattcgagatgagatttgggtggagacacagagccaaatcatattaacttataaattcatttttttcctcttctgtgttggattttctgttttctgaatttcacattttgctggagcacatctcacagtagtttcctaagaaagatgggagattaatctttttgacttcttgtacatctgaaactgtctttattctacactagcacttgactgacaacttcccttgtcataaacttctagatcaaaatagtattcccctagaattttgaagacattgctttacatgttgttttctagtttttagttgcttttgagaagtccgatgattttcaaatttcgattcatttgcatatgacctatttttcttcatcaaaaattgatcaacttttattcattcttcatactttgagttataatcttgatataccttaatatgagtcctcattaattgagctgggaactttttagtaggtcctttttatctgaagactccatgtctgggagatatcctttctcgctctctttttttttttttttttgagagggagtcttgctctgtcgcccaggctggagtgcagtggcgcgatctcggctcactgcaagctccgcctcccaggttcacgccattctcctgcttcagcctccggagtagctgggactacaggcgcccaccaccatgcccgactaatttttttgtatttttagtagagacggggtttcaccgtgttagccaggatggtctctatcttctgaccttgtgatccgcccacctcggcctcctgaagtgctgggattacaggcttgagccaccgcgcccggcctttctcttaaaacaatttcttgttttctttggaattcctgtcagtcagatattgaacctcatgaattgattctctaattcttttttttctctcctattggtcatcactttttcttcttaatgtatttcctgtcaaactctcgtactattatcttccagctctcctgttaaaactttgtctatcattttacatttctaagatatttttctaattcttgattgttccttttgaaaaattgcatcctcttccattgaaggatagatagctcttgtttgaggacataaattattttcggaaagttttcttctgttttttttcattgctttgtttaattcaggtttgtttattttgatttttccttttcatgttgaagctcacttcaaatagctggtgttccctggtgtccacagttaagagtgaagcagtaaaacattaattgaacactgtatggataggcagggctcgttgactaataatcatcattgggtaatcaggcagcaagctagcttttaaatttggggactccctatctgtggatcttttctgtggaatcatttaagtctttccatagatgaatcctttagtagtatcttccttgggctggcatatggggtgcctggctgctggtattctagtagttggcaggaaaagggtagagggatcttattcagtatctagactttcattaacacattttttttttaaaagacagggccttgctctattgtccaggctggactgaaactcttggattcaagttatcttcctgtttcagcctcctgagtagcaggggctacaggcataagccactacattggctctcctgccttctacagtcagttccctggtctaagtttctttggtttattttctccagataataaatactttatttgggaaagaaaagtcaactgatcacatgggagcagggcctgggttctacgtaccaatgttgtaatagttccagtctaaattccttccttctcaggtaccttagcaagattctgtggtgcaaatgaactttcatttgtttcttactggaatctccctctttgggcatgtaggcatcaccttatgtatactcctaagcaggtgactgcttcactatggtttttgttttcaaatatcttcagagttagtttctgttcatttttgtattttgctcattctcttgctgtttttagagtgaacctcagagagatgaagaaggcagaaaggtctttgccgcactgtcttaaaactggaagtttagatattgactttaaaatggaatatgcaggaatacctatgttttaattgtacaaggtcattgttgcatgttctctcaatgtcagtgataatattattgtggtattttctttcaactaagaaaatctaatgctgcctttaaatttatctaaagaatctttctttttgattgacagggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggtaggaatatttatgcattaaatagatattattgaatgcctgaggatacaatgcctattgaggatacaaagataatgatgatatataatatccactgcataaagagcccttattttgcgtgaggcactctcctaagtgctttccatctgtttaatcctcctaacaagcctacaaggatggatattagtagtcccattttacagatgaagatatagaagcttgttctagatcccacagcttgtaagatgcagagccaggattcagacctaaacctgtatgtctccaggttctagtttactgcagagttggcctttagggtgttcatgaccatcaggtgaagacaataaagttacagatgctatgattagtgtttatgcaggctatagtaagggtataaaagtaacatatttaggaaaatgtttgagaagcctttggttttctttagagtacagcccatctttttgtatcttgagttttctacctgtaggtttgcacctcagttggtatgtgcattgggggatcccaagacaaccctcaggtttaatgattcactagaaggactcaactgagaaaagcagctatactcacagttatgttacattatagtaaagaatactcaaagcggtaaggaaaaggtactgagtccagggcagagtccaagagagaccaggcacaagcttccagttgttctctgccagtggagttttatggacaacacttaattctgtcggcattggtgagtgacagtgcatatagaatattgtccaccagggaagttcatccacgtcttggtgtccagaattttgtttggggtcagttctgtagtcatggaacacctgcatgactgaccttagttaatcagtctttagcctccagaaatcaaactacatgatccaaggccccaccatataacattgttagcataaactatctggtgtggcccaagtgtctggtaaacagacactcatatcaggcaggacattccaaaggcctagagatgatctcttagaagttggttgaaggccagatttttatttgaaatgtgcagggtttgaacatcaacactttaatgcacagtatcattgataaatctttaaaccacagggatccacctagagccttagctgattacatgtatcctaggtagttctcaggggcaaatctttagctatttggactgagaatgaacctccaagcccatgctacacttggttctttccattcttgctgtccatactcactgtcccattgatgaagatctattctctcactcttgcatgatactcttgtagttattttacagtaccatagtaagtgttcactcatccctttctttctgccaagaaaaagctatgaagtagggcatgcttcacacacctgagatttgttttctgaagctgtatgtaaaatatagaattccgaattttaaaacatatttctgcaaattgcatgtgtggaaggggccattagtttctactgtactctcagaattctcacttattttctataggcaatgtctagagtatggagagatggtcagaaatatcctgtacatatttacagactcctaactacaggtaacaacccttcagtgtgacaaaaatgtatactctttgaataattaaaattattttttgttagcctgtgcttcagtgtcaggaatatattgttattttattaactagtatgttactaaacattatacccaacaaaaataatgaacataaagatctgaaggaaatctaattaatgttttctctttaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggttagttatattttaattctgttactatgtagtaaagttaatttatttcttgttagcagttgaaaatatttaaagaataactttataatatttaccatttgcatatgttagttttatttttttctcagctcatagggcagctgccagatagagatatttgagaaaatattcagtagaatctttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatctgcccgcctcggcctcccaaagtgctgggattacaggcgtgagccaccgcgcccggcccagtagaatcttattctctgaattttagctttttatttctgaatcacttgtgaaaaattgaacttatttaggaaaatctttcaagtcctggtgtaatggctttggagttagagttttttttttttttttttttttttttttttttccaagacagggtctggctctgttgctctgttgcccaggctggagtgcagtggtgcaatcatggctcactgcaacctccgcctcctgggttcaagcagtcttccagcttcagcctcctgagtagctgggactacaggtgtgcaccaccacacctggctaatttttgtattttttgtagagacgagatttcttcatgttgcccacactggtctcgaactcctgggctccagcgatctgcccgcctcagcctctcaaagtgctgggattacaggtgtgagccaccgcatccagccagaaaaatggttttaatccctatttctctttcgcaaaaaaacatacagttgacagaataatcctgttgtttatgttgtacagaatttattcataatggggtcatattttctgaggcacttagaagcataggtcaccatacttctcagtacttgatgtaagtgctagtgctacttaagtaaagctgaaaatttaccctccagaatagacaccattcaaaaaggaactagatcaggagtaggacttgagcaatcaatgtctagtagctgaaagttacttgatgaattatattaagataggttgaagaagttagactatataagactgagatggaagaatttagattttatataaacataaatatattttatataaatgtttctcttctatggaaatgtttctttatataaatgtttctctttaggtacaatagaagcttattagtttattagttatttgtcatataaattatatatgattatatttattagttatatgtcatatataaatatataactaataactaaatataataaatataatcatgcacaatatataattataacaatatataatatttgtggtagttaaaatatgtatatatttttattttttagtgggtagaatttaaacttcatagaaatgttttcagattttcttcatagccattttggtaattaaaaatattaattaacactttatcctccctattaaattttttcctgttttaataatttctcttcttttctcctttttccttgtatttactctaatgttctttttccagtatttaagtttaatacttagcttaatgatttttcagtcttcttttcaaagaagtggatatttaagactatacattttcctctaagctgcccataattttgatatacagtctttcattattcagttctaaatattttgttttttcattatgatttcttctttgtctcatgagttatttaaaagtatgttttaaaatgtattttagtttttgttactgaactctggctaatgctctgtagtcagaaatagaactacatgatatggattctttggtaattatagagacttggggtatggtctagtgtgtggtcattttttgtaaatgtttgttttgtgcatggaaatcgtgtatatcctcttaattgcctagtgtagaattctgtcatattagccagattttgttatgtaatccattttttcttttatagatttcaaaaatgactaatttaacttttgaatcggtaatatatttacatgactcaattatttaaaaatataaaatgtacatggtgaaaactcttcctcctactctacctcctactctacctcttactctacccttatctccctaatttctagccttctacatcaaaagaaaccaccactattagtttttttgtgtatccttccagatatatatgtatgcatatataagccactctagatatatattcttgcccagttttcctcccaataaattatagcatattatatttctgtacctttttcactcagtagtgtatcttgagatctttccgtattgttacagagtttcctcattctttttcttcctcagctgtataatcttccagtgtatagatatatcataatttatcccccactatattagtctgttttcacgctgctgataaaggcatacctgagactgggcgatttacaaaaaaaagaagtttaattagactcacagttccacatagctggggaggcctcacattaatggcagaaggcaaggaggagcaaatcagatcttacatggatggtggcaggcaaaaagagagcttgtgcagggcaattcccatttttaaaaccatcagatctcgtgagacccattcattatcacaagaacagcacaggaaagacctgcccccatgattcaatcatctcccaccgggtccttcccacaacacgtgggaaatatgggagctgcaagatgagatttgggtggggacactgccaaaccatatcatccatagatgtacaattaggttatttcccataagtgtgtattttattcatgtatcattttgaatatcttcaagtatacctataaggtaaatttttagtattgctgagtcagagaatgtgtacatttgtaattttgatagatattgccaaaatgccctttgttggatgttgtgtcaatttacacactcccagaaatacactagaatgtctattttcccatagccttgccagtttagtggattatcaaatgtttgtatatttgccaatctgatagtaagaaaataatatattggtatagttttaatttgctattctcttattacgaatgaagttgagcattttcctaagtttaaaaaccatagttctttatgtgaaccatctcttcatattgtttgcccatttaaaacattaacaacctaattttttgttagatatatctattattcaaataaatatattaaaatatgaaactgtgacagtggattagagaaaattgttattttgtcattttctgcttcatatattttatatcttccttgtgaaatatttttttcattatggtttctctattttattgttatgtagtgatcgccttatcccgaatgccttttgctttcattttgtcttaacatattacactagttttcttatcattagggtttgtctggtctatcttttcccatctgtttaccttaaatttctctgtgttcttatgttttaggtatctcttgtcaatagcataaagctgggttttattttttgtccagtctaatattttgtttcagtgagaacatttagtttgtttgcatttatcattattaaggtatttttatttatttctactgtcttttcattttttaacgagggcctaatactggcgaactcttggttagccagaggttttttggttagtactttgcaggtattattctattgtcttctaattttggaagcaatcttgtcatctcttttcttttttttttttgagacggagtcttgctctgtcacccaggctagtgtgcagtggcgctatctcggctcactgccagctccgcctcccgggttaacgccattctcctgcctcagcctcccgagtagctgggactacaggcgcctgccaccacgtctggctaattttttgtgtttttagtagagacggggttacactgtgttagccaggatggtctcgatcacctgacctcgtgatctgcccgccttggcctcccgaagtgctgggattacaggcgtgagccactgcgcccggccttgtcatctcttttcttaaaacctcaatgattatgaacactgacaagaatttgatgatattaaggaatgacttgaggcttttcttttaggtgtgataaaatttcaaagaagtgtttatcttttagaaatgtagaatgaaatatttataagtgaaatgatacatgctatatatttattatatttatttgaaatttcccataattaaaaggttaaaaaaataaaacctccaatagcttcctattgctcttaggatagatactaaaatctctaaattgataagttagtcagggcagtctaattgctgtaacaagaaactaaaaaagcacaatggtctaacacaatagaaatatgtttctcatttgtgtaacaggtcattgtgggcatttagtggacagcctttcataaggtaatttcgtgatccagggttctttcacttggagctcttccatccatttggaccttagagtcctctgctgggatcccctgcatctgccagccagcagtgagagaagagataaagtagaaaattgttcagtttgaaggatgtttatagttcagacctggaagtgacatagctgcattccataggccagactcagtggcaatatctaaccgtaagggaggctgggaaaggtgactaagtgccctggaggaaagagaaatggatttggtgaataacggctggcctctgccattcatgttttgcataatccagcccttgaatacttgcttcactgtgcattacttaacttcttttgcattattctttgcttttactctataggctttaattgcataggctcgtatcaattgctcgactatgccagtgtcccttccttttcatagctttttaatgtgcttatcatggaatgctttatcttttttccccatctagttcttttctcatctttcagatcttaatagaacatttcctcagggtgcccttcacttaccttccggaccaagtcagcctctcttgtcatatgtaagatagttccctgtatctttccttcatacccttacctctgtttgtaattcagctccacagtcccttatcttcaattctgaaatctagaaagctcaaaaggtttttttttcttcataaatttgtgacaaaattatttgtggcaaaaccttacctaaattgatgtgagtttatcaatagtctttatttaacccattttgtaagactatttatgacttgctacagaatgttaatgagtttcattatggaatgctgacccagattgttcgaattatattctgaatttgtaaacctggccccacaggttttaggaaagggattttgaatttgtaatacatttttcagatgattatttatttaatgtatatctctcccactagactgtaaggtccttgaagtcagagaccatgcctgtgtttcttcatcattttacctttgctgtttaaatcagtacatagtaaataacttataaatgtttgtaaaaagaatgaatttgttttaacttgaaccatggtgatcaaatgtaataaatcacataaactaattatcataaaacaaaaaagtattgtatttagcaggatattggcttgcctaaggattttctcattgttttacttattacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcattgtataattgttaataattccttgattaatacactttcattaagtatctactgagaaatttttataaggaatataaaaaggtaaaatactctctgtctttgggaaaactaatctgattagaaatattagacagatgtttgaaacaactgaaaaacttggtaagtttaaaatgtagctcaaaggagaaagagaatgagaggttaggatcgcaaatgctaaagatgttggatgtaatagttgctgcagggcagtttgagtgagaaaagtcaatgggttagtgcaggagttgaaggatttgggaacacttgagagcactagttcctagtttgggacctcagacttatgcagtctataaagccatgtctaccaaatattgtttatgcactgaacaaaggttcagctaccatcatttaagggttatctggagtaatttttggcattgaaaagagtgttttagctgtgcgcagtggctccagtttgtaatcctagttacctagtaggtagaggcaggaggattgcttgaggccaatagtttgagactaacctgagcaacacagtgagaccctgactctaaaaaacaaacttagccagatatggtggcacatgcctgtagttccagctacgtgggaggctgaggtagaaggattgcttgagcctaggagtttgagtttgcagtgaactatgattggatatgatccaatatccatcctgggtgacagagcaagaccccatcttaaaaaaaaaaaaaaggttttaatatacaaagcaacctttagaagactgaagcctgcaaagagaaaggagttactaatttaatttccaaatggggcttctgtaatcagcttttgtttccatttaggaaaatttcttttagacagaaaatacaggcataccctggagatattgcaggtttggctacagaccactgcaataaaatgaatatcacaataaagtaagtaacacatatttttggtttcccagtgcatatgaaagttatgtttatactatactgtagtctattaagtatgcaatagcatcatgtctgaaaaatgatgtattttccttaatttaaaaataatttgctagaaaatgctaatggtcatctgagactttagtgagttgatgcctttttttttttttttgagacggagtcttgctctgtcacccaggctggagtgcagtggcatgatcttggctcactgcaacctctccctcctgggttcaagcaattcttcttgcctcagcctcccgagtagctgggattacaggcatccgccactgtgcccagctaatttttgtatttttagtggagacagggttttgccatgttggttaggctggtcttgaactcctgagttcagctgatccacctgccttggcctcccaaagtgctgggattacaggcatgagccaccatgcccggcctgttatctttttgctggtagagggtcttatactgatgtcaatgactgctgactgatcaggaacctggtgaaggttgctgagggttggggtggctgtgacaatttctgaaaacaagacagcaacgtttgccacatcaattgactcttcctttcacaaaagctttctctgtagcgtgcgatgctatttgatagtatttttcccacagtaaaaactctttcaaaattggagccagtcctcttgaaacctgtcactggtttatcaactaagtttatggaatagtctaaatcatttgtggtaatttcaacaatgttcacagcaccttcaccaggagtagattccatctgaagaaactactttctttgctcccccataagaagtaactcctcatctgctcaagtttggtcatgagattgcagcaattcagtcaaatcttcaggctccacttctaattctagttctcttgctgattccaccacatttacagttacttcctccactgaaatcttgaactcctcaaagtcaattatgaggattggaattaacttcttccaaactcctgttaatgttgttatattga

SEQ ID NO: 13158 - DNA, 9722 bp, Human
  misc_feature (1)...(9722): n = A,T,C or G
ctctctatatagaatatctatatagatattctatatattatacctatgttccatatcctcacctgaacttaatagtgccagacttttaatgtgctatcgatccatttaatgtgctatcaatactgggtgttgaatagtatcttaatgttgttttcagttgcgtttttctgatttccagtacatcttttcatacatttgaccatctaaattttgcctattgtgaatcatctgtttatatcccttacttgtatattatacaatacaaccctcacaacagctctctgaaggagccagcagtatagatgaagaaactaagtctgggagaaatgttgcttaaagtaacccagctaatgagtttttgagctgaaatttgagtccagatgtagaggacccgtaaacctatgccttttgttttacactacatgccagggcccaaggtcatgttagaaaaaaaaacagaggaagagcacaaataaatttgaacatgtaaccctatgtcttgtgtctaattaggctttgtgcaattaacatagattatttccttgcttcctcacaacaacctgtgaggtaaaacgtgttatctccattctacagatgagaaaactaaggtgtagggaagtgaagaaatttgtcttggaagggttaaattacagctagaaatttgccttggaaaggttaaattacagctagggacagaattgcaactcaaacacagatctgcctgattaccaagtccacgcctgttccacagtaatgtctgtccatagatactcctggtgtaaggtaaaggcctcccacaaatcaagcctgactcatcatctcctagagccaggtcttgacctgcttccccagtttctctccagatccccatatgtttctacttcggtacggccaggactatacctactatctttctgcagaataatggtctgaggcagccttaaaactggccgagccctgctgcttcacattaaccatctgggctaggttagctcccatagattactcttccccttcctcaggcttctctaatgaagcccaataaggatctcaacaccttccaaggtaaaccagaaaattataagtcagagtccttaaacgtggctgcacattaaaatcacttgtgaacttaaaaaaatcctgatgcactagttacaacccaggcccattacatcagaatggtacccaggcattcataatagttaaagcttcccagatgattccaatctacagccaagattgagaaccactgttacggcatcttcttcaagctccagcagccatactcagtagtttccacattttaggttttcataggaacttcttggagcactggtaaagagccagatttctggacgccatcccagagaatcctggttcagacccaggagtctacattcttaataatcaccccagatagtttcactgcagattattagcagacaatattttgagaaatgctgcattagaggcatggaagtaggatgggaacaggaggcctctggccctttaaggatggattaagggactacttttaaggctgtaggggcaagtaggatcaggctgctttttttcattctagtggataagttaaggaagtgggtcctgaaatggacctctccttttaagttacctgagcctctcaataggtactatcttgttctcagcccgggagagcgggaggggcatgctgccttgtcccaccttctgtttctgtttcttttgatgcaaagaggccaagttatgaggcaactttggtccaggagatcctcttagagaaagcaacatagggcctgcctgcctttctttttcttgccccatccttggttgtggagccaggatgcagttatctgcatgaaaggaaatggtcagagtgacgtcccttgggcttgtgttggggcctgttgttgaacactaagcctttcaagatggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtgagttgttatgcccccatactgccctggaagggagagaagtggagaggagtgtagagaaaagggaattggtgggtttactgtcaggctttgttgccttgtgggcaggttgtttctttaggcttggttttcaaaggatggcaagctttggagaagccagcgccaagcctacttccctttagggcatcaacttaagaacagattgccttggtgcctactgagaaatctttcccaggccccaggacaactgagtgatgtgccatcacctatctttcacagaaacttttattgcttgtgatagttctgaaaactgtagagacatatccagctatattcttgtggagggctatttaagtggcgttttgctcttagagtacagcttgctgagttggggaaacttataaggcctcagaaaggacataaataagcttacatctgagggtctgtatacctggctctgtgaacatgtgctactgtatttcttaatgaaagctactatcttaactgtcttgatgcaattagcctaattttaaaactaaggcacggagaggttaagtaacttgcaaatggtacacagatagtgggtcgcagagatgggattgcagctgaagtctgtctgattctaaagtctgtcggtaacttcttaagtctttaaatgcagtattccaatatccttgtacccccaatagtttttctacttgggccatattgctactttgggattctgggactaagtgtattttggaacttttttttgtccccatcatgcttgattttgcttttaacatttgcatcagacattgttgcaggacaacagtgggctattgaagtgtaggactctctagagaatgcagacagtcatcaacttcaaggaattcttgggaacctagtgagatcaatctgtagccttcactagtctgagatgaaaagggacaggacttaatcccctccccaagcaaaacaataaatattctcgtacctaacccttactgtgagattactgtgtgccaggcattgcacaaaatgttttataaacattatcttaatcctcacaactaccagattaggtagtattaacatgcctacttgataggtgaagaaactgaggatcagagtcacttacccatgtcatacaaccagtaattgctagagccaggtatcaaacccaggctctcaggcccaaagcctgtgtgttaatcatcttgctgttctgactccccactggattttaattgagtgccaggcagtgtgtttgggttgggtatatagaagcaaatacttttccgacctctagaagttcccagtatagtggaatggatagataattacataataatgttacagtatgccaagtgctttggaaaggacaaacagtagggctcccaggacctatgagaagaaatggctcatttcttgaagtgaagagactgttggaaggcctcatggaggaggtagtacttgaaactgaccttgcagaaggagcaaagaggtcatgcattgaggcagataagtgcattctgatttaggaaagagaaaatggtgtgggtagagattcattgaacaaatattaggtgccaaatgttggcacctactgagtactaggcatacagatgtgatcaagataggtaaaacccctactttcatggaacatatgttctcgtaggggagacaaataagcacacacagttaaattgtgaattgtggtaagtgctatcaaaggatgaagtaggttgttaagatagagaatggcaatgaaaccttccctttccatggacttgtcagggaatgtatctttgaagaagtgccatttgagctcaggtctataagataaactaggcatgagaagagtagggagaagcctgatttaggcagaggaacaacaggtgcaaatgcctagagggtgaaaacaagttggttccaattgaagaacagaggaaaatcagtatggctggatcctcatgagcattgtgggaaatggcagggtatgaggctaatgagaagcagggacttgtaggctgtgataagggatctggatcctaagagcagcagaaagttgcaaaaaatcaagcactttgggaggccaatatgggaagatcacttgagcccaggagactgagaccagcctgagcaacacagggagacatgtctctacaaaaaataaaaatacattagctgggtgtagtggtgcacacctgtggtcccagctactcacgaggctgagaccagaggatcatttgagcctgggaggttgagactagaggaacatttgagcctgggaggttgagattgcagtgaggcatgattgtgccactgcactccagcctgggtgacagtgaggccctgtctcaaggaaaaaaaacaacaaccccacaaattaagaaaaaattaggcttgtacagatgatgtgaggctagaaaggaggatgcctagaattagacatgtatcctggtctcactgtggaatatactggtatctagggactgtggaaaggatccagagacagatgacaggttcaatcacacaggatgtgtgattcagccctttccctgaaaagctttgaccagacccttcctggctctgattcttagcaaccccatcctgcttcaggaaacatgtgatgtcaaggtctcaaagaaaagggcagttcctccccagacagcctgctagaggtttgggttgagttcctttatagccagggtggagcaggtttaagggtgggcctctaagaaagattactgtaagatgggagtgtggaataacttgagaaagcaaatacaagcctggcttggatttgtgtgaataatgtctagtgcgccaagcccaagggtatattaagcatgagttggaatttgaccttttattttacttatttttttgagatggagtttcgctcttatcatccagggctggagtgcagtggcacaaactcggctcactacaacctctgcctcccgggtgcacgccattctcctgcctcagcctcccgagtagctgggattacaggtgcctgccaccacgcccggctaattttttgtatttttagtagaggcagggtgtcaccatgttggccaggctggtctcaaactcctgacctcaggtgatccgcccgcctcagactcccaaagtgctgggattagaggcgtgagccaaccgcgcccagccggaatttgaacttttaaagatattctggggctgggtgcagtggctcaaagggcggctaatccctgcactttgggaggccaaagggggcagatcgcttgaacccaggagttcgagaccagcccggcaacatggcaaaaccctgtctctacaaaaaacaaaacagaaaaagctgggcatgttggcacatacctgtagtccttgctatccatgggggctgaggtgagaggatctcttgaacctgggaagtcaaggctgtagtgagccatgattgtgccactgtactccagcctgggtgacagagggagactctggaaaaaaaaattctggaacatcaagatgtaaaagaacttctgtgttaaaaatgccacatctaatgaagaattccaggcttgtggattcagtggagaagaaggactaggtgaataaatacaaattaacatggaattatttactgataagatgtctgaagatgagaggtggctttttcctgtggtgccaggcttttgtaatctttgctcttgaccttcgccgggagggggtgcagaagtttggagcaccatggatgtaacctttcaatcctttggccgttgagtgtcagcactacagtttggattaaagctcttattcacaaagcagcatccagcttttagtagacttctcagcaaacaaaatatttatgtgatcaagactgtgttgaaaatagtatatagaggaatagtggtaaaatgaatggggtaaatggagaacaatttccagcaaggagtggtaaagagagagattaagggccaaaggaggaaaagatgcttaagaagcaattcttgaagtagatggaaggcagaagtggtaagatagctgtctgtactagaggatgatagacaaaattattttgtagtgccttggtcctgagtttgaaattatagcaggccatagcacccaatactgaattgttgtcccaaagctgcatctgtatagtgatatgacatgagactctttcttaatccatgtatgtttcaacaattctaaatggacacatttaatggtcaactaataataatattgatcttctcccctacatacagtatgcacacaagataattctatatttgagttttttcccccgagcccagcactgtaagtaatctaacagtgagacagtttctcttaagaaaaacagacttgggttcaaatcttaactctaccacataccagctgtgtgtcctttgtcatagcttctctgagcctcaatttccttatctgcaaaatggggataataactatctcataagactattaagaattaaagagctaatacatgtaaagcatctagtgtattagtaagtgctcagtaaatgatagtatcattatcttgagttaattttagggctgattatagctatcagtctatatcaagacagtttatgaggaatattcatgttaagaggtaagaagctaaacctctgctcttgttccctcttacttctgcaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatgacagcaacagtacggctagatcaggtttcccaggaaactggaggagagtttaaaatatcagtgttaaagctgcaagtaatcctgtaccaatctgtaggttatatttcttgccttaagtgttacttaagtctcttcccccacttgtgagctagtcagtttatagaaacagttctgataccagtcccctagcatgaatcagtacagtttgaccactaatcagagcccttaatgcttgggtaaaatgtcctctattttactttccttggggctttgtcaaaagtcagcagtcagtagtggtagaacttcagaaattttccaacttttcccagcctgggaaaggtgggtgtccatattttcctagtgtccatattctgacgctctataagatttggggtggtgaaaatagcttgggattttatactcctcttcttgcctcctatgtcctggaaactactagtagctaatcagataaattgcctgcttctgtgttagtattaccttctaaaacttttctcagactggaaatttttcaggtaacagtctttatagaaatcttttgagggactagaaggaaggaaatctttttctaaaccagcagggcttttcctcttagcctctgaatctgggaaaagtatctgggattatttcctgtcctaggtgagtacagtagcatttaatgaagcccataaggaaactagagtatggagctgtctgagataatctacttcaaacctgcatttatggtgaagaagagaaaacctgtcattgctgattagtattatgaatgggggagttattttaagtattctatggaacaatagagttcagagtattttccttatgtgacacttaaacccctgtaaattatcctacaaagttccttggtggctccgaggctaggagttggcctgattgggggtgcaggggattagagggctgtgaaggaaggactacagaataagggtgaaacctgccaaggcctggagctgactttattctgggcttgcctgtttcttgtgttcagtttggatctggaccggggtctctaagggagaagggcttgttgtctttgggagacatggaacgatgccttgaaataaatgatgcttgcagtgtgactcctttctactcctatactgtatttaaatgacgggactgggttttgttgcaaataaatcatttcactgttgaagaaaatcttgactgtttttagaattgggagagattggaaggaatttatttcctttgttccctttagctatggctaggaattcaaccctaatccctgaggggcagggctggagcgtcctctgaagttcttctctcttaaggaaacactgctagccatcagccctcgccaaggtgcccctttagggaagcccctaaggggccagtaagtctttccctgcccaattgctcttgactagtcttatggcaattctcatgggatgggactgatttagggtaggtatgtgtgtttgtcaaatccctacgtttcttacctattcattgtaaactaactccttttaccactcccttcaaaagctggttccaactaggctgaatatcttgcaagtgtataaatgcaaattttattcttgtgactgaggagctattccttaacatcagtttgcctgtctaccttctttactgtatccttaagaatcaactcaggcatttctcatcttctcaatgtccccttgacataccagcctcaggtgtgtattaagtttcctatgtattcagacctcacaaagctaggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13159 - DNA, 108060 bp, Human
agaatctccagggatccaggttttgttgatgtggatcaatttaaagtggcaattactgtagtcagataacagcttaaaaagcctttttacacatagaaaagatacataatcacacagcatatggaagttcaattgtctgagctgcggtttagggacttgcagtgtaccgatattaagaccccattttaaagccggatatcatccagttttctcaaaagtgtattgcattttgtcatatgattttctattttagaagtgattcaccatgcatattgatgaaaggttgggtttcccactgtgaaaatgttttctttctaacataagtatagtactaaaaaaaaaatcagtggcatgtagcattaagtggcttttcaaaaatactctctttaaaaatgaaagtctactaatttaggatgctggattccataaaggcccttatagcaggacttaattgattatcacactcatgcctgctataaagctttctatcataagaatgtttgagcttggtgcttaactgtactgaaatccattacagagaacctcattacaagtgacatctaactaagatgaacaaaaagattggcctcataaatagggtgcagtatactattagtgacagaacagagtaatcgttatgaattgtggtctttttacaagttgtctctgacaatgatggatttttgaggggttcgctggataaagcagcccttcttgggtacagtatttaggggctgtagaagttcttattgattgacactgtttatcaagagaatatatttttagtttgtgcggagagtgtgtgtgggtatgctttgaaacaggttgtgtgcactcttgggaagaggtgtaggaagattgagtaggtagaagtcagagttattgcctctgttttcagaaatttttggagatagcaagtagtgtggaaatccatctgacaagggctaaaagcatatggaaagtgtagagtaagtaaaggacatgttgaggactgaaggaatagcaagagttaacgggaatgctcctgtctatcatgttcattgagcttgcaggctgatcagaggaccctgagtggaattgtttctgtgttgatagtggattgtgcatacgatggaaaggtaaagcctgaggcagctacctcatcatgtgccctgttgttgaaacaaacacagacctaggaaagatttgcaagtgtaaaactgagaaagagttttaggagagaacagtattttccttctgcctggcattgttgtgtgtttagaagaggcatgcaaggcaggcaggcgtgtgtttctcctatgaggcagggatgttttacaaaggactaaagagggactgctgagaagaaaatagccagctttagataaagcactataacaaaggcttctagttttatatatcatggtgtccattaaagcttaatagggaagagtccattgaacctggctgggtatgtgttattcatgggaaggataaacatttaggggtgtgcaaagaaatcaggaatcaggaggacatgattgttcagcttttgaaaaggctttacaatgaagattttgtttttatctcccatggatctctatgcaaggtagaggaaagtaagctgaaaatgtttggagcatatcaacccggggatcccagggggttaaaagcactcgagtaaaataaaagtggtcggctcagcttctaaaaagtgttctattttacacatactactgagaagctgacaaaaggaatgattctgatactttgtgcaggatgataaactggcacaatatacaaagtcttataaaaatgtttgtaggctgtttgggatttccagttgaataaacaggctttgagttctgtacctttttttttttaatacagttcccaattatggctatgaaaatgagaagatgaagggaagccttttattgtgaggggtggtagggggccaggtctacatttctatcttttggcaaaataagggttaaccttgaacaggatgggggtggtggtgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctggtgagttagccctgttctgtgttctctctgtttttccaatgaagaaagcttactttctattatgcatggaaaataccttctgccccacagcgtgttgtatctgatgtgggcaggaagaggctgggggtgacagaggtgtgattggaaggtagcataaagagaaccacaaagatcttgatacatggaggggtacagggtgtggagcccttgcttttaaaatttgggagatgtattttaaaggttgagggggtcgtacagccacggatgtttgtcggagtaatttacttgagggttttagctcaagtaagaagtattgtttctgttcagaattttgtgactatcatctgtacttggtgtcctggaaatttcatctgtggagagagttttcagattatggcagaatcctggaataagatctctttaaaaagctgtttatgtcagagaaagtgaaggaagctttggaactacaaggaatttcagtcttgtcctaaatcacagcccttagatgtcatcagacaaataattgaaatcagttaattaaaataaaaagcctgctgaattagtgaagctcttgtcctggaaatttagtgcatgtcagtttcctctgaaaaatattatttttggagcctggagtgtttctgtgatcgttgccagtgaaggctctgcttgtggagaaggctggccggggaaagggttgtttcggctgttctcaagaactgtctaaattgccctgtgcctaatttggagcttcctatcttcagataaaaaagacagggcagatagagatcctccagctggccgatttatgtggattatttgggtaggacaggcagaagaggctgtgcttggtcacagagtttgtacacctcacagatggtgttttgaaacattatctgccagttttctgcaaccacagttgtgtgtaggtattgccagttgtttgaagaatgtttttccctttaggatgtgtctcgtccatcctaatcattattgatatatatgcagaaaggatgcatttgtggcagaattgcactttttcattagtagactaggaatgtatgtagctgaattatggggaaaatcaatttacaaaaagacaatgactgaggtctttgaaaggtcattttaactctttaagctttcatcttgatttatatgcaccatgcaactaaagatgtaatgtgccctgggtatataatacagaatcagtgtgaaagtgcctgtgttttttatttcaccagaatattgagcacatttatctgatttttatgtcataattcagatcttttttatgctgttaataaacgtgttaaatgatctgatttatcagcattttgaagagtctatatgttaattttgtaaaacaaaaccccataataaaccaaagccatttgtgaattataataggtgaacgagattagttaggacccttgctacttctagctaattgcatcattttaaactaagcttcaaagcacccttatttaaaaagcattgaactatatttagggatttagagtcattgataagtttgttttagtgttgttgttaatacatctggttctacagcaatagcctgaagtgtgggcactgcttctctctctctctctctctctctctctcatcaactgtgttagaaaaccttgtacttggatacatagaatatattaacagctgtgactatgagcatgtgccagaatggcgatacttgagcagatttgacacttggctatttttgacacccatctgtagtttttaaattctactattggatggactacctctaaatatgtttttagcttattttagtccatatatataggttcattttaatggatgattttagccatcttgggcaggttttatatttttaagtaagacattatgtgtagaagattaaaaggttgtgttctatgcactctgatatcatctactgcttaaatgactatatatctacatacacacacacacacacacacacacacacacacatatatatatatatatatatatatatatatatttggtagttgaagtatcagaactaattcctggttgtctcagacatgatgtaacaattgccatatctagggcctttttttataaaattgaggatccctggaaacagatgtgcacaaactgatcttattcagacatcccaatctttgggggtgggtaagtaaaaaagtcttagtttaaggggttctagaactattttggttttaaaaaacatgtttttaaagatgttgctagcatattgtttcaaaatgaactatataagtcaaaagaggctaaggatgctttaaagaaatagattatttcaaaattgtttaactcattataaagaaatatcattttactacctgtcacttttgtaacaactagatccttgtgtttaagaaaaggaaaatgttttcttatgagaaggctgggagaccttgggcattatattgtttcaggaggcagtgactccaagctttctgaaacacttatatttttatgaatctttgtataatattatcaaagaacatatgttgacctacaaaatgctttcaggactatttccttaaaaggacaataagtgagcacagtccctgtagcccagaaatagtgctttttcttttagaagatggctagtattaggtcagaccaccctttctcaatggtcctgctctccagatgtgcctggaacttttttttaagttcaagtttccaaaagagagaaaaaaaaggtttgttttcaaaatctggttttacttaagacatctccatcctggagtgcatttcataaattgcccacatattttccttagcagagaacttaactggctgtaatttttaacacatggccacatcatgtgatattttcaaaacacttacacatagctttaagaaggtccctgcagaaatgatccatcctctcacagccggcccattttttaacagcatatctgcattttccatttagtagagctatatattattagcttacatttttgggtagtaaaacagtgcattgctgattgtaaaacatggactttattatttgctgaaaattgatttggcatttatagccactgtgtactagactatttttctgtttttaacatcaatgcttgcaagcgatgatttgtgtaaaaaaacagaaatgaaattgccatggacagacaactgttagtatccctagtaactgaacatttggataatgcacttggatttttttttaatagatgcatctaaatgctattatgcaagaataaaaacactcacagcagtccattcactgacactctattttactttgcaagttggtttgccattatattaggctctttgctgtatcaaacaacccttgtgccaactatagaagaaaactatgtaagttgtaaatacccaattataaatgtagattatgcagcattacttttttgtagcagaaatgtagacagtccagcttcccttcaaaccctgaaaccctctcccttctctttacattcttttctgttaatatttcagagtacttggccttttagttctgtgtatgtaaaatgatatttggaaactttcacaggccatcttcctgtgcagttaatggtctattgaaaatgataattgtttaatctttttcttgaagggggtgatggttatgacatcttaagctttcataagacaactacttgtttatttttatttcttaaagtaaacatttgcttagtagacattatatagcctagaaatgtttattaactatcttatcactacattgttaatggatgtttgcaaagaagatgctgtaattataattttctgaaaagccttctgagccatcaggggaacagatatatatattttagagcttgaaggtttatcttgcgagcaccttcagtttacagatgttgaaactgaggctcctagagattaagggacttgttcaggtagtttatgaaagtaagaagatcttttgaggacattttcttaactgtgctgtttgtaaatctcaaatgtacattaaatcatgttagcatattagtgtcagtcttactttgttgtcttttatcttcagtcctggatcgctctcatcgtatgctttctcccctcccactctaggattgcagagctacctgggagaaaattctgtgacaataatcacttggcctatggcaaaagtgtgcctattaaatttattttataattgtttgggaattagggaacctatatatagttaattaagagagtattaagcagaaccaaaaatgtaaggctacgacaacagaaagttactgtaatgaggaaagttgggtagtagacatttgtaggttgctcaaaatgtgccagataccagataaccatgattcagtccctccatgccctccaaaagtttggagttctagtgttcccagcagagaagtaaacagggcctgaacatagtagatcatgcaggagcccagaggggtagatacccacctggattaggagtcagggacataggggaaggatgcacaatgggctacacgaacgcctattggaatgccttgcctggctccttctacttgctgcagattggatctcagttcatgtaacttagcattttttggtttgttcttcttatactaaggatagggcattcattttggtttttattagattttaatttctgtgtgtggcagtgggtgtagtatttcttgaaagctatttctttgtgtacagttgcagttctttgatagctaaccatatctagaggaataaatcattaacttaaatgactcataacttgagaacaataggatttcacacctgaccaagaaacaggtttatcgtgctggctttctcaaacagctgtttgcattaattaatattaatgtaaatgtactttctgagaaggtctagcttaattatatttttcaacccatagagttccaatcaaaggaatcagaaaatcctcttaatctcaaagggaatatataactgctgtctctgaacggaataaatctctgatagtatactaagagcagccttttattgaaagcctatatatgccaggctgtgggctaggcactgtgtatactttctgattttcactacagctttgcaaattgtttctgttaccatgtgatctatttgaagcctgaagatcagataaattaagcagtttgcccaaggacataggtaaagttaaatggtagagatgggattccctggactttgaattctctttttgtttccttattttatttttgagaggggttgggtatgttgtggcttgatggcaggatcttttgtaatgaaggctagatggaacatttaaaggggaatgtttgaatctgaattatagtagcatagaaggtagagttctttttgctgaaaaataaaaacagaaaaagcattagccttcatcatcaagaatgatcttggataaaacaggttagcatgctggttatttctctgtgtattactattcctcttgaaagagaacaatggaattaataggcatcaggagacttaatgttattattttgaaaagcctaatagaaatcatagggcacattaagatacaggaacaaaaaagaaatcataaatttactccctgacagagctatacaggttaactgaaatatcacctttcttggcttttggaatgtggtcatcctggctatcttttgttaatcggaaggtcagatggatggttttctgtgttttggattagtagaaaattagaaagcaaataatatattcaacaccttggcagacaaaattgttaaaaattgtgtagctaaaaaaaagcacgttttttggtggtgagactggtgggtatccatggctctgcccccaggagctcctagacaagcaggcacagtgtttccagtagatgagtacattcttaagaaagcagatatctttttttgccatcccccacctcctgcaaagaaaaaaaaaaaagcagttgatttttaaaattgtgggatgctttctctagaaggcttgattttgttttccacatttcgcttttaaaggctaagtgataagtgtagtctggctcactttattagagggattcttttaattttatgtggtttattaacattatacagagtacttgacactcatggaagaaaataattttaaaagtacctatgagaacatgatactgggaagagtttcactttaagagctatataatcagctaggtgaaatgctttttaggaagaagggatgtaggagggtgtctttatcatgtgtttatgactttaacaagagtcttaaagagtttgacaaagtaaactgagcatttttcacaatctgggatgattttgatgggggtgctaactttaaaaaagacaattgctgtgcttttgagagtctcgttattttacgtttgaactttccctcatttaacttcaccaccttcctcaggacttgtttgctttaatgattctcaggttattaggaggaaaatacatagtaaaatttgagggtcctgaggtaacaatttatatactcctgcatttgaaatttaaatatgtcctaatgaggataagactggaaggaagaaaggctgtgatcctgacattttccctgtgaaatggacattgtttcttagttgttatggttgtatctgaacctatatacttagcagttacagtaacacttcatttgaaaggcctgttaacatttattttctttctttttgctttagcattatatttgtatagcctacagacaaaatacgtagaggaaatcaaaacaaatatttttgtctatagaaaacacttgttaaactttctattcaatatttattttcttctaacttcctagaatattccaaatacatagttgatttagaaaatatagaaaatgatagaagtcagaggcaaaacccaactttttagttatccaggcattctttatataccagtgtttgcttgctaaacataaagtggaagccaggcgtggtggcacgtgcttgtagtcctagccgctctggaggctgaggcaagaggatcgcttgcatccagaagttcaagtttgcagtgagctatgatcgccccatgacactccagcctgagcaacacagtgaaaccctgtctcaaaaaaaaattaataaattaatacaaacgcgaagtgcctcccaaagttggtaagcctaggcatgactaggttttcaaaatgttttctattttgtacaatttaggaatctttctaaagaacatctttaaaaggaagagttacctgttgttgacattgtttaactacttactacatagaggagtgtgtttccatttggttttttatctttatctatattttgatcatattttctgagtgtaaaacatttggtaccatgtcattgtgaagttaataaactttttcccaaaacatcttggagaattgaatcattttgtagtgtttctcaagagcaagattatctctttaagccatagttactttcattcactgtttaaaattgttgtacttactaatcacaagctgatcagtttgtgctgagtgtatttttttatttttttaatttatttatttattttgagacggagtctcactctgtcgcccaggctggagtgcagtggcgcaatcttggctcactgcaacctccatctcccgggttcaagcagttcccctgcttcagcctccctagtagctggggctaaaggtaagcgccaccacgcccggctaatttttgttgttgttgttgtattttagtagagagggggtttcaccatgttggccaggatggtctcagtctcctgatctcgtgatccgcccgcctcccaaagtgctgggattataggcatgagccgccgcgcctggccctgtgctgaatgtattttatctttagctttgtgacttgggtttatattatgagcaattaatatattatattttatgaggccatctatcaaaaacacagagcatcgagaatgtcaatgcctgattgtgaatcagtgctcttccatttacagtctgccagagtttcactctctttgtcttaaaagtagaaacagttattctgccttgctaactttcacaggatggcaatagtgattgtagatatgctgtgtacctgtataaagaggttattaaacctctttatagacagcgatgctgtctggagttaaaaaataggagacagtgtttaaccccccacaaaacagtgccaagtgttatgcttgatgcacattgtctaggttagatgaaattttctgagttttgcctatgcttgataggattttctgcctcatctttatgtcagcggtttaccccttctctatcagtgtgccacccttttacacatcccagttatttgcaaatgtggaaaccagataaccaaacttagaatggtgatcacataataaaacacatgcttaagtgagagcctgaaaagcctgtcttttttttttttttttccaggtactaataagtggcacttttaatttgtggcatcaatttacatcactgagtctgtcccccacttcttccccaccccacccctactgattttcatgtttctttgtaggtggttttgctggagagctgaattttgtataaccttttactccacttctgtgttatcccaagatacagcttctttttttcactgtttaaaatagacattttaaacatcatcaactccccttgataaagctgccatttatgttcagatcttgattttctagttttaataattccattccaggctacctgtgagcctggcatagagtatgcaatcagcaaatatttgcttaatgaataagtgagtggatgagaggtagactgggactcacagagatttcaaaagaaagaaataatacacaaagcatgttaattaacaaggggaaaaattaagaaatgaatcttataaaaattttcagtaagtggtctttacgaatgagaattttctttcagagttaaggaaaatacatatattttgtggcccacaactttattggtggctagctgcatgttaaaattcaatgtaatttatcctgattatacttactgaaagtataatgcaacatacaacacttaaaactttctggcataattactaaaattagaaacaaagggcttttgacagtgtgtgtgatattttggaaatggactctccctccacctgggcattttcatgtagtttggccatttttcattcttgtcacctagtggaggatgggtataatgtttcagtctcccatcaggcatactgggtaagattttagcaaagagaagtattaatgaaatatttttatcttttacatgataaatttagccaatagtttcttatatcaataatcctaggtaagtaacaatttgatagacaggtaaaatttatcttaaagactctagagcgattgctagaataattcattctatatataatatatattttctttaaaaatttgaatgattttaattgctgctctctttgaatgtttctgcccttttatcattttttcaacatttgcattggatcatttgaaaggaatagggtaagacttttgagtttcagtatctcttaaaagaataatctttgctaattcggcagatactttgtaagcatttctcttaattcatgcattataaaaattcttggaaggtcagtttagctcatctgttgagtttcctaatacaagaatgttgctgattttctaaacagattaaagactctcacagggtcagtcaagcactttggaagcatggtacaggatggtgtagccacgttctcaacatggggtcaaggggaccaacagtgtctgcctcaccagagaatttgttggaaatacaaattctctgccccctcccaagcctactgagtcagaaactctgtgggtagacccagtaacgtgtgtttgaacaagccctcagaggattcttaagcatattcaagtggagaaccacttttgtaaattatattttttgtgtccttttatattctatagataatgcccctttttggtcataaataagccaggttaggtcctaaaagtatggaaatcaatattgttcatttaatcttattttttctttttatttttgtggacttgtgtagagaaatatgatttattttaaatgatgtatttttaaaaatacttgagagattacaaattatgtatttgtttaattatgccttggtttctgacagtgtattcagatgcccacacagctaagttgactgagaatcaagggagggtgcttttcgacttgaattctggtttgttggtttgttctgatagttacttgtaaacaaatgagtagaatatttaggtagacttcaatttcacagtaatatcagttagtcttggaagtttggatatacaaagattttcttttatttttctctgttcaacataaataagcattcaatgtaattaaaaaatgtttcattggtaatgccttgagaagatttatttctgatgtctcccatatcttctgttgttctcttttgtgcttggtaggccttcagtaagtgtagtctgacacgctttgtggcctctgcctcctgtgataaaatagattgaaatgattcctggcaccatctggtgaagaggagcagccctggaggactgtgctttgagagaaagtgactgaatgctaagaaatgtggaagtctagggacacaggcaaaggatttttttttttttttaaagagcatgaacattaatacatcttcttgaggtttgatgggacatgtactgcctactgccccatctggtgcttatgatagcatggcatattagcatgctgcaagttcataatgtattcagggggaggaaacatcccttgcataccaattgaggcatcctctctttcagaactgcttttgaatttcaatgatgtttatatcttccaagccgcgtctgaactgagcatttccgctctgaggaataacttgagagagagagagagagagtgagagagagagagagagagagtgtgtgtgtgtgtgtgagagagagagtgtgtgtatgtgagagagagagagcatgtgcaagagagaatgtatgtgtatgtattctctccattaatttatcttcctctcttttttgtgatgaaattaagtagtttttaatattatgttggtatataatttttaaattttttttcttatttgaaaccatgtactactttgttatttcacgtacggcacttaaaacattttgccttgtggaatcatttgtatggttgtcctcctatagattgaacacttttcgagggttgggctggtacctaattatgtttgtgtctccatggcacctagagttcagtcatccatttaacaaatatttatttattgagctcacactatgggtctgacactgttatagatgctgaggaatcaatagtgagcaagactggtgagtccctcctctccaggcatttgtattggaactgggaggagacagacagtaaacaaagaaacagaaaaatgaaaaagatgatttcagatagggataagtacaataaaaaaaaaggctggagagtgacttactaggtggggagctcatttagattagattgtcaaggaagacacctttaaataggtgagatttttgctgagagctgagtgatgggaagatttagtgacagaggaatagcaaccgtaaagccttgagatgaaaacgattgccattttcaaaggtcagggtagcttgagccaagttcaggggccagtccattgctagaagttggggatttattctaagcatgtctggaagccatcagagggttaagctaggaagtgacatgatctaaattgccccctttaaaaggataacttgagctgttgtgtgtcttgcacttagtagtcactaactaaccctggaaagaatgagatgagcctttaaatccattgacgcaccatgtttaattggaattagcatgagttttaagatcagtaaaatgtctgttggattctggcctggccatttgctttatgtttgattttgagcagttatttaaccagttatttagcgtatgtttctcatccgttgaaagggaaaattaataccttaaggccatggcattattgtgaaaattaaatgagataatttgttaggagacccagcacagtgctcagtttttaataggtacctgatctatcactgacatagggatcataataaaacttttgggatagtttcaaggaacatttaaacagttggcagtgtccagttggaaatctgtttctggtactgttatcttcttaataaaacacttcaaatattaccatgatagtagcacttaacatctgtagtttgttgctcttgatctagaattatttaagaaaaaatactcaaggaattatatggcaaaatttatgcccagtgaaacaacctagattttcctccccctgatttcttcttcttaacaaaaatgtatttcagtgaatttgatttcttttacgaataacagtctatcatttactttaaatatattttctttttttttcctcaagacatgtttaacattgaagaagccaaactgccttattaattggaatgaaaattgtggttatatatatgaaggttacaatgcagaattttaattcataaaatagtaaccttattagttgcatagttattagacataagcctttcaaagataattttttaaatataccgtaatggacaaaataaggagtttcttagtttttgcctaaattatgcacttaatagcaagaacagtccttcaactattttcatagtctatgaggtaatgtttagcttctcaaactttctgtagaaggattgtgggattatgagtaggagcagatagtgttggggattgaatatctaaatagagttcgacttattgtgttaggcataattttttgaatatataggttggataagttatttggtatttgttttggggtagaggttcttcccctcctcagttggtagattgttttgtgttttgcctacagatattcaggaaaacaaataatgcttaaggaatgtggaggaggtagtgtgggtaattcaggcaagtttagtcagcacttatgagattcttgaaatgttttttgatgtcctgcagaactgtagagagctgttaacatctgcatgttctgtgagagaagtcacatttatggctgctgtattcttgctggaatgtcagaaaaagagggaaagccacagaaaaaggccacagaagattgggaggtgggcatcacagttcagaataaggcatctgactttacatcctaagatgtatcattttctttaggtaagccccaattgaattcttaacaccatcttagaagagtgataggcttgtgaggtttgagggtaattcgaaaaagatagttgccttgctgagaaacagcctttgtgaaactttgtaggccatcacagatattgtctgtccacaccttatatgtattttcattctcttctgcaggatgccgcaaatacagagacttaggtagtatttgtgttccactagaaagagagggaaagaaaaaccagctgatcaggtgagataggtacattttgctaatctgtgctaggtgtgctgggccacaggcctccagaagagacctgcatgatacagagtcgcatgtgacgtagccaccatacctcctcattttaatttgtttggcttaggcgctataatattgcaaactacactgctagatttctcctctcttgtctcttaaggacaatgaccattatcttgtataatacccaatttgtaattattttcaatttcagttacttggccaatgtggcctttattttgaccatttctctcacatgtttttcagattccaataatagaaagagctctttgtcaccctcacaaaacttgctttcttaggatattaaaggatatacgagatacaatgtacttaagtaaaatgaccatcatctcaccctccaaagaccaggttgagtgtcaaatatatggttctgtctgtctttctatcttcttacttttccccacccctccctttcttcctcccacaataaactttaaaacagatgttgtactatatatttaaaaattttttaaaaagagagatggggtctcactgtgttgtccaggctggtcttgaactcctgggctcaagcagtcctcctgccttgggttctcaaagtgttgagattacaggtatgagccaccataccccgccagttgtaatatttttaggaattaaaatccgtaacaagctttggtcattgtcaaatcacgttgcatacacagggtttaataatgatctgacacactttttccttgataaaattgaaaggaaatagggcctatatgttatttactgacacctcatttatattttgaggaaactagaagtccttaaacgtctaaaacaagtgtattgaatgttcatttaagcagtctatcagttgtaaatgtttacatttaaagttaattgtttattgaaaatggatcatttgaattagttcatttggtgagctaaacgtttgacaacattttgataacagcagatattgagcatacacaagttatactttttatgtggtccttcttgataagcagtgcaatggagttgtaaaaaaattatgtgagaacttttcttaaaggactactcagctgctcaaagctcagatccctgacatgcatcctttccattgtaaacttgtgcagtttacaaaggtctgtagcagatgttggaggaagtgggtagataagattaagtgggtgtggtgtcctaaaataacctaagaggcaattttggagcaaattgtttgaggttaaggactcttgtcttttcttcctttgtatcttttttttttttttaaatccatagtgcctagtacagtgttttacacataatatggatgatgcatgtttcataaaaataccctgtagctcagttatgataggtctgtaagtcatatattcatttaatcagtcatgcagcaagtatttattgaactcttaatacatgctatacttttttctagttactgggatgaatcagtgaataaaacaggcaacattttttgccctcatagaacttacattctagtgtatgtgaggtgggtggggtgtgggagtgaacaggagcagacaataaatgataaacataaaatataagtgagttctgtggtttgttggatggtgataattatggaaaatcaggataaggagggtctgtagggctgttggagcaggggtcaggttacagtttaaatttgggtaattgaaatgcacctctttgagaagggacttttgagcagagatttgagggagatgagggaagcggccatgtagagatatatgggagaagcaccttccaggcagagggtagagtgtggtgtggattgtttgaggaatgggaagaaagacaacgtggccaggttagactggtatgaggatgaaagaacacctggagatgagaccagagagtagcagggagcgtgaggggcagatagctcatggagggttcttgaaggccattgtcaggacttccctgtccaatccatttaacatccatcccacatacccgctgcccagcgcttggttgagtatattcttattcttccctgcataatgtcataaaatcagatgcttaaacatcatatcattctgaagacctcactgggcctcatggttactcccgtcatttattattccatgcctccagatatttactgtcatccaatccaatttgtgttttctgttttatttgttgttgtatggcagctgcattctttaacctaaacactgttctatgtagtgctagtcaaggctgcatgttaagtctttcttggttttgactgctatgttttagtgcttttaaactcattttagatataagatacccaaaacaggcatttgctgaaggtaaactaacagtcaggctgcagtaatattaaaaatcttggccaggcactgtggctcacacctgtagttccagcactttgggaggctgaggcaggcggattgcttgagcctagaagtttgagaccagcctggccaaaatggtgaaaccctgtctctactaaaaataaagaaattggtgggacatggtggtacaggcctgtagtgccagttacttgggaggctgaggtgggaggatcactggatcctgggagatggacgttgcagtaagctatgattgtgccactgcgctctatgtagcctgggtgacatagtgagattttgtcttaaattttttttaatctttgtattaatcatgtgttcatactaaggggcattatttgagagtcttattataaaccgtgatctagaatctgcttccacatttctcttagtaagcagcacacataccgaagacttgtcttgtcagctttcctcattcccctgcagtgagttaaggtggtacaagttacactagtatccatgaacatattaaaagtcaaatgtgtgatacaaatcattcttttctttcaaggtggtgacagtctgaaatgatacatgagtcggcaggtaggggtgaaatatctgtgttctttaggagagcacaggccatggggtaggcttcctatgtaatacaggcatgttcagtttaaattatttgagtaatttccttggacccacttaaattttctgacctccatgaagttgctgcaccgtctaaaagtacctgaaaaaaataaaatctactgaacttaagtggctatataggtatcctctcaaagtataacttttgagttttagtggctgcacaataaacaggattcaattcaatataaaaatatttgagtactgattctgggaacgactttctactaagcgtagcaggggttttaaagagaggaagacacagtcctggcacttaaggaacttaagtgtagtaggggatatagaaggagattgaaggattgagaggcagaaaagtggagactgattagggagaaattacaagaggtagcgcaggttccaaatcaacatgagaggattttgaaagcattgagttgaagtccatgattgaaattcattgaatgagtgtcattatttgggagaaaaggtgagagtggaatcaagggtactgtttgaattttgagcctgcgtaattggcagagtggtcttgcctcagtggaaataagaaagcaggaagaactcgttttgcagaaagaataatctcactgataggttgaattggagactcttacaatagtaggatccatcttgcctacagttgggaatgtatcatggtagtttgggtgaggaattgagtcctgagatataaactaaagtggaaaaaattgtacatttatgtgatggatagacaattttgagaaaatggaaaatactaaatgggtgttatccttagtctcattatcgaagctttgaaattccattgcaattatattatggtttattttggcggtgcataaattcccacttggtaattaacttttatatccttcctatttgtgttctatacttttattttccatatggaaaataaaatatatgtataatatatatatcgatatctttttttttttttttgtagagccagtgtctcactatattgcccaggctggtctcgaactcttggcttcaagcaatcctcccaccttggccacccaaagtgctaggattacaggcttaggcccctgcacctggtctattttattactttctgttacttgtgcatagcttcctcatagtggaattaattgactcctgagtatccttgcttgaatcaacatggtttccaggtggagggtaatatagtggttaagaagttggactttgcagtcaaacaaaactaggtatgattttctcatcttccctccttttacttgctttttgtgcctgaattttctcacctgattctcttgaggattaaatgaaataatggaaaaccatacatgttggtcctcaataagtggttggtgaaaggcagtagtggtgatgagaatgacagtaataatatttattccaaaactcattaggtttatccatgcttctgcatattgcaggcatggagatgtgaagtagaatagagtcccgcaatggaacatgagtttagtggttgctcagcccacctcttcatggtgctctgtgctctttttgccatctcttggatagactgattgagacacaacagacttataccctcttggtcttcttcactcattttttaccatagatgcacctccaagtctggaattgactttttcacacctacctttctgtgagaacttgcagaagtcacattggtttactcattcacaaaacatgaatacagccaactgtcagttacagcttgtttattcagagtgactaaattttggctttttctttcctgctgcctgtcttctgcccatatcgctactattgaatttttgtgtaagcgagtgcatattggttcattttagctacttatcaaggatttttaagagcaggtagcgaaggtgcattatttaccatgggcttttctgagttttgttttgtctgtctatccatacatctatgctgttcccctgactcctgttatcatggatagtaagataaaccaaataagcactatctgataaagaatttagaaactttggcataaattcagcttaaggtttttttttttttttttttgagacggagtttcactcttgttgcccaggctggagtgcaatggcttgatctcagctcactgcaacctctgcctcctgggttcaagcgattctcctgcctcagcctcccaggtagctgggattacaggtgcctgtcaacatgcccacctaattttttgtatttttagtagagatggggtttcaccatgttagccaggctggtctcgaacttctgacctcaggtgatccatccgcctcagcctaccagagtgctgggattacaggtgtgagccaccgcacccggctaaggtttttatgattataattattttttaaattgtgattttaatactgtcactccaaaattccaaggaaattacagctgaaaattttatgtataccatctttagtgtaacactctgtatgtttgttactataaaagatataaaataatcatactttttattatttcatttattttaaaattttatgtaaatttatattaaattttatgaaatgataatgtataatgacttttaataaagttttctctacttttgtgatagtttgctagaactagttagtttttttttccttccttagtatatatacttttttggttgttaagactgggactcagagaggaaaagaactctgtttcatttttggtaagggatttcacaaacttaatttggggacacttgaggatatctcatctaatcttggaaaatggatgtcagttttcttaaaataatttttaaattgaataaaattaactttttgtggaaactttatttttttggagggggcagaatgctatatagtcactagcaaagaggtctgagaaatatgtatagattgaaattcttccttagaacacctctttctccacattcacccattaactttataaccaataagacatatgccttcatgtgagagaaatgagaaataggagagactgaggtccaggtgaattgtctggatatgaacaaattagggacacaggagaaaggtgtgagaaagctcacatgcttgaataaaaatgtggttgttttttcaagtcttttttgggtaactgacatgcttgaatccaaacacagctcagggcactaaaataatgaaatggcacatagtcttcccaaggaaaagctgtgtttatttaaacagtggatgcttatcttttcctttgtgtgtgcgtgtatcatttctgttcagattctcagattacagtaatagctgccatttattagtgctttattatgttccagctgttgcataaatttttcacatccatattctctcatttaatctttagaaatcacttacagaggcagttgccaggaccacccttactttaaggtgagggaaagcagatcaagtgggtgggcatggtgccccatgcctgtaattccagcacttcgggaagccaaggacaaaggatcacttgaggcccttcgaaaccagcctggccaacataacaagacaccatctctacaaaagaaaaattaaaaaattagctgggcatggtggcatacgcctgtagtcctagccagtcggtcagaaggccgaggtgggaggatcacttgagtccaggcattagaggctacagtgagccatgatgacaccattgcaatccagcctgggcaacagtgagaacctgtctcaaacaaagaaaaaagaaatccagtaatttgcccagtttaagaagttggtctgggattccatttaaagtttagtgatctcaaactcatgctcttaacaacctatctggactgtttctgcgtatcatcatgatatcataggcagcaggcactttaccttcaaataataaaaccagagaatgtttacatatgaaagagataaagaaccaccccttcaggccaggcacagatcacacctgtaatcccagcacttcgggaggctgaggcaggtggacctcttgaggtcaggagctggagaccagcctggccaaggtggcgaagccctgtctttactaaaaatacaaaaaaaaattagctgtgtatggtggtggttgcctgtaatcccagctattcaggaggctgaggcatgggaattgcttgaatctgggaggcagaggttgcagtaagccgagatctcaccactgcattccagcctggacaacagagagagactatctcaattaaaaaaaaaaaaaaacccaccccttcattttttagcttaaaaaaataaaataaataagcccaaaggtttttgttttgttttgttttgttatttgggacaaagtattgctctgtcacccaggctggagtgcatttgcgtgatctcggcttactacaacctctgctgcctgggttcaagtgattcttctgcctcagtctcccgagtagctggggttacaggcgcatgccaccacgcccagctaattttttgcatttttagtagggatggggtttcaccactttggccaggctgatcttgaactcctggcctcaagtgatctgcccacctcagcctcccaaattgttgggattacaggcgtgagccacagtgcccagccatacccaaagttttaaacagtttttcattcagccagccaatcaaccatcaaatatttactgagtatctactatgtgccaagtagcaagtaagccaaacaaagcccaggcctttgtgaaatcctgctggcctttagtcatgtatttgatggtgggttattggtgggaggtgttagtcgaatagtatagtagttaaacccggagcatgggccgtgaaatcatgccccttggctttgcatgctgttcatttgctgtgggacaatggacaaattatttattctttttaaagctcagttttttcacctgaaaatggtaatatgaataagatctattgcattgtcttatagtgaaaattaaatgagttaactcatgtaaagcacttagcaagataactggcacttggtaaatgctcggtgagtattaactgctattaagataattagaaatagcctgggtgcagtggctaatgcttgtaatcccagcactttgggaggctgaagtgggaggattgtttgaacccaggaatttgagactagcctgggcaacagagtaagacctcgtatttgaaaaaaaaatttatattattttattttttttgatcatatctcactgcagcttttaacacctgggcacaagtgatcctcctgccccagcctcttaaatagctgtgactgtaggcacatgccattacacaggctaaaaaaaattacattataaatatttctagcagtaattgtatttcaccctgacgaggaaggcatgtacaaagatttttacaataagatgtgagttgtatgatggggaagaaatggagggctttgaaagcacagtagagccagacctaactcccagttggttcagggaaggttctggtgcagcaacactgttttccttttcaccttttttgtttttttaaaacttgataacttatttgatgccctaaatcctggtgttctttgacttaacagcagtttgccacagtgtatttattcagaattagctgtgtgctaagcattgtgcagaatgctggggatggaataatcaataggatgtagactcggccttttaaggaacatgtgtgtccgtgtgtatgtgtatatagtatacacacgggacacacacctgcaaatataatagttgtaataagtgatgctaagtttgctaataaatgtatgtaaaatagagcccaaagaaggtaatgatcaactctttgctctgaatatggggcaggggtaatttgggaagccttcatgggagaggtggcacttgttctgtgtcttgaaagatcataagcttgttgtagtcaaggtacatttcaaaatcagggaagaccatgacctggtatgaattgccagggctggagcatatgctgtgagaaagtaacagagggaaatgtcaagtcttataagtagaagtggtagaaagggaagccactggatgcttttaagcagaggagtcacattgctgggtttgaacgttaacatcactctaggagtgaagggaagggtagattgaagaagatgagatttgtagtacgctaggtgagagaacatgaggacctgatgggccacagtgtcaatgagcaagaagggaagggaggaaggtacaggctctagaagtaccaaataaacagaactgaggggctccaatgatcagttggtatggagccaggtatggtgagcagtggtgtctagagtgactctggattctgatatgagcaattggttgccatcaaccagaatggggaataatacatcgagagaagacagtgagttcactttgaaatgttaactttcagttttatttggtgtattagtgcagagatactcaatggcaaggtggatcacaggtttgtgaggtacagatgtatacagtgaaaaatcatcatttggagtcactggcgatagctaaaaccttttgagttgctcattcaggaagaaaacaagtggtataaagagaggaaaggcttgaaaagaatatgggaataccagggcaccagaaaagatgaagagaggagaaggaactgttatggaggttttgagagagtcaggtattgttaaaacaacaaagagtttcacaaagggagtggtgtacggggtgaagcactacaaagggaccaggaacagaagaggggtcaagatagccttttgggccaggcgtggtggctcatgcctatgatcccagcacttggggagaccaaggcggttggatcacttgagctcaggagttcgagaccagcctgggcaacatagtgaaacctcatcactgcccttcagcctaagtgagactctgtctcaaaaaaaaaaaaaaaacaacaacaaaaattgccttttggatttggccacctggaaggaaagtagcaggtaactttgtccttttgttggaacttttttgtggtggattgcaaagtggatggagcccctgaggtctgcccttaagaagccaggcagtgggagaatggaggatgtgccagtatagtctacaataaaggggaggggtgttaatttttctggatgagagagactccagcaagcctaggttttgagaaggagtggttagggccaaacaagttgaagataagagagagagtaatttctgggagagtgaagcccctagaggcagaagggtgcctcttctgagcctagaggcataggtgcagatacagaggagtttcgagggcagagtttgcagagatgtaggacccatgaccttactttgctatattaagtagactatgaggttatctgcagaggagagtagcagagtttggctggagaattgagatgagtcagtgtctttgagatgaatgcaacctggtttttttactggatgactttcttgcctcaccttgtccggggctgtaccatgttggatatgcttgggctcatttaatctcgaaagccttcgttcttcatttcctgtgtcctgtttggcttttcctctttgctttatcccacctcacatctaaccttgaccacagcatgaactcgtaactattcaccctccctttgtgtttctgttttttaatgacatctccttgtttcttttcttactgggtttataaccaattcactctccattgtccttttaaaagttagaatcctgccttcaggattttttatgcttttttatacagttttttttaatacttctatgccagacactgtactaggactgggatataacagtgctctgggagagagattaaactccaattaaaaggatataaaagaattttgattagctgggtgtggtggcacatgcctatagtcccatctacccgggaggctgaggtgggaggttgaggttgagggtgcagtgagccgaaattgtgccatggctctctagcctgtacaacagagtgagaccctgtctcacagaatacataaataaataaataaataaataaagaagaattttgagttgtgtaagtattgggaaggaaacaaaggggtgaaaattctccatgagataggatggtcaggagaggattgattccatgagaaggtgacattgatgttgaaagataaaggtgaaaatgagctaaccatttgcagaagggagaagggaaatagtaagtcttaaaaaatatttattgttttcataaatagacattccataagtattggattaactgcctggagctgtttgtggtactcttgggtcttccctactggtctttccttggttcctgaaagctccatagaagacctgtaacagattatactcctctgcttttaaagcagaggattttttttactttttaaatttattttttttgagatggattccctctgtcacccaggctggagtgcagtggtgtgattatggctcactgcagccttgacctcccggtctcaagcagtcctcccacattagccacctgagtagctgggactacagatgcatgccaccatgcctggctcatttttgcatttttctgtagagacagggtttcgccatgttggccaggctggtcttgaactcctggcctcaagtgatctgcctgcctcagcctcccaaagtgctgggattacaggcatgagtcaccgcacctgatgagaaggacttgtttatgtatttttaaaaaaatattgactggaaatgcagctgttactgaatacctactatgtatttatgggcagagggaagaacaaggcacctgaacatttctttcacttagttggatgatgtttctgccctccctccttctcaacatcagcatctgtggcttctcaaggcattggtcatccacaggacacggggttataaatttacacattgatgagaaagtttatttcagaatttctcaggtaattctgattcagtagcccattctcccaacccagttgaaaatcatcaatttttatttcatgaggcgatgagggtgtaggtatgtatatgaagttgccatcattagcccatcaccattatatgaattagttgaaatgactattggaacttcagtcccagaagtagacatttgggacaaatctgaagctcaggacattgagcctagatgggtgtcactatttagtatctttagctagggaacaatataagagttccagatttcttggagatcggagttagagggaggtactgaaaggaagctaagcaaaggagaacaaggaaacactgaaggttaactgtgctgacctcataattttgtctagagtcagctcaaataagttgacataaccacattttccagggcaaaatctagtgttttcttgaagcccaaacttgtacaagtaagttattgttctttagaaaaaaggagataaagagtagaatttgtgtaatggtttattaggcttcagaaaccttccggaggcatcctggcaagttctcctgaaaaggaaaggtattcaaaggtgctgtgttgatccctcaaaacagaagttcccaacagtttttcttgctgtcactcaaggaatgttgacattgacgatcacagtggtcttctgtgatagtgttgatcacattccaaaaattctatccctttgccttttagggaagtactagtgatattatcataggaatggttttggatatatcctaacttgagttattgttagtaacaagttaataacacaatgaacttagaaaattgagaacactttcctgtatatttagacatttattgctttcataattaatttatctgacaaataatatcaagaaggttgtgtttctgaaaacaaccttatagatctttagcaagcaacatttttcatttatatgtggaatgctctttgcagttgtccatcaatgtttggtttgattctcgccattataattcttcataagctcagagaagacatctctagtgctatatgaaatataaatgattcctagtaagtggatgggaatttagactgtcatcttaatttaataacatatatacccatatttacagtataaatagaaatgaggctacattaagaacttactaacattaaatttatgtatgtgttcacttgagacacttccctggaacttaaggtggtgtctgaattgtaaaaatgtgtcattcaaattgtaactagccagaattttatggttctaggttccccagtggttttcctggtattaaaaggtatgcttgcttttacattgtctggaaatatggaaggtgaaagtagacttacttagatgcttttgaatatatatatatatatgcagatatttcctgctaaggcaatcttgattttctgtccttagggaatatttattagcaattaattatttagggtaacttctctgaattactttattaagtaaggtcatgggtttccatgaaaagttgtattatgcaaagtattcactgatgtagaaactctattaagaaatgataaatatgaaattgaaacaaccgtataaaatatatggagttgatctccctttatattgaccatattaagccaagagaaaatcgcctttaaaatttttttttatgtatttagagtgtacaagtgcagatgcatttcttacatgcatatattgtgtggtggtaaagccgaggcttttagtgtaccaaatgtgatcattatacctaaaaggtaatttttcaactctcacctccctcccaccctcccactttttggagtctccagtgggatacctattatcccactcttatttttttttttttttgaaatggaatttcactcttatcgctcagacgggagggcaatggcgcgatattggctcactgcaacctctgcttcccgggttcaagcgattctcctgcctcagcctcccaagtagctgggattacaggtgcccgccatcacacccagctaatttttatacttttagtagagacggcgtttcaccacgttggccaggctggtctcgaactcctgacctcaggtgatccgccctccttggcctcccaaagtgctgggattacagggcatgagccactgtaccagcctatcccattcgttacatgtgtacccattatttagctcctacttataaatgagaacatgcagtatttgactttctgtttctaaggtatttcacttaggataatagcctccagttccatccgggttgctgcaaaatacatgatttgattgtttttaatggctgggtggtattccatggtgtgtgtgtgtgtgtgtgtgtgtgtgtgtgtgtgtgtgtatatatgtatatatatatgtgtatatatatgtatatgtgtgtatatatatgtgtatatatatgtatacgtgtgtatatatatgtgtatatatatgtatacatgtatacacacacacacacacacacatatatatatgccattttctttagtcgtctgttgatggatacttagtttgattccttgtgttgctgttgtgaatagtgctgcaataaactaggagtgcaggtatctttttgatataagaaggaaatctccgttaaatgcatatctttcgttctcaattaatgcatcaatataattatatgtaaagaatttgctaatataagtcacaggctgttcaaatttgtctttgggagcccttccagaggcctcaacttttagtgaaactgctttatggggtgggttccattttgtcacatggcacttactaaatgctttctgaagaatctgatcattttttgggggattgtattcttatggtgctctagtgtacttttggatttttccccaaggtgatctctagtcttttcctctcagtcagctagtgtttgtggacctttttcttactaaaataatattcattcttttattcagtgaacattgatgctaggcactgttatatgaatgggatacaaaggtgaataaggcactttttctactcgtgtgtgttcacgggctttcttgtgctccaaccgctatagataactccgcctctttaaccccttctcttcccttttggttgtcttgaatcctgctttttaccccttcactccaaagctgaatagccttggtagagttccaaatttaaaaaaaaaattttttttttttgagacagagtctcgctctattgcccaggctggagtgcggtggtgcagtctcagctcactgcaacctccacctcccaggttcaaacaattcttctgcctcagcctcctagtagctgggactacaggagcatgccaccacacccggctaatttttgtatttttagtggagacggggtttcaccatattggccaggctggtcttgaactcctaacctcatgatccgcccgcttcagcctcccaaagttctcggattataggcgtgagccaccgcacccagccaaaaaattttaatttttgtatttagctgggcatggtggttcacatctgtagtcccagctacttgggaggctgagacagggttttgccatgttggccaggctggtcttgaactcctgggctcaagtgatcagcccgcctcaccgtccgaaagtgccgagattacaggcatgagccactgtgcctggcctgacgatatatttgaaagttctgccccattctgaatcacgaacttaagaaatagctactcagtattctaatagagatcattattatacgtacccttctagtctttttacaaacacatacacatccatctaattgtcttaaaatagttttcttaaaaaacaggatcttgtaaaacatactgctttgtaacttccccccatgtggtagtagtatattttaaagatctttccaagtaaatatacacaacattgtattccactgtggatgtattagaatttgaattgccaaatgcctattgttgaatagttaggctgtttccagtttcctcattatgaatttctttgtatacttgatattatttatgtggaataatttccaaagagtggaatttgtgtattaaaggatatgtataatttagaggcaattgatgatatgtattgcctaattgtcctacaggaaaattattattttagaaaagtatattaattgaagtgccaatttatactctaataccatattataattaaaaaactatcattttgttggatgaaaaaaagatcttgttttaatttaaaaaaatactagagaggttaaactttcccttatagggttatgggtcattaatatttattttgtacattttctatttgtgttcttttacaatttttgttctgttgggctgttgaacttttaattattgacttgatggagctatttcattttttagagacagggcctcactctgtcacccaggctggaggcagtggcgtgatcatagctcactggagccttgaactcctgggcccaagtgatcttccttcctagctgtgcagagcactgggtttacagaattgagccactgcatctggcctgatggaactatttctatattaaggctatcaatccattgttgcccgtataccaatcatattttcttcatttgttacttgcctttttactttccttttactttatttatggtacattttgctgtactcatgtttattagtaagtgccattattggtcttggctcatcatggttattgtctcttttctcattctatgattaaataaatatgcacttacatatttaattttttactgcagtttttattcatacagaatgagtgaatttgaatatatggcatgagacgggtttatttttatgaattgttgtctgtctagtagttgcttgggaattactgaattattgaattactttgtctttttctcactactatgagaaattattgtatactaaattcttaaaggtatatccatttctgaacttagtattttttctattttttttttattctgctgtgttggccatctattcatgtactagcagcacactgttgaaatcattatagttttgtcatgctttttttttttttttttttttttttgagacaggagtctcgctctgccgcccaggctggagtgcagtggtgcaatcttggctcactgcaacttctgcctcccaggttcaaaaaattctcgtgcctcagcctcccaggtagctgggattacaggtgtgagtcccgtgcctggctaattattttgtatttttagtagagatggggtttcaccaggttggccaggctgttctcgaactcccgggctcaagtgacccgcccgcctcagcctcccaaagtgctgggattacaggagtgagccatgtcttgctttaaataaacgcccggccttgtcatgctttaaataaactttaggctgctgggcactggtttatgcctataatcccaacattttggaaggccgaggcaggaggattgctcgaggccaggagtttgagagcagcctgggcaacgtagtgaaactaaacctctacaaaaaaaaatttaaattagtctggtatggtgatatgcacctgtagtcccagctactccagaggctaaaggaggatcgctagagcccatgaggtcaaggctgcagtgagctatgttcacaccactgtattcccgcccaagcaatagagcaagaccctgtctcaaacaaacacacatgcttacatacatacatacattaggctaaatcttgtcacactttattttcaaagtgtttcctggttattttcatttttatttcagattaacttttaaaacatttgtaaaattctagaaaaaaatctactggtattttgtttgtaatgatttgagtacacacacaataggggttgaatggacacccgactatgttaacttttttagatggtttagtacaaaaaactaagggcctactatgtgcaagatgcttatgtttagacaccggagatacagcattgaaaagataaggcatcctggatcgcaaaggttatttagaagtggaattgacagaatattgggatggactgtagccagaggaagtcttaggatgattgtggtattttggcttggttagctcagtggaaaataatgctatgcccagagattgaaatataggaggaggcacacatttccaaaggactatgttaggtttggttccacatataactatcaatgggatatccagctagagttgttaagaaagcagtgagacctcttggtctggccctcaggaaagtatccttccttggagatatggacacctggcagaatttgttgcatgagatgtgaaggcctgtgtcagacgccagacaggttgaagccagttcagaagatgaggagatgaggaagggccagggtccaagagaattccattgcactcctagagatagctaggagaaggatgccactgcagaagaagaatgagaagtggctaaacagatcaaagggcacccagaggacaggtaagataaagactgaaaggtatgttttgggttaaccacaaaagagttggtcttttcaccggggtggtttaggtggaacagtagtgatagaagccccattgcagtgggaatgaggttgaaatatgagaaagtgatttcattattatcgtcagttgttattttattctttctattactgaagaaacttcggaaccccttctaaagagaataaggagtccaattgttttgctctacctgtaccttcaaatctatatttttaaataggaaatttcttatatatccactgtttactcatactaagtacttggcaatgtgatacgttctgggactgagttgatatgataagaattgatatgtccccatttccttatgggacactactctctggcaggaggtgttagacaaataattatacaattatatacaacagttgtggtaagctctacaaaaacagattaggtagtacgatattgcttataatacagtgggtaggataggggagaggtcaaggacgccttccttgagtaagtgaatttgagctgagatggattttctagggagagggaaaggccctgaggtgagatgaagtttgcagctgattaaaccaatgaggcatgagatgagataagagaggcccatattaaatctatctaggttgttggtcatttgaaggtttggattttatactaagagttatggtaaaccattgaaacactttaaataggggaatgacttgatcggatcattagaatgtaaagttcttgagtgtagtgatttttaagaatttttgttcactgacctgtccatagtgtttaacagtacctagcacattttatatagctcagtaaatatttttgaatgaatgctttttttaaaaaaaatgagtgaaacatttggttttacaagaagttttcatctgttgtttcatgtaaacagattgcagtgtggtgtgagaggttgtaaagtccaagtggaagatagtggtggcttgtatgctagtggtggcagtggaaatggagaggcacatggaggaggcagaataatttgatagtggcaagtgtgggagacgaagctacttgggatattttatacacgaacagcacagtaccattgatgaagttgaacttatcctgtcctttttccaaatacttcttccagctgggttttggcattggtttttaacatcaccatgcacctctcggttcctacttattcgagggcatcttactgagctgtgttaacttgagcaatacttctgaaatatctcctgaattttccccttttctccagtcttacagccatttccatactgaatgcctgtgttctatcttgcctagactattgctatccagtactcctgccctgttgccacttttatcctattcatactgtgctctcagatacactatagaaatgaacatctcatttggctgcctaaaatctcagtgccttttcattgcctataatgtaaagactaaactaacagtactttttttccccctagagtacattcaattaaaatcaagaaatgttcatttaaactcctgctgtttgcttgtctacgatttagccacaggtacataccctgggcaccttcctgattgtctctcttgatttgctaattactatctggatgatcataactgactctactgagtgtctgtgctaccgtttttctgcagcagctctctgaaccttctctataaccttctttatccttgtcaaataagacaaatgttattagagtaataattgtcagttctttagatgataaaaggtttggatcactaatgacttgtttttgttttttgtttgtttttttttactttccagaatgaactacagtttgacaacaaaatgttaacatacatgcttatgttcagttttggggcccttgtgataacatgcatctttctcttctctttggacaaggaggagtgacttctgttatttgggcaacttagttttccttcctaagtattgttaaccttaagtagacatttgctatttgcctgtgccaggggctttaaacttttctttgttaaacaaggacccttatttttaaatgagatcttaaatagaacaccagggtgtaagtcagattaacctggaactagcctatttgaagtgtattgacttcacctatttgaagctatttgaagtgaagtcgttagatcccaggctgccacttaatatccatttggtaccttaggtacctccaagaagtggtgattagaataagaagcaagagtcactggaataaaggtggtaacagctgtgggagggatgacatttctgaaggacttagacatacaagtaatgcctggcatccaccagtattccaatgacagcagatctttccttacttcatgaaatgagtattatttttctgtccagaaccaccatttgctctattgaactgtcttaaggatttgtttcaaacagctaagttatttgattaaaatagtgataaaattgaaaaaaaaaaaaaaagaattactaatatgtctctagctgttttggcagaaactaacctttcttccttcctttcatccatccctccctcccctcctccctcccttctttccctccttccttcccacccccccccccatttattccatccgtctgtccatctgtccgtccatccaatgcctactatttcaggcacttttctaaatgctacagagctaacaaaacagagaaaaatctctgttcacgaagctgacattatggatggggacacattcaaaaataagataaatgtgccatgcatagctagccggataagtgctatagaggaagggaaggggaattcctgttgtccctgtatggagatgagccaaacatttttttgaaattagttttccaaaaatagtaatcgattgccatagatttatctcattctcttacctggtttccctcttaatccaagttcactcccattaaagaccatagggatgtgctgcagtcatctctgattctgggccagctgctgactggctcatcccaggactgtgagcctgtggccttgtcctcactggcatggtcaccttgatgtttactgatcacctgaactgagaatgtcttgtgccggcacttcttcagagctcatagcttacatatctttgggcttcagacttgtttttcctatctcatcatcatcaaatgtagaaacccagcatataaagcaactgaaaggtctgaatggcagcggaagatgtttaggatgaggctccagacaatcctcctgctccccatccctttgggctgccttgtcacctccatggacttctgccacagagctgttatttctagggtaacatttcagagtcattgttctaggatgccattgtccttttctgatgacagaagtgttttataactgagctttctaacatagtaaccatcaggcacatgtaaatttgagtatgcagctagtgtgactgagaaacgaaattttaaattttatttaatcttaattaaaatttaaatagtcacatgtggctagtggctactgtattggaagatgctttttttgtttgtttgtttttctttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacagggtttcaccgtgtcagccaggatggtctcgatctcctgacctcgtgatccgcccgtctcggcctcccaaagtgctgggattacaggcgtgagccaccgcgcccggccgtttgtttgtttttgagactgggtctcgctctcttgcccaggctggagtgcagtggcacgatcttggctaactgcaagctccacctcacgggtttacgccattctcctgcctcaacctcctgagtagcttggactacaggcgcccgccaccaggccaggctaattttttcatatttttcgtagagacggggtttcactgtgttagccaggatggtctcaatctcctgacctcgtgatccgcctgcctcagcctcccaaagtactgggattacaggcatgagccactgtgcccagccggaagatgcagttttaatgtaatgctagctacagatttaacgtttactgagtgcagttcatatcccagttttccagatcatgaataaaatgacagtagttttagaggataatgaactttgagaaggcatggattaagacctgacttaaaaccttgggcaaatttttcaatccctctgagcctcagttccttttttataaagtgggcaaatttatagtaccttttcatagagaggtttaaagtgagataaaccatgcccaacatttggcacaatgcctaagcctgattgtagctgatttatcctaatagggttttgttgttgttgttgtttattggggcatttctttggcttgtaaaatgtaaaatatgcccattatagaacagagaaaaataagaaaataaacataacctgtaccaccatccacagacaaaacaacagaaaacttgtagaatgtagaaaaaagtatgtctttggttcacaatatgcttttctctttgttttgaatgtgtacatgtatgactacactgacactactattgtaaaacagtttttagaggccatagatcatatgtgtataaattgccttacaaactttttttctaatatcatatactaaaaagtctcaggaaatatgtggttactgagagttgttagaaaactggtgaattgaataatccagtagtatttttctagatttatctttagtgattaatttttccagaatataaaaattcttttggaattctttttggatgatgagaggaaaaaagagatacatagatgatttcatcttgagttaaagctgtgtgtcagatactgctaagtgctgggactataaaaacaaataaaatgtcatcattgctcttaagtaaattgtggtctaaatactgtgtgatcagtgctgcaggagggatctagacagtctaatatgagaacttgggacaaacccggccagctggggatagaaaggttgtcagcaaaaggtttctggctgaagtgacacctgaaggaagttttaaaggaatgatggacttaattaggcggtgatggggtgaagagtattcaaggaaagggatgcagtgagtatgaaagccagagtgaccatgggcatttggagaactgcagctgtctagtatggaggtcagaggtggggatggggtggatggcagaaatgaagatgtgtctggagcagctgcaggaaccagatgggtcacaaaggtctttctatgtcctgttaaggagcacagactttaaggttataagagatgtttaaagattacaagaggagagaggcaggatctctggtcacaccattggcatacatagaaaaataactggatgtggtttggagaatgtatcagagacgggtgggagtccattcaatgacttgttgaataggtcaggcaagagatggtagatgattcaggttgtagaaatgagtagccctctggaagtttgggtctagaatttgggagggatattgactagagttattctcatactggccacggagtgaataaagtcaccctttccggagtgcttaccatgtatcaggcatttgaccaagaatgcaatacacattatttgagtttattcccacaatacaggggttgcaaaacatggccagttttacatagaggatggcaaattccagtcctgtctctgaagcccaatgataacacaaatgaaatcactaaggaagagtataaagtgaaaatttgaaaagggtctaagaaggaacttaggggaaaatgtcagtagttatcacagagcaggaaaaagaggagcccttaagagactgaaaaggagaagcgaggaaagccagagaaagagagtattagactcatggaattctggggatgcaaatggttcaaggaggaagtggggaagtgtcagatgctacagagatgtcagataaagtagtgtacatgtttcttggattaagaataaagagacaattgagaagaatttcagtggagtttaggaggatatcttgatgctacatgccagggttgctttttttttttttttttttttttttttgagttggggtttcactctgttaccccagtggcaggatcttggctcactgcagcctctgcctcccaggctcaagagattttcctgcctcaacctcctgcgtagcaggaactacaggcatgtgccaccatgcctggctaatttttgtattttttgtagagacagggctttaccatgttggccagggtggtcttgaactccagtactcaagtggtccacccacctcaacctcacaaaatgctggaattacaggcgtgagctaccgcactccaccttgcatgccagggttattttatcagcatttcttggttttggtgaaaatcagctcaatctcggttttaggcaaagtagggattgtttgactaggaatctgtagaaggtttggaagacccaaattgtaggaattttacagatatgacaagtccctcgtattcactagaatgagggactttatttactactaccatgataatctctcattacttctctttgcttttttctgcctgttagttgctggcttttgtgctgtagacctgctttctagatgtggagggtagtagatggtgcagttttctaccctcaactctaaatataaagatcttggagaaggactgatactgcctatcttggactaggtgctatgtctgggcctgttggtgtcttgggtacaagttcatgaaagaacatggtagttcccaaggtagttatgagattagagggaatggcagtttccagcatgggaagagaaatgtttagacagacagtcttataggtttctgctcctagtgcatggaagatggagtgggaaatgaagaaccagagaaagtgactatagattctcttttaagagcctgggctatgaaagaaaatcctagtgattgttttggtgacaactaaagagggagaattggactttagaatgcttattttataactaaatcattgatgaggagtgaaaatgtatctgaaaagaggaggtagacattaattttaatgtttatgggagaaaaatggacatgcagacattcttgtggacatggaaatttatgtgaacagaagaaggctagttatgatcatcactttcaaagtgattgtatttgtggtcacttcattatcaaatatatgttttcagggtggtcatctttgtgtttgtaatgatcataagccatatctatagaaagaaaccagagaatattagtatttgcaaaagatctttagaaagaatacaacctaatatgcttaattcatagataagaaaagtagaattcaaaaaagtgaagggaagtaattacttacagataaaatagtgcctattagaagagaagggactatttgctccctgggtccctgtttagaaagtgaggatgtctttctcacaacctcttcagtagacctcctttcatggcccattgtccagaatcgaatcacatcacccacctctgaagcctgctattgagaaagaaactgtgataatctgactaatgtgcaacaaggagaatttgcccccaaagattgtgggaagaggaagagtacctgaacaaagtcagggctctccagcaaggaagaaagcaacaagcattgctaagaactcaacagtgtttgcaacatggactaagctaaagaggttatattttattccatggacaatgggactctcctgaaggttttagatcagagaataggtaagatcctatttgtgtttcagcaaaaatgctattcataaaacatctatggtcttagtccatttgtgctgctatatcagtaccttagactgggtagtttaaacaagataaatttatttctcatacttctggaggctgggaaatgcaaaatcaaggtactgacaggttgggtaagggcctggtctttgctctcaagatggcagcttgttgctagaatagtgcctttttacatggcagaagagatggaagggcaaaagtggcctccttagctctctccaacccatttgtaagagaccgatcccatccatgatggtagagcccttatgggctgagtgcctcccaaaggccccagttcttaatattatcacattggtgattaagtttcaacacatgaattttgggaaacattcagatcacggcacctgtgataagacatgaggtgagacgtcattctatataagttagttgcaaagttgaactaaatttcaggtctccagcatcttcccattgttatctacattctatcctctctctgtgtatactgttgatggtgtgtgtttgtcttttaccatgaaatttgatatctttgaacggataataatatagggaatggatttctaatagttagaaatgtaactatccacaattatattactacatatttattaagaatcctcctcaggaggaattttaaaaaatatcgccatcaagtgcttaccatttgcattggttggaatgtttgggtgtataatatatacatgtgtccatcatacagaagggctgtgataaatgttaaaagaaaggcagaggtaatgtgatatggctgttgctcggggcagttgagggaagctgaaagaggatgtgtgatctacagtgagcagtgaagaatgtgcaagtgggacgggtcattctagatgagggaaacagcaagtaaaagaaaggcagaaaagccagggagtaccaaggtggctggtatttgatagagcctaggattgagagaaaagtcaggaatggatcatggagttgaagacacaagagaatgaagctcacacctgctggtacctaatataagtaggcacagtgctagggtttaaaacgtgcaatctcattcaatttcaccacattcctatgagggacagaggatcatttttgcatttttttctgatgagggactgaggctcgggaaaactaacttgcttgagaactcactactaatggtggagagagtcaacatttgaagccagtctgccttaggaagttattctgttatgccaagtatcccactgtgtcatttcatgattcttagcatcttagtgtttgactttcattctcgggcattgcagaagggttctgagcaggaatgggcattaccacagtgctcatcagggaagggtggaggctggatggagggcagaagcgaccagcaccattgttctggtccatggatagtctcctgtaacatctgacacccagacattggagtcactacatagcatcattttcagaactgtatttgccatcttttccagtgaaataaaaattaaagttctatacccaccttgatgcctctctagcttccttcttctttcctgtttcctgttacaggacttgcatttcactttggcttatcctctctagtacataccttctagcttagccaacacttattcaaatatgactaactcagactaactactagttgtccaagaagttcctcctaatccataacatctctgagacttcgataattgacctgataaactgatagaaaaagatgtaccacctaccaatacttgaactccctttttgttgttgttgttgttgttttatactggtcctctctagaatgctatgtaaacaaggaaaatgcagaatacctactttttgtaccttagaaacacatctggtgctatttgaactaactaaaagtaaagtaagtgccatggcagattatgccataccttttctttttattgaaaaaaaaaaaaaaaaaggaaatgggaaacataccacttctagaaggccctgacactgaactggatattgaaatcatataggtaatgtattaatatatgccacatttgttttccatgcatcaaccatctttggtacatatgtgttggatatttgccatgtgagagaaacgttacacagagggaagatcgtcttgtttagaagtagtatgaatcgctaaggtagaagtaaagtcagcccttttttattttacttacctttgctacatgatctgatggaggttttttcttttgcttttttcttttgacttttaatcattttgtgtcagtctttgagtatatgtcagaactcccctattgcaactaaaaaatggaaattacataccaggacactataatttccatgaacttaaaaaattatataagaaatattataacttaatattggttttaccatgtcctctaatttgaaatggagtgaaatgcttctgtggttaaatcagcttgcttgtgctgtttgctataaaagtttcaagaatatatatttcaaaaaaagtttttaaataatccaaaacaaatgcaacagggctcagcatacttgaaacacattttccgcatttatcttaaatctctgtgctccagagagtgttcatgtgtatgtggattaggcctggctggttatttcaccatctatctccatcctggattgattgcactgaacagcacagaatgagttacatatggtcccactttgtctcagtttgtaggacctctgggctggaactccatttgatcagagtgaagctaaccattgcagaaatttggctaatgtaaaaaccctgaatatatgcacatatacatatattctggctagaatgttcatattcctattagaagtagtggtgtttcctatacattgtctctgtagttattgttgacatttcaagaattaaaaaaataatctatggatgatgatgttgctgttctggataggagtcgttacaagtgtggaccaagacaatattcagatgttttcaaatcaaaattatgaatataccaaaaactttctaaaattgggaagaagataggaatacaaagattatcttaaatacaaacttaaaattgaggaggaaacttattgtcaaatttatagtttattttttttagggtggtctattttaggaaagaaaaatagccttcaaatatgtttaagtttagatattgctccttaactctataaacttgagtcaggtagggggctgtgcacattaaggtccagcttgtagacactgagggtaaaggaagctgttgagggtaacttactcccccatcaggctcttgtctctctattttgttctttttcctcctcttctttttcctcctattgctttatttatttttttgttactcccacttcccctccccctcctgctcttcctttctctgtctgtgcaaccacgtgcttcaaatctgtgtatctggactgccttctctaacagttccgtgtgagtgttagcagaatgaaaaccagatggaccagcagttcccactgttatctcccagccgactctggcaagcctccctttttccctccctccttggcatgacagaaatatttgcctttatttagggagacttgtatttgctgctgtacctcttccctcagctgcaacataagtgggaagctatttattcccttgttgctgaggttggttgaggtgagtagaatgtgcaaatgaatttaactgttgaagaagcggttttaagcctgcctaacttctgtatttttctagaataagtgacttactggttgtagcaatctgaagacaagtttttaacaatagataaaggtgaaaatgctcttcatgtgtgtctctaccatcctttcactcagaacacttttattcactatagggacatccgttgttattcagccagaagtatagattcagaaatggagaccctgatattgctgttaactcatcaataataataataacagcttattgtgcaaatactcttattagaatgatgattattttcattctcttattgcatcttccctaaagtgatatcaacattatttcaacttttaaatgttgtgttttattgcaacccaagtgttaagcaattgctttgaacaaaagtgaggtagatttggaattgttatagtagtaatttgggtttttctttttctttcaataattgacctttaagtgattttgagattttctcactgtggttattataacatttttaaaggcttgttctttcttaatagttacttcacttttctaaaagcccaagtgtgagatatttgtgtctataactgcaagaggtgcctcaaaatacgttgggtgtgtgtgtgttcatgtgcgtgcctacacatttgtgaaagaattagatctaaagaaccaaaaatagagactctgatactgctgttgactagctcatcgtgcaaatgctcttatttgaatgatgattatttttattcttttattgcagcttccttaaaatgataccaaaattatttcaacttttaaatgtttattataaccaaagtgttaagaaattgctttgaacagatcaaaaggtctgttgctttgataagtagattagattgagaaaaacagttcagaatgtcaagggaaaagtatacttacagcagttctgaagtatgaatgtccattattgggtaatcaggaaatttcttcatatctgccacatactcatgaaaaaaatattagcagtgtctagttctttttagttctctgtttgggacttttacattcttaactctgtttgagattattaattggagtattggtttcatgcttttaaaatggcaggtcataaatttacaccttttaagtaaataatagtttcacttcattgtataacacatttcacctatgtagcagtgatttttaaaacagggcaggaaaaattgaaatgcgaaatatgcctggaagacgataacctatttcatctaataggccagaaaactaaggacagcacagggatggcaggtgtaagagaaaatcattacaaagagctggctcctaccagtatctcacctgcataacagacttcaggtttttgttatttctgagctgtcatgaggggttcattatcatcccacttcctcatctattttctacctcttgctaacattggcttcagcttccagtgcagttgtgctgctgcatataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgtgtaagtagtcatttcaggcttttgagtttcagttttaaagtttaaattaaatttttttctgcaaatgaaaaatcaagggaaaataaaattcagcatcaatgtattatgcagaaatgaaccaaaaaaaatcatttgtttgccagtaagtaggtactgagcacagaagtatcatagcttaggtctaatttgtgtgactgccaatatttgccttccttttcattattgcttcgaagttgcagtctgctatgattttagcaaatgaagcagcatttggtctgtaattccagttgttaccactgtaacttctaattcatcttaatgtggagctctttattttagtttgttcagcatgacttggaacatggaaatgtgctattattatttctaggttacttcttctaacaccattttcatctatttcaagtggttacaaataatgttaaaatataatatccttgtgttaaaaagggtattgatatgcaacaatatcatacagaaaactttctgaagtgagaagtgcctttcttgcccttttttttgggtggagggggaggacagaatctcgctctgtcacccaggctggagtgcagtggcacgatctcagctcactgcaacctctgcctcccaagttcaagcgattctcctgcctcagcctcctgagtagctgggattacagtcatgcgccactgagcccagctaattttcatatttttagtagatacggggtttcaccatgttggtcaggctggtcttgaacttccgacctcgtgatgctcccacctcggcctcccaaagtgctgggattacaggcgtgagccaccgcacccggtcgtgtctttcttgtcttgaacctgtcagactcttattaaaactttactccattcctgcttggctcaagttctgagttctctcaatagagtgtattgctttcagtacagtccaaaggaaaggatagagaattctgacagaattgcaacttcccattctttcctgtgtatttcattagggatagtgagtaactgttttaataaatctcaaagtcctggttgaaattgtcatcaaggaattgtgaaactaataaatgttatcggttgcagctattttgcacaccatgtgccatgaaatccatatgaatgaaaaataactaaaaggcaaaagtagatctttgggactataagggattagcaaagtacgcatctcaggctgtttatgcagtgttgcactgccatttaaaagacctttccaaatgtgtaaggagcaggtgactgtgcaatgccaagttgtaaccgtgtcatcttatatttggtttgttgttacccaaagccacaggggtaagcatatgtctcctgtgagatgtcctggtgagctggcatttcttgacaggttattatgatactcagttgtgacaagagaaccattttattatgtcaaaattgaacttttaagcataacatggtctttaaaacattttcaaactatatcaaaattatattaaaaagatgggtttgataaaggtctgcttatcaaattaattgacttaacatgataaaatcaacattttctttaatgcaaacgatgcagatttttaattctagttcttatggattatcaactttttgctttctttttatgtacttattaatgtacatattaatgggttacagagtgacagggattatcgtcttgatgttcaaacaaattttatcagaaatgaatttactgaattatcaccactccatgctcttggctggatttaggtgtccctttttgatttcttgaagtaactccttgttaaacaccatatccattttggctttgtacataaaatatgcatttttcctaaagaagtggttaagaagtatgagggggagaaaatagccttctaattgggtggtggaaggttaaaacttgaaagtcctattcctataaacacagctgtcagttgtgtgtacaaaacatgattaaaaatgttcaatgataaatttagtctccaccaaatgtacactttctctaggggagcagtttggaaaggaatagtcctgttatattgatgtaagcctgcgacaaaaagctgacatccgaagctgtctgttctatttttgaaacatttcaggtggttggcatatgtgcacatgggaggcagggctggccctgggttgcagcagactccatttattgtcagcctctgtgcaggataccatcactcagtatgaggagtagacccatttagttatagagtacctgagaatgtagtaaccctgtgaagtccaagcatttttaaaaagtcccaacatttaaaaacttataaaactagtagatgtaaaaggtaggaaacttggtggcaatttcctcatgcatgttctctgtaagtttatgacttccttctgattttgtgctcttgacagtaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtggtaagcaaatggaaaccaacccagttttcttggtgtaagggatagtgtgggtgggagactcagacatgtagacaccgttctcgcaagtattttgttataatagtttctacatctgaagattgtgtgcaagtctgattcatgctatagtgacagtcttttaaattctgcattatatattgaccccaccagagttttttttctcactgtttgactaataaagatatggttatacaaatttattgttatattggccataaacatgttatatatataaatgtgtgtgtgtgtgtgtgtgtatgtgcacgtgtatttcagtatttcagtaagtacactttcctggcatgcctagtggttttcaatgatgacaaaatggttttgttatgttgagtcactcaatctaattggatgctcattttaatttcattgctttagcggatttttatcattggcccagatgaacaagaatttgtaacaacacattcttcttttatctagtgtcatttttaagatgaataacattgaaattttttattgtggtaaaatatacatacagttcatcattttaaccatttttaagtgtacagtttggtggcattatgtatattcacattgctgtatagccaccaccactgtccatctccagaactttttcatcacctcaatccgaaaccttctgtattcataaaacagtaactcctcatctcttttatccccagctcctggtaaacactaattcttttttgttaaaaaaaataaatctttgttataggtagaattaccgaaaccactagtttgagaagagaactgttggtttttgcatattacactacgttctgcacattgtcacactagaaaatagaacatatatctttttttgcgttctaagtcacttttccatgtgttgtgattttctgtagaagtggaggattttcgagtatttaggaaggctagtctcccatatcaaactgagtcacggagaagctatgaatcgtatatgcagttctttcattgtccagggttatggtcgtctccactttcttgaaatagattatttatttttattatatggacctatcaggggcaaagccataccagttgtgttttgcaaaagaagtttcagaattagaagtctgggtaagagactagctcagaagacatgcttcaaatcactatatcccacatttgacagagattttgcaatttaatttttaaccattaactgcctctcctccctactccaagaacaaaagacttccatgtttctcacagtccatcagctccacctcataaacttccaagacaggaaggtgattttcacaaaaggtgtgttggcatacttcagatacttttgtcagtcacttatcttttcctttttattcattcttgaatttgcataataagcttttttaacatgtaaataagttagaccaaggaaccacaaagtaaatccaaagtaataattgtatcaagtaaatggtgaatgtgttgttcttagcaaaattttttttttttgaaaattgccttataaatttgacatgttctttattaacagtggttccataattgaaaatgcagaaaaacttggtagctttaagtagatttttcccaagtggcatacttttgtgtgaaatacttttaaaaaatatattttttaaaatctaaaagcctagagaggaaaataggggaggacattaattcattataacttgcatataataggcagtaaatattcattgagtagcagacttctgttaaacatttggcttacaagccattttacataattctcaggactaccatttgagagagtgatttttttttttttttgagggagtgatttttatacacatttgacacatgggcaaactgaggttatagaggttaagtaaaatatgcaaggccacccaactggtagtgacagatttgaacctaggtactaaatcatgctgatgcttaggtggagttaagaaaatgttaggaagtactgtcttttttgttttttcttttaaacatttttttttagtaatttttttgagacagggtctttctctgtcacccatacccgttctctgtcacccaatgcattcgcatcggtgccagcaaggctcaccgcagccttgaccttccaagcataagcaatcctcccttcccagcctcccctgaaactagaggcacacaccaccacacctggctaatttttttgtgacatcatctcactttgatgctctggctggtctcaaactcctgggctcaagtgacactcccaccttggcctcccaaagctactgggattacaggcgtgagccactgcactggaccggaagtactgtccttttgaaaaggagtcatagaaacaaaatgatagattttaaaaaattggctccttgacatttattgttacacataggaagttattgtttattcatagtttcatatgaagatgttttgagtgtgggggtatgaagaacttagaacttggtgctcgtgtactttgttataaaaggaaacatgcacaaaaaagtgggtggagcaatattgtaatgacgttaggtcacaaattcccaaattttgtcagtcatcagaattattgaagggactgaagaagttgagaatgagttgtgatcctgcctgagaaactaaagaaaacgaatgaaatgagggttaatttactcaatgcctttataattgctttgttgttcattaagtagatgcttttaccaacacacattatctattgtaggatacaaatcctgagtatttggggcttgtttttttatataaggtaggttagaagtgaatctgagttaattttgcttagtcttgtttgggtcaagcagttgcctctaggataagtggaatgtcttcgataattgggatttttctttcaccttctacaaaactcattgactcacagaagggtcaaaccttttctttggctttattggcatagcacactacccaactttgatgttcaccctgagcaaagatgctttggcagacaaagaaagaatacaagatggaaatacaggaggaggagaagaatatttccaccagcagtagtgctgatgtgacacgtgggataaatcttgactgagaattctgacacttgccctcggtcctttaagtgatctgttatgcttttaaatacatccaagtgtgtttgttttccataaaggcaatattagaagattcttcataattgcaaagacttctctgataattaaaccatgctagtgatcatgcacattatcctcaaagtactatacataatgtgtttcattttcagatgtaggttttagaagtgagtgatgcaataaactgtgtgatcatttttacaaagtcaataggttttattgaaaatactggtttctgtcagtatgtttgcttgttattacactgtgttgtaccagtcttaataattaatttgtttgtgtttttactatttaccaacaggctaatgtatttatactacatattttcttccatagaactccactttgacaattgaagaatttcattccaaactgcaagaagctactaacttcccactgagaccttttgtcatcccatttttgaaggtattgcacagttcactggtctgtaaagtattttaaaccatattgttgctaggtcataactgtgtgcttttttagtacatttaggggctctttgatttaatttaatggatgaaaactatctgaatcgattgtatttatgaccatttcctaagtagtctgaaaattacaaggagtgttttaaataattacctgaaaagaagtaaagtttgaagaagagtttagaagtctctttgaataaaggttttgttcatttttttggtcatatgagatatgttattttacattttgcttgtctttagagtgaacagaagattggttgagctttgtagttgttcaggatttttttatcctcctaattttatctttgtaacaacttaacgggaagatcagaccgtcatccttttgtgccagtgaagaagttgggagtaagtgacatgtccaaggtgtgcctggctgaggactgattgaggtgtgggattcgaaatggtttttaagtctctgctgtgagctttctgtctcctccaactgctgccacttcagtaaagcaactggaaaacaaacaaacacaaagttcacaagagaaagaaggaacatttttattcagcatagcgggtagttaattcactgatggatactaaaataactggtagttttggtagaaaagcagattactaagatcccttttacttgggtaagcatattgcttgggcatagtggattctcaataagtttatactaacagtgggcttagcagattgataaatgtgaaagtttcatttgcactcccctttgaaggtcactttcaaaatgagcactcaaggaagcctctgatttaattatttgccaaggaggatttacctttctgtctggttcctagaactttgtttgggagacaccagaaatataactgatcagatcctgtgtgaaatttcatctatttttaaaactgtatcagacacataaggttcaagtaagtatccagaagcctagaaaggtttgtctgaaatgagccccaattctgaactttctggatattagtctttcctgttgttattattaaggtgaaatgaaatattctgctttgtgagtacctacaaaccagaaattagatctgtttgtgtggaaacccagattacaattatattcttttcgttcttttctaagttgtacatttaaggttaaaggtataatgtgttagtgttttctcccaaaatggcttatactataatactatattcttatttaaaagcaaattgtttgttgaacaatttgaacaagtttgttgagactagaatctttgcctttctcagaaagcgttgttttctgtaaagatttcatcatatgaatgccatttcctgtgcaaataccactggtttctgtgctaaaaaagaaaaaaaaaaaaaagaagaagaagaaagaaaaaataggctcctttcagggtcaagttggcagccaaaaaaaatttaaaaagcttacaaggacacttccagattcttctatcactgctgcacaccatatggttaccatatcatttagttgggatcattggaatcaaagatataacttttttttctaattttagtgcttttcctcaaaggagacattaatgacaaaaaccatatggttgtgggaactcgggccttaataagtgcattcaaacactgctgtaacaatatgcattaaagtcttgttttcattaagctaatgtaacccgcagaccctctattccattttgcatttatggagaaacatttactggaaggatattagacaccattctaattacctaatctggcaccagaattagagcaaacaaaattgctttgtattaccatattttttaaattggaagaagatgtttatggaatcgctaaattaaactgagtaccacgtgtggaagcctcttgtcttgtaccatccatacgtttaaatttgaaactggaggcatgcatgtttcccattagtcactcagctgtgtggcaatgaatgtattaaacatgaggttaggagcctaccaaaacacagataagatgaattctaaagaaaacttcttcagtgaaagcagtcatagatacagcatcttttcttattagtatcttaatttttagacatcaatgaaaaagtttatgctttaaccacacccaatttctatagtctcttttgtgaaaatatatttgcttcatcctgaaactaagaaattgctatctatctataacacatagccaaataaatgtgcattttataacttctctccagaagtactatttaatgtatcttaaaaatcaactcttgtactgaatatattaaggctgtttctggatgggagccagcgaatgctttgccaaaagacatctgcacacaagatgtccagcctgtgagtcaattctcctgattatcattcaggaatttgtctctctgagctggcataactatgtttgcctgcttggttcaatattgctggcattcttaacagaaggaatatgattgttttagaaaggtctctatatgttcagatagagcctttacctgaggtcccagctgactctatttaatacagaatggcacatagtctcgtgtgtgtgtgtgtgtgtgtgtgtgtgtgtgtgtgtgtgtgagagagagagagagagagagatatgtggcacccaaataattctttttgataagaagaatgtgggagacagtattagtaaagtcaagcaacagtcttcacttcccccccgcttcctcatcgttctgaatatcatgctctgctaatagagtcctgaagatactgttttttgtctcctcatttgttactccatttcttgttctaggatttcttatctttgggatccctaaagaaccaagagcagagagctttgcagtgtattgttttggacaatttaaatcttatgcatatacagtcatgtgctacatataatgtttcagacaatgatggactgcatgtacaatggtagtcccataagattataaatcatatttttattgtgtccttttctttttctttctttcttttttttttttttttttttgaaacaaagtctcgctctgttacccaggctggagtgcagtggcacggtcatggctcattggagcctcgacctcttgggttcaaacagtcctctcactttagcctcccaatagcagggactataggcatgggccactgcatccaaccgattttgtattttttgtagagatgaggtttcaccatgttgcccaggctggtctcaaactcctgggcttaagtgacctgcctgccttgacctcctgaagtgtttttctatggtcagagatgtaaatacttgtcattgtgctatagttgcctacagtattcagtacagtacatgctgtacatgtttatagcctaggagccgtagactataccatatattctaggtgtgtagtactaggtttaagtacccgcttttgatgtttgcgtgacgaaatcatgtaacaatgcatctctcagaatgcatccccattgttaatcagtgcatgactgtacttcagaatgattttttttttttttaattagactgagtctcgctctgttgcccaggcaagtgtggtggtataatctcggctcactgcaacctccatctcctggtttcaagctattctcttgcctcagactcccacgtagctgggattacaggtgcgtgccaccacacccagctaattgtttgtgtttttagtaggaatggggtttcaccatgttggccaggctggtcttgaactcctgacctcaagtgatacacccacctcagcctctggaagtgctgggattacaggcgtgagcaagccactacacccagcccaggatgaattttaaaaactttaaaaatgttcacatagaaatgttatttttgctttattattttatgacacaaggtatctaagctctctctttactgaggacaaaaaatagtttaaaaaatatatacaatatattacccacatgttcatctttactaattacaaagagtttaattttagcattgttatcctgtaggaagtcatttccattgttacagtgtatggcatgcatttatctttagcaaatatcctagtattttatatcttgtgtagaaatatgctttggtgtgattatgagatggtttcttgattaatactcttagaaaactgacttgagggcggttggtgggtgaggggagagaaagcattaggacaaatagctaacatatatggggcttaaaacctagataatgggttgataggtgcaacaaacgaccatggcacacatctacttatgtaacaaacctccacactctgcacctgtatcctggaactcacaaaaaaaaaaaaaagttaaaaggagttcttcagagtaaaggaaaatgatataggccagaaacttggctctacataaagaaataaagagcactgaaggaaaaaaaaaatgaatttgaggtacaagtagccagccgtagttcctgtccatgattctctagaaggctattttttaaggctgttgggcccaaaaattgaggcagctgggacctctcctgtattcagaaatgcttttctacctgatgggttaatcggtgtacatggcacctggttcctacaaatgaaatcttcaagttgcaaagagatttatgtgattgatctttcctggaattaagtgtgattggggatgagtgctgttcactcttcccagtatcttctcctttcctctcccttactgcccctccccaaacaataataaaaataagagaaagagaaggcaatgacaatctggatttataatgtcaaagtaagttcagagtaaaatgccttcttaggttttcattttaatgcctttactatgtgtgaaattgcctctttctctcttattacatttgaaattgccagaattaccgatcagcctatcaaccagcccgttctttattcaaggtgctgacctagctgaggaggaagagtgaccagtatacaggatttcttctaacattagaagaaatatgtgtgtgtgtgtgtgtgtgtgtgtgtgtgtgtgtgtgtgtattcattccttagaataagactgatacaaagaaggcagtttacttttgtagactactagaatatactgctttatgcattaattccatctgggatatgtgactgtacccaggccattacttaactattgtctgaacttgatgactatggaaaataatctctatgttcatgtctatatttttaagtgtattttcattaagttagtacttgacaaaagatattttctgggattagcctgcttgacctttgtgagtcaccagatacaaaattgagtgtgtcagggaaactattctgaaattaattggactgtgtatatattttttataccctctatcttccctgtggagaacaaaagttcttatgattggagctaggttctcacataccgtagaacatacattcaagtataaagggaccctaaaaataatgtgccacttgcaatgttatcagtgaagaaataaaagagaggtaaagtgatgtacaagggtcagtcacctcacacttagggcaatctgcgcacatggtagcccagtgctgagaattgtgcctgtggttccagcccatggcatgcatttgacctttgatgtagctgcattgcatactcttctccagtgttcgaaaagcagagtaagtcaacaggacagaagaaaactttcagtccgtcctctcattcctgtcattcccttgcaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacaggtgagagggaggaggagcctggatgaaccatgacctttttcccatacctgtggcatgaggaaacatttcatgtcacaattaaaccgctggcctatgtcattcttgcacaatagcaataagccattgtggccatcttgagaatctggctctggcctgggattttacagagttttgaatctctggcctgggacagtttggcttttgtgtaggttaatcttttctgcttgtagtattaaagcgaaatggtgaagacgaatgatttttctgatttgccaagtaccactgatggctcttagatgcacatcaatattaaaattctcattcattatgtaatttaacccaaccacatattttacttcaatattctgaaattggctgttcctagtttccttaaaatgtgatggtttggaagcttgtctgtatgtatttcttaacacagtacagtagttatttgttttggtttgtatatgaactaagagaaaacttctgggacactagatgaactgagtgaagataagagttatacagtagagacaatagatggtatttttgctgaaaattttacttgttagatactgttctatcagatactgtgctctcataactaagaattctaagaaatgtaaaataaaaccacttctccattaaaccctacagagtaattgttgaataaagcatacacatgaaatttcccatttaccgtagtaaaataatttttatgaatacctcatcctcatctataattatcttctgatataggaatgcaaagtcttattagcatcattttgcatagtgtttttgaaatatggagaattttacaatgaaactatattcaaaaacttatttagcatatactttgctttctttctctgcttatctgttctcttttgctgcatttcatcaggcatgggtataacagcctttgagaggttaacaccctgacacagttatgttccacattcataggagcttaagatctttggagctgctcagagacatctatttgtgactgacttagctatccttaaatgtattagctgctttgcaaatcagaatgttatttaaaagccagccagtttacatactgttattacataatcctctgttaagcagtttttatgctacaatctctgtaattttgttccccttgacatagaacctcttaatagtttaaaattcctaaagcaaacagttaaatattagtccccttttgacgtattgtaggcctaccttcatatatgacctacaaacagagctactttcttattcttgcaaatcatattttgttggtcacatttaagagtaaaatagagcacttagtgctttagcttttaaagggaactgcttaatcctgatgcctgagtggcatgtccacatgatgctgaaaaccaagaggtggctcaacaataggtgatttacatgtgcattcctgtttgacctgaactgatttaccctgcagaaaatgagtatgacatacagatactgagatgttttagctccatggtaaaagaatgaaggagagactcgatggaaaattggaagaaggaaatttatttagggttgttggggtggaggagagtgtaacagggaaagatttagatagctaagataaatgtagagatgatcctgcaggcaaaattgaaaatggacacaacttactctggcattctgaactgctaaataaccataacagggaatatgaaaatctgtttcattcatttctctgtatttccagctattttcccaccagctctttcccagtatttcatatttgaatgtattgtgacttttgactatccttgcacagtcttaaggtaagtgctgggcagtatgttaacactgatatgaaaacttcatcttaaattccacagaggctcagcattcttgttttgatgctctgtcgctgtgcatgcatcagtgtatgcattcagtcaggtagaactctcctaaaaagagtctttggtctgattttccctttggtttttcatggatggttgccagagtcagagttcacatggttaatctttggatggaacattctttatcaaatggggcactgaaatatacattatatctcaaagatggcaaatgggtttccttagagttaggaggaagggtaatgagaatatgttgtgtaaatacatttgtatcttgtgggaatttgatcagagccaagaaaatatgggcctctacagtattttttctttttgcatatattttctgcatcttgtttgcatatgcattttcctcttctctggttatttatctgtatatccagatctactatatgaaattttatagagtatggagctgtctgacagcagagctttttttgttttactgaatgttttgttggtgcatatggtctgacatggatgagcagccacggtgagattttggagtctattaaactggctcattaaaaagatcaatctgtttctgtaataacactgggagccatcagtcactaaaagagggaaaaactgacacctgaggagaaaacacattttggtaatttgttcatgacatgtcatgaacaaaagagcgctctatattttgtttacaactttgggagcttaaattctgtgacgattgctgagttaatgtactaaacagtcatcatgtgtttcagggatgggttttggcaaatttaactttcttcttgtccttaaatatgattgtcactggttatgttttttttctttaaacattattgttatttacagagaaatgagtactctagggaagtctatgaaattgttttttgttttttgttttttgttcctgtatggaacagtgaaatgttttctactttcttttaaatgtagctctggggagtgtctctgaacaagtgttactgattttgtaggtctgtgagagaatattgtagaacccaaagtagaaaaagataatttttattataaaattatgttatttctttcctaaaatattagggaaagtaagtagaaaattctgatttctattctttgttaatatgtaaacgtcatttatagtaaacatttattcttttaccattctgtggtgggagatgctgaagaaaggaatgtgatcgtttgttttggagccatgtaaacgaaatgaacactcttacagatagagagtagaagctaagagccctctttaaaactgctcaccgtggtgactcgtaaagacacaagcacttttgtgtaggaggagggaaaagaactgttagataatgctttctttctttgagactgcagaatggattaaaattattaagatttaaagaaaataattgtgttaggatgattatcattgctgtctttcttttctcagagctttgatatcacagcttttcgatctaatttgccttcagtattgtgttctcacctgttatgctacttttctggtttaggatttttcttgcttaagaaatcaaaccaaataatctttgcttttgtgtgggtaacatggttgttttgtttcccattttgtaccccctactatctcaaatgatggatgttaagtatgaatccccttcttatatgccattattttaatgtaattatgctttacattactctcagtttaacgcttctaaactttcaatgcaaaggccatgtagttggattaatatgtatttcctcctcccccaagggttaaacattattctctaaaaataattggttgaactttagagttatgtaatttgtcagctgggagggatcttatagatacaccaggccccattctttttatgttttttttccttaggcatggtctgcaatgttgcccaagctggtctcaaactcctgggctcatgtgatcctcccaccttggcctcccaaagtgttgagattataggcatgagccaccacaccctgcctttttacatttcataccaaaacaaaaaaatcacacatattttaaatttatggatttgctcatgggatgttatctgtatttttttttttaagacagtgtctcgctatgttgcccaggctggtcttaaactcctgggcccatgtgaacctgctgcctcaggctcctgagtagctaggactacaggtatgcaccaccacacccagctggcccccatctttttattcttgcacaaactaaggcccaaataaattgcctaatgttgcaaagcttcttagtggagaaacaagcatatttgcatacttgaaatcttccagttgcataaaatatgttttaatgtgcagaatttaaataaggaaactcaactaagacttaagcttctcttttttcaccttactttccctcatttattttctatagttgctcaagtgggtagatgccatagtataacattctgaggttttatatatatttttaacgacagaagagccacagctagcctgtgttcctggcttaatgagtcagttagaaaatgctgaaggttggaggatcaaaggcaatcattttaaaatcatgttggttgtatttgtgagatttgttatgacagtacacaccaactaaactgaataggtccatttttttgtttctgtaaaatgaaagagatttcactatttttatctttctaaaagaaaaaatagatacactttacaaggaattgtagggtcagttgtgcaaataagaattaaatttgtataacctgcattcggttttctatgaaaaaaatgtagggattttatgacacatttatttattctagtttgtgttgcatctattatgtattccacagttgcaaggagtgatttttaaaaatattaatcacatcaattgggaggcctttcagtgaaatagcacaaaattacatttatttatttttatttatttattttttttgagatgaagtttcacccttgttgcccaggctggagtgactgatctgggctcactgcaacctccacctcctgggttcaagcaattctcctgtctcagcctcccaagtagagaggtatcagatgcctgccaccatgcccggctaattttttgtatttttaccagagacggggtttcaccatattggccaggccggtctcaaactcctgacctcaggtgatccacccatctcggcctcccaaagtgctgggattacaggcatgagccactgtaccgagccacaaaattacatttatatgttaaagataacacagttgtacggggcattttgttctctccacattccagcttcaactttaacttgttagcctgatttcttgctgctttgttagggtctaactttactgcatactcctcacgccttagtctctattccagctgatggtttctgctgtctttcctaattcttatatgccataattctattaatacctcatggcctaactcagtatctactatttgaatgaaagcttcccaattataaataatataataatggttactatttactgaacacttcagatatgctgggccctgtgctaaataattgacagactaacatatagcacttctttcctcactatcctatgacatagattccagaaggccaaataatgtgtgtgaagtcacatggcttgtcagaagccctaatgggattctaaccctgggttctcagactcaaatgcccatgctctcatagccgtgattctgtatcatcagcctctgaatgcccctgcttgaaaacaaaatgctttgattaacttattgaatgccaaattcatgttaggttcttttcttagattctttcctatagttctctccatagctttgagataatcatttcccattttgcaggcagaaacactgaggctcttagaggattaagcctcttgagtttatatggccagcaaatagcagagccacaatttgaagccatctctatgtgactccaaaacctctgtccttatgagtacacattctggagtaatctctcattctgctctcacataccacatttgttctgtttttaatggtaccttctgtatacatgtcctgtatgaaagtatagaagtcttgtagctccaattaaatcattttaatggtaaagaattaaagtctgccctaaataataatcttatggaaggttgagggaccatgtttctctcatctttgtactgccactgaagtgcaggatagtgcattacacatactggggacctaaaacaaagcaaaacactacaaacagaacaaaaaccactattgaacaaataattcaaattaaacttaatgcagtcatttttagtagtgtattaaatggtctctcttccaggcatctttatttttttgtttagttaaaaaatgcatctctgaaatacaataaaaacagccacagacagcccaggaaccaaatgctgtgattggttcactgaccagaaaaaactggagggctccaatagaaacatacaggtgacagattcgaataagaaagcagagttccaaacagcaggagcagcaaaaattgaatgcttcagcagtggcagagattagaaaaggcaagggaaacagccagtaacagcctaactgttgagcagatggtcagcttcagacacgtgacggaagcattccaccttctcgctgctggagggaaggctcagatggctcccccaacctgcatattgcaatccttgaaggtctgggcatcacgtttgtgtgtctggagtggcacgtatccatctgcctcttacttacttctaaaggtattagcacactgctcagaaagttctcactgctaggtggttgtttagcaatggagagattaaaggtgcttctctccacctggcccaataatgatggtcctgtggcattcagctctctgttcttcatcatctaaatgtccccctccctctagagtgatagcaaaacagagaaaccactgcaggttgtcatgaagaattaggtttgattttctttttaaggacgctggggaatttgtaatgtattttgtttcaataccttattcaataccaataaaagtgtgttacgtgaaattcatatctaaagtcacctctttcctaacaattcctgaagagatcttttgctgaattatgttttaaaaataatgatgatgagagtgattttcccccccttgattcaatgtctagtcattctatggcaatcttaacaaactgcacgtgttagaaaaggaaaggaagatgtgtttgatgttattaatgtctttggtctgcgtttaatagaactaccttcctaagatttagatacagacttctaaaatataagaataaaataaagtaagtctccagacttctaaaatataagaataaaataaagtaagtcttcaatgcctggtcttaaaagaattttagacccagtgtctcactcttactcatttttcaaggagctacagtctagggatgggacttggctgggctgtggagacaaacagcaaacaaatctgggggcctgtggctctgggggatactggcaaagtgggaccatggtgtgacaagggccaagataaaggtatcctggggcaagaaggagggacccgtatagagatgcttgagatcagcaataggacttggatttggaaaagaaagttgtagagtgacttcaagtttctactcgggtgactaggtagaagatggtacagaaagcaaaagagaaatgaggccagtttggacttgtgaaatgtctgtcgaaactcagataagtgagtgtgtaaggcacataatttatttaaataaataaatgacaggatgaatattagaaattaagtttcttctttcttaggtttattgtgctctaccaatttgccttcccctaaaacaatatttatagtggtagttcctcacattaaaaaaaatgttaatgtagagaaaaaaacttacacccgcttctgccatgtagatttgtcctcttgttctacttatgtcatgattttatgatggattttttcatacttccccgtttccttgaatgttatacactgttttatataaatgttactaaagggattaccagcacacactagctaatcatcatcttaaaaatatttcatgtagagtttttgtttttatttatttttattttttccttgagatggagtctcgctctgtcacctaggctggagtgcagtggcgcgatcttggttcgttgcaacctctgtgcctcaggttcaagtgattcttctgcttcagccttcagagtagctgggactacaggcatgctccaccatgcctggctaattttttttttttttttcttagtagagacggggtttcaccatgtcggccaggctggtctcaagctcctgacctcaagtgatccacctacctcaccctcccaaagtgctgagattacaggcatgagccactgcgtccagcctcatgtagtttttaaaggacatttattttcttttcctaatagtttacagtttctgttattgaggagctggaaaaaaaaaaagagcctgagatagggtaaagtataaattaggttgtctcttaatttgttagtcccatttcactgagcagaatactgaagccagaaagttaagtaactggagatcacacggctgagtcctaaggatcccctgagcttagaacattaaacctcgagagagaagtgattgggatctaaatgttgaagtggttagattgtgttgaggaaaatgtctcctggtaaggagatataacatcctcaggtagacttaaaaaacaaataagccgggcgctgtggctcacgcctgtaatcccagcactttgggaggccgaggcgggcggatcgcgaggtcaggatatcgagaccatcctggctaacagggtgaaaccccgtctctactaaaaatacaaaaaattagccaggcgtggtggcgggcgcctgtagtcccagctactcaggaggctgaggcaggagaatggtgtgaacccaggaggtggagcttgcagtgagccaagattgcaccactgcactccaggctgggcgacagagcgagactctgtctcaaaaaaagtaaaaataaaaataaaaaaaataaaaaacaaataaaataaaactttcagaaatccttaagacataatacagttacctctcacttcagatttctactagaatttgagttatttcaagggtatactggtatgggacaatgaaaagtctttgctaattttgcctgatacactgaaaagggcaatgaagaatgcaaatatggagttcaaccgagcaaatgagatataggtagttgtaggcatttctaagaagcagacagacaaatggcaattaattgtttgagttacccttctgaacatacatgctttgaatagaactggccttgtaagtagacattagtaatttgaggaagcaccagagagatccttcatagctttatttttgtggacagtgaaagtttttgtgttttctttttttccccttttttttgagacagggtctcactctgttgctcaggctggagtgcagtggtgtgatcatggctcactgcagcctcaatctcttgggctcaagtgatcctcctgccccagcttctggagtagttagaactatgggtgtatgtcaccatgtccagccaactttttgatttttgtagagacagggtctcactgtgttgcccaggctggtcttaaactcctgggctcaaacagtccttcctcctgagccttccaaagtgccaggactacaggtattagtcactacacccctgcaagtgttaatgtttcacaactgttagaatgtaaactatccttatgaggtgatgagcttttattatttcagtagctagcagggtgatgggccccaggataggacagtaagacctgattgaagtgagagaacagactcaggccctagcctgccttttaggacattactgcccttgctttagaaaaaaaatgctttttacctcccatttaattgggtcattgaagtaatagcactgaacaaagggtttatctaaggatgaagataaattgtgtatctaaccatttaagaattattaaaattactccagtgttgttgtttttgccttcattgatcaaggagagagaaaactagtaagttggggtggtttgacccaaatcagtcaaagatgtttcattatttagaaattctgcaggggctgccctaagataagaggatattttctaatttttgcacaaaaaataaggtataaataataaattgttcaaaccaaggaatggagaacttggctaaggtggttgccttagatacttatggtttggccagaggactatcagcactgtgtgttttgatctgcataactatggcatttagttgtaaatatagaatacttgaattgcagagtttgcaaactagaagggactgcagaaatcatctagtccagtggttttcaaacttgattttagccgcagactttttcctttaaaaatgaaatcttaggtggaaccccagtgattgaaacaaataataagaagtgggttcctctggcactttaaatcttgagaatcttgattgttttggggaaaagttcttcattgcctaccttcagcacctcaggtggcacagtttgaaaaccactgatctagtccaaccctttcattttacagatgaataaactgaggtccagagaggttaagtgacttgaccaaggtcacacagctagtcatggaagagccaggactagatctcaggtctcttgattcccagtccagtgctctttccactacaccacaatgccagtaaggtaggtgctgtgttagcattacgttcatagccactaatagtcttcagtattttccagctgatttatgctgataatatgcattgaatattgaagtgtattttttagaaatttgtgggatatgcaaatacagattagaatcacatgggtatattcttagatgataaatcagtatctagaatgtttcagtttacttttaaaaattattttaaagcaatgcaattaggtaatgtctgagctacattggatattttagtctgatatcagtgatcaatatgtaaggagtcagtatgttttagtgtagacacatactttgaagggagcagcattaggactcctggccaccactcccttgggggccatgctttgccatcatttccaatattggccagtctattcagaatagtgcatccctcttagtatgtagtgggcatgttcttcaacattaagctctgcagatttaccctcagtttttttgttgttgttgttgttgttttaagaaagagttttgagtttgttgcccaggctgtagtgcagtggcacaatctcggctcactgcatcttccgcctctggggttcaagtgattctcctgcctcagcctcccgagcaactgagactacaggcatgcaccactacacccggctactttttgtatatttagtagaggcgaggtttcacagtgttggccaggctagtctcgaattcctgacctcaggtgatcctcccgcctcggcctcgcaaagtgctgggattacaggtgtgagtcactgcacctggcctcatgtagagtttttaaaggacatttattttctttctgtaatagtttacagcttctgttattgaggagctggggggaaaaaagcctgagatagggtaaagtataaattagattgcctcttaatttgtttttacaaatgttgtttcctatcagtcccattttactgagcagaatattgaagccagaaagttaagtaactggaggtcacacggctgagtcctaagggtcccctgcccgctccataatagtgcatccttcttagtatgtagtgggcatgttctttaacataaaactctgaagatttaccctcagttctttctatgcctataccttctgtctctaagtcctttattcttctcaacctggtgtgtatgaattgtcactggggcgcccaccctaaagggccataaaggatggttcattgtagaatcctgttgcccctgattatctctgttgttgattcagtttccacctgaattgctctagtgttatcagacaaagactggatgccatcactagatgccgggaaagtagaagaagtgcctctatgctgttgttttactatctaaaataaagaaggcatgtagatgtctgcagccactgtgaactggtagaattcttatgagaaaacgtccctgggaaaatagatgttaccacctgtctaaagataagagtgctggtcttgtaagtaaaaagtaagtttgggagcagtgattagtcaaatttgaatatggtttgtttctatcttattgaatatattaggggctagtctctatgcagtagaaatatatacagccagaaattactgctttactcctacttttatttgagaatcaaggaatcgtgactagttatcaggtcttatttatagaatgcattccttctgaaagccaagtttagagttctgtgcatcacctgatggtgtgtcgtcagggtgttcccgtcctgccatgtgacctgataaccccagacaggatacattagctctctgggtatgtgtttcctcaactttaaaataagggggttgacctagatcttccttctaggccaggctagctctgtatgactgctgattgattaccttggtgactcaagataatgtcagggtcccagacattgcattgcatacggtatttgctcagtttgatccttactttcctatagaactttctgtgatgatggaaatgttatgtatctgtgcagtccactactgaagccactggccaagcgtacctgttgagcacatgaaatgtggctagtgatactgaagaactgaattttaagctttatttaattttaagtaacttacattttaagttaaacaaccacatgtagctactgtattggacaacacagttcttagatattctctgacacagaagtcagataccaagtggaataggtgtaccttaagtgttcatcaagagagtagtgatgttttaccttgatgaatcttcatcaaatacagtcggtcttagggtaacttgttagaaatcaagcactgttttttgaatgaaaatgttatctacaggagtcttgagtttcctcttgtttgtgacttaaccacatgagcttcaactgaaaagatatttgctaatttgatgagaagtgaaggattttttcctgtctgcaggcttgtgatcatttaggtctcgacacaggtctcagtgaattcccgtatgttttctgggaagctgagtttagaaggtttctggccaataaaaaatattctgtttttattccaagctcaaatatgagtgactgaactgtgctggtttctgaatagatgatgaaacaaactcttgttttttccccctttagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatgggtaagactgaaggacctgttcacttcttacgggattgggtgcttgaagacttgcaccattatttctgaacttaacttgaggcttgaaatctgtgatagggatgaagattctcatatcttgctttatattgtctcctttatgaaaaaaacttgattggtattaatagacttttaacagctgtactttctctctcctaatcacttgtattctttaagacagtacactaaatttctttggaggagggcatctagattaatacaagaccctcaattgttgtgttggtaacaaatgcaaaataaatttttagcttgaattctctttcaacatgagacttcatatgcagtctgcctgccacaaatatttttaaaaatcacttgattttcttgtgttgtatcttttgtttcagatagtctctacgtttattttgatttttttgagcctccatgatattccatatttccaaagtgtgatatggcatgctatctgtggcttaacagatgtttcccaaggaatgatttggtacttttttttacttgaaaatgccagtgattaaagttaatattgacagttttgggtcaaggatcagaatactgaagaagaagtgaatttgggcaaatatgtgttctatttccctgtgttcattccttctttgcataaaactattagaagtaaagcattttgtctgggtgcagtggctcacacctataatcccagcactttgggaggctgacacagatagatgagtttgagctcagaagtttgagaccagcctgggcattatggcaaaatcccgtctctactaaaagtacaaaaattagccgggcatggtggtgcatgcctctagccccagctacctgtggggctgaggcaggaggatcgcttgagcccaggaagcagaggttacagttagatgagatcatgccactgcaccccacacactgcacctcagcctgggtggcagagcaagaccctgtctcagaaaaaaaaaaaaaaagtagtaaagcattttgaagacattgccttctatagaacaaatgtctaccatgaaaaatgagagagaagatgaacaaggtaagtttttaaacatatgatcagtggttcagtggtggagatgatagtgtatcagagggttatcagtaagtacactgttactgggatgtcttcaattcctaattagtgatgagtctcactgagagcaatagtcagtctcctcttctttttccatctcctgtgtccacatcacccactaacaggacttaatctctaccttgtaactaattgctggcaaactttcctgatgagggcgacttagtgacctggacactggaaagagcaagggatgaaatgcaagtagaaaaccagaaagtggagctgaggatacagaattctggggaatgcagccagccagatattcactacttgattacagtgatggtggttgtttttttgtttgtttttttgtttttttgccacaggcagagagagcctaatatatagaagtttacattcaatttccaactacattgctagcaaacaggggctccacgtgtagggccttttttacctttctacacccaactccccaaatgtttagaaagcagaaagagagtcagggtgagaggaggggtgattgaggctttggttgtaagacagtaaattagtagttctggttctccacaacagtaatttctacgtttatatagtgtgtcagacaaatggctatgcatataatttgtgctttcttaatagccagtctgtctaatgttctcgcaggtaccatttctgaagagctttcaaaggtggttatgctatttcttgatctggattgatattttaaccccaaaatcaaatgtgataacaactcccttctacacaaagccttaccacttatttatgacttaaggactgaaaaccatgattgcatgtttttaaatagcagtggagtcttcaggtcacggtgagaccagttcaagggatcccattttgtagatgtgttagcaaatggcctgtttcttaggcagcaggtgctattttgtgaaatattagttccagtgcactatacagtaatcagcaaggaagtaattacacttatgtgcaatgattatgttttcatcaagtaatataaaatatccctttatgaattatatctgtatccattggttttatgtgattttcttcagaccatgttccttaccttttaattatattagcttataaaaccaatagtgctaatctctataaatatgtgcagctactaaaccatccctaaagtctggcagagtttagtgtgtgttaatgtaaaataaaatcttgatgtatgagcaacaaattatggtgttacatcaggctgccattttgagaatataaaaattgtcataaagatatacttagtctggtacgatttataaatgcctattatgtgtagggacatatactcacgagaatccttcagtaaagtaacttcttagcagcattagtttataagtaagcttagagttttatcctagttagttaaaatattctaaaacaaaataatcagttgagactcaacattagtgtcaaatttcccacaaatgaaaatgtgattatgagctatttaatgattatgagatatttcccccggtacatccctctggtattatgactataaataaaaattgtgtgctgctgaatatttaagtatcttaaatagagaaattaataaacataaaatcttgatttattttttatttttaaagatttgattatatctaacaaatgactttcaaagttcaaaagcggcaaatgaatcttacattttttcaccaagtacttgagctcaaacatgtttctaatgcacttaatatttttttaaaaatgagatgaagcttagtactgtttcacaaatgctgaaatcccaccaccacagatatcctgttgctcattaatattactccaggcattacagcttgtgtcattattgatttcttctgctgaatttttcaagcttttgagacctctggaattcttgtccttaaaggcaaatattcagatgcctctaacatgaaagtcactgtcacatttatatccttatcactttctggttgttttgtatggtgactaattttaacagtagtggtttttctctaaaacccaggcaacaaataagttaacaaaaattacatatttgcaaacatttcaacttgaaataatcacaacagagcagtagctaaatactattctttcccaatgtctttatattatgcaaattaataaaacatatttgcacttttacttttttaccaataggtggcattgacaattttaacttttaaaatatatctcagaatatgttctaattggacaggaatggtacaaagcatcttatatttagctttttatttagtctgagaaggggctatcataaatttgttcacttccatcagttgtaaatgaaatcgttttatgtggttggctgaacagtcatgtgactcatctttatttgtgtaaatcagctaaaaaaagggatttataaccacttaaatctcacaaaaagtaaaattcagtgtcttataactcctatggtcatttaattcttacataagttccacagagagatagctcagttatctagaaacccaaactataagaaactttatacataagttccacgagaggaagcccagttatctagaaaccaaactataagaaactctatttgctgttcagagtaacattttgaaaattggtaaccaaaaataatagttttgatcatttaaaatgcaaaataatgccacagcccaggggcttttcctatacagtagaatataaagtgaatatgtaagaggaataacacgtttccagatttctctgttcggagcctttcagcctctctttttagtgagacacatttacttcctattttaatgagcatcctagctaaccgcttaattaatattggtgctcacttggtaaacacttatgtattactttttcatggacttcaaattaggattttcagttggttcacttggatttatgatatttgtcaaattatatctggtatattaatttttttttgaagaatatccaatttacttttattttttaatttttggtaaactgaatgagtatatgtagctccatattatacaagccttttcttcatggtctaattttatcacggaggtatatgtattaggattgtattcatttacacaaggctgacatgtagaaaaatttaccatgcttgttttgggaaagcataacccttcctatgtaaaatgacttatgctgtctttatttttaatgcaggacagcaatgctttaaaaaccacttaatgtctacttgtggtttcttgtatttattaagagttagaatatatttttacttacagagtgttgcatggataactagttgtggagttggtgtcacttaactgtctccttatgtgtaaaataaaggcttctgaccaggtgacctctaaaattccttctagttctagtattttatcattctatgaggaatctgttaggtaattctgaatctaaatatgactcatgtctccatccaaaatcaaacgtatttttacatcgagtttgcccacatagtccttgctatgagtctgtgtgtttatgggttgtgtactgaatgctttagggttattcagccttctctatttttgtagggttgcatggcacacgtcaagaagaaatgattgatcacagactaacagacagagaatgggcagaagagtggaaacatcttgaccatgtaagacatcagtaatcatttgggattaaaaaatgtttggaaaacaactggagtgaggttatgtgataaaataaaagcttggtgatcctttgaaggcattgtttttcctgctatccttgaaaaaaaaatgagcgagaatatctgaagtagaatataggatttgatttctaaattgatatgaaagtcacttgagagaaatgtttagatcttggaaaggaattctcaaagccagatcggtgggctactgttctattgtgaaaaggtcatttaatttataaagtaatgggattagtatttggagaggtggatttactggctataatgccttcaggtgaaatttcccttctgactcgtgttcataacacttatcttctcattcccattgaattttccatctattggctctgaatttcaaatctagtcatagaaaatactagactgaaaccttcagggataaaattgcttccttcattgtcctgaaatggtttgtttcactactcagcaaaatctttaattgtgatgatttatatgctcttccctattctcccctttcccaaatagctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggtaacttttcttcagatgagtatctcgaaaacacatatttcttatgctgttaatgctgacttcatttttatttttaaaattaaaggatatgcaaggaattttaagacaataaacaatttacatatcctccaatatgtcttgtctatctgttaggaatttgggcagattggcatagacagagatagccacaaaacttaaattccttttccaggtgagtgtattgagctgatggcagcgtttcagcactgaaccagattttcatgtgcataactaaaacttgtgctccttcgtaatgcctcaaaacagcaaaaacaatctcagggagtgggcctggggcttaggcacttccgtcaaggtctctagtgaattctgccactgcataccaatgttatcactgcacatggggatgtatgtttcaaattattaattcagaaaacagcctgtaagacaatcttgttagttgaatcatatatatatatatttatattttaaacttttttctcaaccccccgcctccaggaagagagacctagaagctatatattttgcctacagctattttaaaattaatgataaagatgtagcacccttcctgtgatttgatcttaacttagattacttaatcatgattatattaattctagttttatctagttttataataggactcataatatagttgtgccttagaaatggaatgttagtatgtaactatttcttattgatatttgggaattgttggggttacagatagaatataatcccatatatgttgaaagaaatcttcaacctgaaagaatttttgtgtggcctgtgaacttttacctaaattaataatacggttttgtcattgacattgccacccattacgtgtgaatactttttgagtaaacttacgaaggtggatttctgtggattcttgttctctcatattatcttatgcgttggccccatacccatctgctaactcaagttactgtccatgctgcaaaacgtgcagattaagttcataattttggcctcattagtaccatggctgattatccaaagtttaaaacttgaagtatattatctgttgatcacattactgttttcaatttgttcccagccagtgtagtttcctatgcacttaggtttgtagatttctgctgatctctgaatgccgaatgcctattatcataagtattaaataatgaaagagtctaaggcagttaatttacctaacaagcattattctgaagcatattttaaaaacaaaattgtatttgtcaggtcacattaaggcaagcaacgaaaacagaattacgtttggtttgagccaatattggtcgaagccaaactatttagagcagagtggaaaaaaaaatcttgtgtttatttccttattatgaacaaaaattgattaatcatcagagatttgcttaggacagaggggatatttataaccgtccagtctaggcaaaaattgagagctttaaagtaaataaaacttagggagttaaaacatctagtttggcttattctattgaacacattcattgagtcagtacttatttattgagcacttactatgtgccaggcaatgtgctaggcattctaatgaaggaaaaagtcttcatttctttctttgagggcctttgggtctagtggaagaaggcaagggaatagctagtgttcaagccataggatagctacctcaattcagtcggccaaactgaccagattgctattatctgccatccactataaaagaaacatctccgaaattgatcagacttcatacctaagcgagttatcagcacatagaacaagggccattttgtgtatagtcactactactacacacagattctggtgatataggtatatatcatgttctccaggaagagaggttcattgtccctgctacataaccaaaagaataaacttggtttaaaaaaactcctttttaaaagtatacaaactatactattttttagtgatgttcaatggatttatatttttgttaaacctgagatatttgtttggccttaagcttttgtaggttgtattagtcaaagggtacaagcatttaatttctttgtttatagacaacattaagacattatgttctttattgtcacagaatcctaagttgccattaagacactatcataactttagagaaaatctgtgtagaactctgcagtgtgcaagttttagcatccagtagtgcttttacagttttttttcactgtgcatccttactagctgattcttgcagccttgtgtactattttctgggactgagctatggctgtaaataagaggacaggtggtttgtaattatgggccacaatcatttacattaagtgctttctaagtccctcttccaggctttggagttgaatggattgatgtgtgtaatgaaaggattggagattattggctgataaatctattttctgtgactgggaagtgtttaatggagtgcatgtgcgcagataaagatatggatatgtctatatctttatatacatttagatctccgtatcccacagttgtatgtatttcttttagcctaattattttgcttcttaaactactgtctggtctcaaatgagatcttcagaatatattatagaagatatctttggttcaaaatattgccctacttatatccctaacttggaaacactgggaacgtttagtcatacacacattcttagcattttaaaattatatttggggactgcacaggggagaatgtaactttcatgattgatgtgttgtacctgttaaactcaatcccattctcacttttgaaatatatctgtagtattgagtgagtatagggggttagtaaaataactcgattaatctattactaattgaattttaagagttttcctggctgggcacagtggctcacacctgtaatccaagcactttgggaggccgaggcagacggatcacgaggtcgggggttggagaccagcctggccaacatggtgaaaccccttctctactaaagatacaaaaaaaaaaaattagccaggcatggtggcgcatgcctgtaatcccagctactcgggaggctgaggcaggagagtcacctgaacctgggaggcagaggttgcagtgagccgagatcacgccattgcactcgagcctagacgacagggcaagactctgtctccaaaaaaaaaaaaaaaaaaaaaaaaagtattttcctaagatattaaaatctcttttttgaataacctctgactgaaacaatttttaacactgagtatacactgaattcataatggtatttctattctttaaataaaatgcaagttgacatcttgaaggacttttcataaaatagattttcttgaaataatagatatttatcgtttttactgttgttactcatttactttccagggaaaactccaagtatccaactcttaacaaaattagaaagcaaattttaacactgctgtctctattttcaaagtatgacttatttatacatttaagttttattacatggtatgctccacagaagagcaagataatgtgatcagaattgacagatttgaccattgaagtagaattacttttatatgtatagaaaggcagttgctggttagcactttgtatgttttccgaagtgcttgtcagaatctccttagtagctctttttcctttctttgtctttggttcctttttctctcagaatgttgtcacatcactttcttggctcctgacattttatttcttttaaactactttcctttttactggcttttgactattctagaatctttctgtagtttgtcttgtatctgtgtgcgctctttttgttttctagaagtcttccacatcgttagggttaattttttttttttttttttttgagacagggtctcactttgttgctcagggtggagtgtggtggcataatctcggctcactgcagccttgaccttctgggctcccacctcagccccctaagtaattgggactacaggtagaccaccaccacacccagctaatttttttgtattttttgtaggagtggggttttgccgtattgcccagtctggttttgaactcctgagctcaagggatctgcctacctcggcctcccaaagtgctaggattacaggcgtgatccactgtacctggccaaaatttttttctaatgataggtttagggctaatgtcaggggctggacataaactctgaaatataaatgcactttccctgtgcttttaaaacatgtatgaacattgtgatgacatggtagtaaatttagaaaaataccttcactctgttttgttaagagtttagtatttgccagagaaagaaatatcaaaaagttttgtttgtttaagtgtaatgaaaaatcaagcttagcatttataagaaacttagagccaggagtgttggctgacgcctgtaatcccagcacttggggaggccgaggcgggcagatcatgaggtcaggatatcgagatcatcctggctaacacggtgaaaccccgtctatgctaaaaataaaaaaaattagccagataatggtggtgcacccctgtagtcccagctactcgggaggctgaggccggagtattgcttgaaccctggaggaggaggttgcagtgagccaagattgtgccactgtactccagcctggaggacagagcgagactgcctcaaaaaaaaaaaaaaaaaaaaaaaaaaaaaggcttagtaacttaggagtttgttgaattaataccatcccctgtcccaagtgggttggtagaggaattagtattttaaaatactgctagctggcaagttttatgattgtcatatgattgaattatggaatttctcattgctctctaaatccccgggaaatctagcatgaagactgaaagcacaaactcagtcagtagaatttctagattcgaattactcattcctcttcatattagttttgtggcctttggcaggtcataatctctttgtgcttcagtttcctcgtgtaaaatggggatggtaatatatatttcataagcatttctgtataatgagttaataggtaaaaacatatgagacagtgcctgacacatagtagaagtgttatgtcttagctgttatttagatgtgcattctcaaaaagaactttctgctgggagtagaagtgtctcatgcctataatcccagcactttgggaggctgaggtgagaggatcccttgagtccaggagtttgagaccagcctggaaaacatagtgagaccccatctctaccaaaaatcaaaaaattagctgggcatgatggtgcatgcctgtggtcccagttgctcaggaggctaagatgggaggattccttgagcccaggaggtcaaagtgacagtgagccacgtttatgccactgccccgcagcctgggcaacagagcaagaccttgtctcaaaatataaaattaaaaaatttaaaacataaaatcaaaaagaactttaaagaatagtggtaaatgaaactagtaaagtttttccttggcattcaagattgtgaagttacagtggattcataagtattttttcatctacaaagtacttctaagcaggtggcttctttaataggcacagagattagaaaagattcctgtcttaaatgtagtaaatctgttgtacctttgggaccctaattcataatacaaggctatggaaaaatagatttctcccagccaatgaaatatttcaacttctatactctcaaaatatgaaaaccacaaacaagttattctgtgtatatttgcatgtaaatgtttggagttttgtacccttgtattgatttctttaaatcacatcatgaaattaatctcacagtcattcagctgacttcataatgcaaatgcctactgtacttaactatattgggtttaaaaatatgggactattagttaaatatgtccatcttttaaaattaagaggagatggttacttcctggagcattaagtatgtttgttgtaaaagatggaaatcctaaagcagttgctagcttctaggttggatttgggcttctgaaacctagtgtgaagatttctgaatgtattatccttaaaaacaagtggcatttgtaaagataaaattacttaactctttctttcttttgatggtttttgtaatagatattatcatgatcacagcctcattctgcccactacaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcgtaagtgtagtgcatcttccatctctttcatacatcatagattgctctttctgttctttcacatttcttacaccattttctgtcactctgacctggtctcctctcttcatagatgtgaattattttcaagaggctcccttcatcctcatccactctcaccaccaccccccgccccaagcaatttgcatcccaaagcaagctagacttaatttagaaggacttttctataatgttttcatctttcagtagttgcatatatatatacgtttaacattttagaccatatcatagacgttcttctgtctttgcatctaccactacattttagaatgatgattcctttttctagcaattgatattttataggtacttaagagttaacgggtaagaattagcttcttttgaatctaagccttagaatcttaggatgttttaggtagatgtgtttagattagccagtattctaaaatagtaaagtcctaggagagaattgtcccttgttttgtttttcaaactcagttttccctatatagattttgatattgctgctgcttaatcagaagaggagatattaaatgtattagtcatttggtttctgaatctattaaagtagtgtttatcaaggtatcaaatagatttctgaggagtatacctactaccaatcactctgttctttctgttggtagacctgatgtttatcaagtacactaacttagaactggagaggatattgtaaaacacgtttatataattatttccctttagattctgctattttgaaaaactgtcttttagaaggtaggttagcattaagaaaacttttgcataattggctttagcatttctattgggtttctatgtcagttaaagtttgggcctatgtggacatggcagtatgtcagtgagaaatttaggaaggtatagccaaagtgaaacattgcacaactttccagtgtggtatatgtacccccaagacacctgtgcagcccatagaaggtggaaggtcaattgagcctggcacgttaatatttgagtcaatttgggtgttataaacattcatgggtgaggctcaagtaaaatttttgaaagtgtcatctaagaaatttgaagattttgcttccaaggacaaaggcagtgaattgtgaactatagaaatattttctatttccaagtgacatagattctgggagtttaaaaaattacttggtgtatattgcttaatccaaacttcttcaatggctttgttctcttcaaaatttgtggtatttggatttttaacattgagagaaaagataaactttaaaaggaaataattatatagccattcttactagaccacatagtaagtaataataatgataataatgaggataatagcaagtaccagataatgggagtttaggatgtgtatgtaataggaggtacttccttcaatcttcacagcagtgctctcaaataatagtagtattgtcctcactttattatagatgaggcatctgagacatggacaaactaacatacccagtgttccatggtcaatagctagcttcactgggtgctagaactaactttcttcagcctatgttgcctggggctggtaattagcatctttcatgcatggactttggatacctaaacattacctttcctgttctttatcataatgattgactatttaataaaaaaaaaatgtttataggctgggcatggtggctcacacctgtaattccagcactttgggaggtcaggtgacctgacgtcagaagtttgagaccagcctggccaacatggtgaaaccccatctctactaaaaatatacaggttagctgggcttggtggcatgcacctgtaatccgagctactcgggaggctgaggcaggagattctcttgacctgggaggcacaggttgcagtgagctgtgatcgtgccactgcactccagcctgggcaatgagcatgactccgtctcaaaaaaagaaaaaagaaaaaaataagtttttattaactacaggtctcttcttaacacaataaatgaaaaaaaaattgctactttgaagtcacgtttttttctttcttcaaactttacagatctgttcttattcttatccaataaattatgcttaaatccaagtcttttctccttaaaagttgtcttttaatgtcataagtaaatctctgtgttgtactgtgtcacatggctaaatatgaacttgattgcactttatttcttctggaaatagttatagtggtaaggaagataatcttgataaatctaattagctgtatcacatttccttttaggttgtttatgcagcagttttatctcgccttaagaatgaaagttacttcagtaaaaacgtttttatttttgtcatttactttatagaaatgaatatacacaggagaatgcatagatatttccagtccatcctattattaagtagtcatgacatcacagtgtaaacttttgaaaataaacttttaaatatttggaataattttagattaaaaaattgcaaagatgatatagtttccatatattcctcaccaagctgtagtaaatttttgctaattcagaatagttgagaaaatctaatgttcttgccagttgataatctgtgtgccctgcaagaattcaaagcattcaaatgtatttaaagcattcaaatgtaacaacatatacttagctaaactcatcgtgcttttctttatttttgacattgtgtagcaccataaaatataggagactggactaaatgtcttcatcttcaacataaccattagataaagcatttaaaaatatatgctactcaacatttactgtacacatagagaaaatttcagttttcctcagaatttatcatgggcttattaattaagttttataaaagttaaaatgatttttttcttaccgaactcttctatataaggaggcttttattgaaaatccaatatggaagacatgaaatgcatattttagctatggaagacggtatacactttgtttacttttgagcatatgtaagaactataaaatgttttgtgttaattccatgaacatattttagaagttagcattcctatatcaaagttattagttgttttcttaaacttttaaaatttgagacgcctagtaagcacagcatttaatttaaagtggaacttcatttccttttctggaaagcatgggctaattctctctgctcaacagaatgtctgtgaatccattctgatgagtctttctggctttcacgtatgtcaaatccatatgatctaatttgtgtgaaaaattttaatggtcactgagatttttaagaattaagtatgagaactggttagccatagagtggagcttgctattcattgaaaggtggcagaatcagagctctgtggaaattacattacctgaacatttgattgtttaaccaccagtttgactcatgaaaggaaaactaccaaatacaatttatattccttaacaaaatatatctatagaagtctccatagtcagaaagtgctgagaacagtgttcccaaacatcatattgtataatgaaatcaagttgctttggctttgagcatgcatggcatttagaccaatgaccctctgttttccttgggctctgatgacaggccttgctatttttatgtgttttcaagaagtgaaatgtttagccttttaaaattgcgtttttgtagagaagccaggagaatgggcattgcttactttcactctgtgcgatgacacaagtgtgcttacagtactctcctcctctctccacccccttcccatccttttcatagacgcgcatcgggaattccttcacaggcctgcgtctggatacgtgccagaggagatctggaagaaagctggtaagaattgtttaaaaacatgagtttcgtgttctggcagctgtgtgcagttgttaatgtagtgatgtgaggaatgacaagaaaggactttactgctaacaacaacaacagcaaaaacaaaacaaaacaaaaaaaaccactaaacaaaacacctgattaatattcttaaaccaggcctgattacaagatgaaatcatttttattttagtaacatctgccagtttcactataattgagaagctggcaatatttccattataaaactccatttttttcagggccataatgatttcaggctgaaacttggcataggaggtcttagcttgcatgcatttttttctttgatgaaaaaattccagtgtcttagaaattaaattgcgtacttcagccttttctcctgcatccaaaaaaaaaaaaaacgaaaccaacatcaaatctagttgacttgttaaagtactcagataattttttggttacaatcgacttttaaagttgttcttctgtactaattagtattcaacgatcagagctaaattactctttaagtgaaatgacaaagttactaaacatttatttttgcttttcatatacactatctgctttccattacaagatgctgctctatattttgtaatagtagatttaaagctcctcatgacccactgacttgttattgggcttaaagaagtccagatctgtgagaattttggtggaaccacctagcaagcaaaaacctttatgaaaaccaactcaggagatgaaacataaacctgtttcaagagttaaagaggccatgaaaaacatactgtggctttcagctgctgtaactccagctcttaaaacagtttgtctttttgagttgggaaactgggaaatgctacttctacaaacagtgcaaattgaagagtcaggggacagattttttgtttttttctacagaagatttctctttgggatttcactcagctgtgtttgtagttctgtgtaacttgctgactctctagtcacatgtatcttatccaagtatttttatacattttccaagaaatacctgtttttgtaagagtgataatgagctttaaaatctgatagcattctaggtttagtagcccagattaagaattagaaagctgtcttgcacgtccaatacgcaaattagataggtccatttagcttaaaggttaaaatacatatgttgctgaactgtgtagttttaccagatttactgtaatagtcatgtagtattcccaagctgttaaaaatatgccaagtaccacctacctgaaaagacgggcaacatcttccttctgaccatttttctcttccatttctaagctgtcagtgcaacttattccaataagaggtacaaataattgtgattttggacagaagaagggtgactttatgttcagaggagtgagtcttttctctgcacttccctttttaagtatatttaagttaaattcttgatagttcatagagaaaaattaccagtaaggtcttgtgtaatccgaattctttttgtgctattatctgctcaagtctttgtttgactgctattaagtgagaatagatttttctgaatatagcacctttgttggaaagtcaacttgaatagctatgtacaaaggaagtcctaccataagtggtaagcaattggacgcagattcaaaactgcactatgtattttccacttaatcagttgtttattttttcctacatggcatattgttatctattgactccactattatttttctttactgtctgttttgggggtttttaaacctaattctgggtgtaatttaggttttggggacttaagagagtagagaaagagcactacttgtttttgttgtgtgcttgccctctccaagaagggttaaaccttatctaggaagtgtttagattatttattacagtgtctatcatctacagtaggttttcaatctaaaatatgacattaaatttgtattcttctcacagtggtatccctaaactgctgcttaaaaacagtttgggaatagttttctatggatatatgctaaattttaaggagtatattaaatccacaaagtatggatgatagtttcatctagaaatctccagtaactacttataatatttatctttataggtttcttaaatggcatttctagtgttcagtgtcaaggcatccaacatgatgaaaacaccaagggcagaatgtgacatctgcactcagcttgttacaatttgaaagcttttatcctagctttctaaaattggctatgggcaaaaaaattttttgaagaaaatctataaagtgtgtctttgcaatgaaattattatacattatctttgttgcaaaacataggtgaataaagtatttgaaaaatacaaaaggggcagaacacccaaaacttgatgtagcataacaaatgcatccactttcacagaaaattgtaattacaagtataccctgtgcttgaaagtacatcatatagctttttgcatcattttattttgaaatgatttcaaacatgcaggaaagttgcaaaaaaaaagtacaaaaaattcctctataactttcacctagattcccttattttatcatatttgctttagtattttctcttttcctccctttcatcctcttctttctcttaaatatatatatatttctaatcatttgagagtaagttgcagacataatttctctttaccttaaatgatttgaatgtcagtttaccaagaacaagaatattctacataacttcagtacagttaccaaatcaagactttatcactgatagaagactattatttaatctacagaccctatgcaaatctttcacattgcccccaataacacaatataataacataacaacacacatttttaaagattagaaatccaaaaaattgttcaaggccatattctcctctaaaagtagtattttttaaagcgaaagtaacaaatgcactcaaaagttacaaaggtctttatgaaactggaaaaaatctaacataaagatggttttaaaattgtaacaatgttttcttcagtatatttctttttacatgatcagagaatgtttgcagttggtaataaatattcaagcaccttgcaaatgtcctaccaattctctttgctgatctgtatatgcctgtgggattagaataggaatgcataatttaaatgtaaattgcctgatttgcatatacaattagtcaagctacagctttgatcgtaagcaaaaattattgttctgtactaccacttagatagaattttaattcaccttgaatattcaaactaaattagaccctggctgtatagttagaagggcagtacttcccttgtgccccaagtcatttatgataggataataaaggcatcttttcacctcctggtgaagaaggtgctataagctgtttgcaatactctgattctgtacagattttaaatgcatatcttaaagcagctaacaacggcttaatataatttagttaatatttccactatggatcttttacttatattttagtttataaaacctagcagacagtaattgcaaagaaatgtacttcagatataatgctgctaaaatgacagaggctacaaaagtcatgacagttaattactagtggagagcttctgatgactctcaagtcatggacaatagatgtgtgaaataaaccagaggaattgaagaaacaataggagtacttgcatctcttacatttttaatctacagtaaaacatttttattaggaatctatgtttttaattaaacagaacatttaattaaggtgctttttaagtgggtgaaacaattaagtgcaaacacttgaatgaaacatgtcataattagttttaatagagtgttaattggtactaggtttgccaagttaataattactgcttattaaattttcaattaatcattgtcattttgctttgaataaagatgaaaattagataaactaattcagggggaggatattttcccctgttaattagaacagttaattttttaaaatggaaattacttgttttagttgtcagtcttatgttgtacattagttgaatctttgcaccctttcctcagccaaaaataaagagcttatttgacaccttgcagactcatagtcaggcctgattgttttggcctgtggtatgattcagttatatttgtctagtgcaacagttggttatgcaaaaccactgtatatatttggtaaagtaaatggacaacagcttaaaatgtaaaaatgagattattttttaaaacctctatcatttaacctataaaggcacatatttatattactcaggaaatgacttttcaaaagtaaaactggatcatccattatagcattgatttttcattaaaaggtctatagtaacttaattgctatctgagttaccttttcactattgtgttgtagattatgccagcaactaatagtttgcacttatttgtttatgtgtaaaatccattctcggcctctcttttttttctgaactcttgacctgtggaccctcctatattcatgttaacttatagcattgtggaaaactgactttatgtgtctgaattattcagacaggtttcttgcgaatgaccttgtcctttaacttcttatctggtctcagaatcatttctggaggcattagtttggttaaaaaaattataataatgatataggagtttcaaaaaatatttccataaattcaagttaaagaaacattttcaccctttgttttcctaaatgtatgtcaaaagatctgctagtttttagactgctggaactgcccaataatttggatgagagtcatgcttcttctatagaattctacaaaaaagtaatcagatagtgggcatggtggctggaaggctcctgtaattccagctgctaggggaaattgatgcagaggataacttgagcccaggggttcgagaccagcctcggaaagaaaaaaaaaattaaaagaaaagtaatccgtatccaatgacttcggctaactgagaggtgttttcttgtctggtttggcctgactggcacacagaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgaggtgaggcatcttgggaagctccaaataaacaagatagttttcattcattagagtgctcattcttcattcaaggtgatcactttagataaatatttggaaaaaaatttagaacagtgtggggaaagtcaaggtattcatgaaatttgccaagagctgatcacatttgtctttttattgaacacctaatctttgccaaaaaaggttttgaatgtttggtaggttaccgatcaaagtgaaattcttataacttcgcagcattatttagagactcatagctcggctgtgtgtgtctgttgtgtatgtgtgcatgtgcatatgtgtatgcttgctttccaattgaagggatttaatagatactgtgtaagctgtggtctccaaagccatctggcaggcttgggattgaaatcactgccttagctattggtcctaaagtccaatgctaaaacaatgtttgcatcaactgaatatttctaagagatcttagagacagtctgtacttccacattatttgtggtaacccatatgatggtcatttcatagcataacattgctgctagaggtaatgttacatatattattgttccagtataataattctcacacacacacacacacacacacacacacacacacacacacacacacacacacagctagcctaaatggctcaaagatctgcaaagtaactaaaacacaatatctaacaacatgatttttaaaatattgcctgcaaaatcagcagaatagtaatgctccacgttaattaatatagcatcacgatccttaaccccagagtaactttagataaaggactacaatgggctgctctcaccaagccgaactcacaatggcatggactgataaatcaatggtctactacaatacatatctataatttgtgagggagagtaagtatttaatttgtaccaggcttttctgtagatgaaagactctgcaggaatctctcaatgcccagagtttctatttaatgtgtagcagatgaataacaaggggacaaaaggaattgattttcaacatttgaaagtttctcaggaaaagagggacaaagggaagtttatctgccctttaactgctgacttttccattgttcaattaaactagacataaattcagttttattggtatcttgtggctaagatataaggactttatgttttttattttaaaaacattattagcatcttttgaggagaatttgtccttctctgttcaaatgagcaatatcgtgaggcacagttgatgtcatatcattaaaactgtcactttcacatgaacattttagggctgttaggtatgttaagagtactttttaggtcaccaaattctaaagacagatgtctaggaagaaattgtcaattaagtctttgtactcaggcagtaacatgctgtattccttcagtatttataagctttgtgtctttattcctaaaacctatttagaaaatatgtgatcttgacaccaatatttagcattataaataaaccctgttaaacagtatctgtgataggttattcagtcatatctactactaatgtaagaatgatcttctgtaataattgtttttctttttttttttgacctcttgggggaactgatctttaatatagcattaccagtgtcttcagtgacacttccccaagaattttaaagcagaccatggtagaggaaagggtttggaattcagagggtcaaacttaattcctggctccaattcttacaattctttgatttttgagaaaaccactgaacctgtaaaagcttcaattttatcatgatctgaagaagagtggaagtgtctagtatatggcttgaaccttgagtcatgctatggatgaggaaacttacctggctaaagttacacagctaggaaatggcagagcctcaacaggatctcacagcatgctttcagtccctatgttgttttgtaacaatgaaataaggatcttttcatagggatcattaagataatttttgtatgcagataaagacaggcagcttaggtctgttttcttattctttaaagtgcaaggaccacttttaagacttggggaggaatcatctctagaaggattaagcctcttttctccaaaaatgctgtaaataatttcccaagaatagaagaaagaaagatggaaaaaaagatctctttacgcccaataaggcccatattgccttgtgctttaagtattttatggattgttctgttttctaagaaaaatgaatgttctcatttcttagaagtttaatgtgcaaaacttaccggagagtgcactgtaacctagggtgcagggcaaccacacctcccactttgggtggagctgtccattgacacctagtgtcccaatataattattacgagcgcccccttccactgtcaggtgtcctgtcttcattgataagttgaatggtcccacctcttaaaggccatgttcatctgatcagatgatcgtcttctgctagcacagctcggaggcagatacgtgtggcagaaagtatctgagaggaggacccagaagtcctgaattatggccccagctcagttactgtctcagaggtccttcggcaattcattttattcctgtcagcctccatttcttcttaaggaatgggacgatattcatttaccttacaaggttgtttaaaagatttttaaaatagtgtttttgaaagctataacacaatatattattatctgctcatatttcccacagtttttaaaaaatcacagtatttactaaagtattcctactgaaacaatattctttcctccctttccctttctttatttgaagccaccacctattgtaaacatctgcccatctcttacctaggtcaggtatgaactatataatccaaatctaaaacaacgtatatgtggtaagatacacacattattattctctttccttcatagggattgtaagaaggaatctaagattcgcgatcagaagaccagagttctaggcctagcttggccatttatgtttcttctgcgctatttgtgttaactctagatacctctgaattcttctctctgtaatttctgaatttgccctttctcttcctatctcagttttctttcacatgtataaaacggagctaatgatgctcattctgcttagaaaaaacagtggttctgaaagattggcagtggaaatgtttcagaaggaggagaggagttgagaacatttgactggggagaccagcagaaagaaggcttggaggcaggaatgaataactcatggatattatttgtaggtgggcgggggaggggggcgtgtaaaatttatcatccaaactgggatgccttttggagtaagaaagactgctcttgcttagacagaccagtccggtaaaccaggccatcccaggctcatgggaacccacagtcagccaagttatcggaggttgcatgaagtttgttttgcctgagatgaaataagacgacctacgatgagtgtttaactctgaaccaggcatggtatgaagtgctttctatactttagctcgtttacttctcacatcggctctgacaaagtaggtagtgttactttcctcattttactgataaaaagctgtgccttgaagggattaggccacttgctcagtgtctcatggtcagtaagtgtgagctggtccttagttcaggtagcccgactttcaggccaccttcttagtagctacatggcaggagtgggaggtttttgtttgtttgtttgtttgttttttcctaattgtgtactgtatctatttttcactggacttcatgattatttctacctagttctcaaactttacttggatttataggctgatagttggtattactatcagttagaatgacactggacttgcggcagatatctaagcaatgtgatgcttactgtactttctcttttcccagtggattatatatttaacccagaatataatgccaacattagcataaatcagaaatttactgaatctgatcatcttaaattcttttattttctccatatttatttctatttttcatttcctatctgtgtacagataaagctttttccaatgaatgctctcagattgcagctatttccaaggaaacttctacagctttctttgagatccataccttatactagcttaggtgattgaagcaagaaactgcaagtgagcacagaaacagataaatacttttattgttctaatagtttagagttttaaactaccaaagtgatgtttttcccccagattaaaacagcctttatttatcattcttatataggtgcagagctgcacagttataccaacctcagtggaatctgtgaagtttggcccaaactggaaatgccacctgtgtagactctgaataaaacatagggacctcacagcatgggtcctgtcaaagccttcacaatctcatcagaccagttgattcccagaaaaatttggagctctcagagcatgagctatgatgctatgttacatatatatatatatatagttatacaatatacaatatgtacaattatatatatatattttataaatatatatatatatgccagctgtttgattccgtagatgttcatggtatagtagacagggcactgggctaggattgacctttggttgctcacctcttgaagctttggttttctcatctgcaaaatttgggataacgtttctgtgatctgcctgctttgcaaggtggtggagaggtgccaatgagatgaggagaagtattttattaaaagaaaagtcaccttacaaatgagcagtgtgtctatgtaagaacgaaagaggaaaacggagaagaaaaacagttaagaaatgatcctaacaggaagggtggcgagagaattagagtagtgactatgcgattgaaaaggagagagaccacagaagtagtctgtggggtttggcactgaatggttccaggggctaaagaaagaggggtttgcaataaagtgacaaagtcttgggcatgagtgttgccaaagactgaaatggacccaccagagttgggtttagggaatactgacttagaggagcatcctggtggaggtacctacagaacaggcagttgaaataggagcacaaagctcaggaagaagataacaaggagaaacaggtttgagagtaatttgcttacagctgatcattgaaaccacaagatctcacaaggggcagcatgagaaggaaaagatattccttttctttatgccagcatccctccctccctcactgtcaactacagggaaaagaacaaacagcagaagaagttattgtataagaaagagaattttagtaggggaaatttcaacaagaggcatttaataaggaagaacggggaagtaatcagcaatggtaaatcttcagaaattttgaggacagcaaatgaagttgcggaagaaattattagtcactaatgaagtatgaggagaagtaagttaatgttcttctcctgtagctgtcagtgcccatgggtgatagcacttaatttgaatgggaccatcagccttctaattctaaaggttgtaaggtgctggatctggagcaaggactgtatctactctctctttcttccagtcagtaccaaaaggagggagtggtggtagtacctgccatttattcaggacctatgaacatcatgcactgtgcttagcactgacataaccctgaataatcctgcagttattattcctgctttacatgttctgttgctccaagggttaagtaagtggcttgtggttctaaagccacaaagtgatgaagttggaaatgaaatgaagttggcctggcttttgaagcctgtgccattttcattacacactctgacaccttgtctttgctgcctctgactttatggttcaatttctgtccatttttgggagttaagtgcctgctaacctgttcttgccacaatgagagctaataaaagatctgaaattgacaaagtgtggcattttagaaagaatatttttaatttgtaatccaaacatctgggtgaatcaaactttggctatgtaattttatatttttgtgacttggggcaagccttttactgtgaaaattatttattttgagggtcccagtttctgaaactgcaatcatgtgaaaatgattttaaattgtcaagtgcaatgcaagtagatgatgatgcaatcttaatgtgaatttaagtcaatgtgttgccttctgtaggattcttaacatttgaggagtttcaattacaatcattctattatatttaaatttattacacatcgattttgtgcaagtttttctgaagaattatagatatgtaagacctggagagacttaaagcagttcagagacaaaataaaagatattttgtccttcagaaaaagatttttctgcagtaagaaccagaagggatatatgcctgtacgacagaaagatcattctctaaatgtttttcttagggacaaagagaaatgctgatttgaaacaaagtgtcgaataccttcagtatgcagtgttggcattcaaaagcttcagtccattgattctgtatatagccttgtatttagtatatttagcaaaggggaggttcgtgttcagccacaaattcttcatctgagtcacaacctaactttggtcaattgacttattcttacttttcagatagggaggaaaatattctttatgccaaaaagggaataacattatcacaaataaaggaatactataaagtgccatgagctttgggaatgaaatttgctgtgatatggatatccgtgagctttctacactattatggtaatttcagtgacatcactccttagaggcctgaaagggaagctcagtcatttaaaaataaataaataaaacaattatcaggaaatagtatcttgaatataaaatgcacaaactgcaaaatgtaaaattagattaagccattgactgcctttatcccagcccttgtggatagacacgtggctgttagacacagtttgcaatttccacctttgtgaacagtagaaagcttagaatgatccaaattggagtactcaaaagattctgcaccttccgctgtttccagaattgtgactattcaggggctgagtgccactgatcaggcatcagtcttgcaggtatggattagccaacagtaaattcactagagcatccaagagaaatatattaatagaaattgctctttcagttttctaatgagcttttaagaatgaatatgcgcattggagcgtttgttagttgaacactcactaaagttccctacacattcactgcaatgcaatgtcaagagaaataaaaatttgcagatttttttttaaccagatcattaaaattgctctttttgtaacttcctacagctgaaggttgttttttcttttgtcccagtggtgggtggtaaatgaatagtatcaaacaacttgagaatgaaactagaggtaaaactagccagaccccttaactcctggatcagaaccagacaatactatgcaagaaggctcaattcccagcagcttcacgatccaaaacatctgtttctgtatttggcacaattccacttttttatttgtaaaattgttcccatctttgaaaacactttaaaaaataaagaagcccccattctgtctccctttccacttcccagcacatgcatctgtaattacctggtttagtctgtgtgtttaatcagtttaaattgagaatgttgcatacatctgatttcaatctgaaggagccattgagtattggacagttaccaccctgtgtctgccaaaacgtgcctctgccaaaaaacggataggactcacaccagggtatttcctaaagaagccacttgactcagattagatgtttaatttccttaaaatattgttttggatgtgagtctctgttctctaattggaatattctgatgtaatttaggaatatagcttatttgctgagtttgttccaggatccagctggcattattctaaaagcctaaacctcaaggaagttaacttcactctgagcactgagtattatacctcacagctttgaagggtgggccaggcccacgtttgctcacgtctttgtggaaccattgtacatgcaatgcagttgaattaattttgagagagaaaggcttcttgttatggtaatgagacttgcgatcagagcttcacatcttttgagatagtttcttaaattaattgaagtaggaaaaaattgttttgttctactactattcattcaaattttaacttatgacattttttgacatatcaaccaagtttctagatttcctcagcaatagtcacttaaaacacctgtcattggccagagtttgagattttaagtttttgttttgtttttgttttgtttttccgtgttggattgtaatttcttttttatttctgttttttgtttgagcttttctgctcaacatagcaatgtctgatggttaaagaaataagaacgtggagctgggctctttctaaaagttttaaattggagttcttgagttcaaaggctttcagcacatgccagcctctgggagcccatttatttgttaacaatgttaggatggctgctaaaaattcccttgcacgttttgcacagtggtaaagccatacacagggtgatgggctgacgtttcctaggagtatagtattgtcagcagctcatgagcttaccttaagccacacaaccagcatgctggaagcaaagcaaatgtagagaacacagtagggagacctgtgaatacctatgtcagggctttaaaaatctttcttatcacacaagcacatagcgtcagctgtttggggttaccagattgtagtcagaagtttgtttttcaaggacataatcaaaaccaatgaagttaaagaataaaaagttgaatgacataaagctaagattacttactacagttttgcataatgggatcggtcttgccaaagaaactaggaacatttaaacatttaaagtcagctttgtgaggtccccctccccaccacactcataggaggatccctgaaggttagtttcttcctcattcctccttgcctgcttagggcctgtccccaaaaggtgctcttctgtctctggtatgtttgtgctctaattcgtgatgcatttatcttaaagtttaaatcctggtggcagcctcagtcccacttttctcatgtcttgcaaaacactgcccacaactggcagtgaacttactagggtttgagttttgttctcatcactcccaaatgagccccagttccctctgcttttctgacttcccagagttgctgaggcacacaggagcagcagagcagctccgttggctggaaagaactgtgtgcaaatagaattgttatttggctggttttagcatttctcatttctcaaagccaaataaggcgtagtctaattcattcatttcacaaatatttattgaacacttctatctatcaggcacccattctgggtgcttcagatacagggagaaaaaacaaactgaggatcctgtcctccagggagctgaggtaaagggggttgttttaacacagtcctagcatttggttgtaaggttcactgaatggatgcactgaaagaactaaagacatagagaggttaaaggactttgcctcaccttgtctagtctgaaggagcagggaatagaatcccttatctactctattatatttatttgaatccaatatagatatggttctggtagtttctttgtgattccttttggtatctaaaaggaagaagcttctgctcagatatatctctgtgtctgactattgtggtataggtattgggaaaagatttggaaatagtaattgctagtcagtatgagtgaagggagaatttacatacaaagataaccaaacctaaaaagaaaggatgttatagtaagaacttaaaaagtcttcaactgctttgtcagatgccatagtagttgttggcagagcagtttggacaaccatcccatcaaaacctgcatcttctgtgtttagtgtttgtatccatacgtgaacacctggatttttcatcctgactgtatagttcttgaaaataaggctacagtgatgcctaacatatttgtcagactattgtcttaacagtgtattaatttgggatcttgctttcttctgccttctcctttagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggttta

SEQ ID NO: 13160 - DNA, 11185 bp, Human
ggctgaggcaggagaagcacttcaacccgggaggcggaggttgcggtgagccgagatcgtgccattgcactccagcctgggcaacaagagcaaaactctgtctcaaaaaacaaaacagaacaaaacaaaaattagccaggtgtggtggcgcacacctgtaatcccagctactcgggaggctgaggcaggagaatcacttgaacccaggagatgtaggctgcagtgagccgagattgtggcactgcactccagcctgggcaacagagtgagactctgtcaaaaaaaaaaaaaaaaaacgtcagattcatgaaccccatttgctaagaagatttgctcaggtagtcacctgtacccctgtgagccaagattgcaacagtacatgctaagagcagtaagaaggagtttgtaaagcttagaaagacctgacaggccaggcgctgtggctcacgcctgtaatctcgacacttcgggaggccgaggcaggcggatcaccaggtcaggagttcaagaccatcctgaccaatatggtgaaaccccgtctgtactaaacatataaaaattagcttgacgtggtggcccgcgcctgtagtccagcaactcgagaggctaaggtgaggcggaggttgcagtgagccgagatcgccactgcactccagcctggcggcagagcaagactccgtctcaaaaaaaaaaaaaaaaaaaaaaaaaaaagacctgacaagtgaaagctactaatattgccattatcatttaaaaaaaccccagacacaggtttttcagggagtttcatccaaccaggcaggtctcagaaatcagaaaagaaatggaaagggtaggaaatctggagtttgacaattctgagtttgaatttcttgtgatgggatcttgggcaagtcatttaacctccctgagtatcatttttttcttttataaaatgaagatttttctctcttaaccttccagagctgttttaaggattacaaatcttctactgaaaggcgtagcacaggagctgtgcttggcaagtgccaaatacaaggcattaattattattattagaattaataataatatcccctccctcttacacattctttgtctccgggtggattaaaaggtggaaggagaggctaccaacaccatcagaagagaggcttctctctaagtttcatttcccatctcctccaaatccgcatccctcccaaacgccggacctgtaaggccagcagggtccaagacacacatcctttgcccagcggggaagattaaagctaaagctcagagagggaaaacatttcctaagctcgcacagcgaatcaggacagaaaccaggacgagcctcggaatccctccattacctccactttcacctgagcatcacagcccgctcgggactcagtttccccacctacgtgaccacaccacactaatcagggtctccttttggagatctgctcttcttctcgaatgggggcgctgcaccatcggtagaacagggtaggtgggggcgccagaggtgaaggggacctgcaggctggggtcttccccgcccgggtcagcggggtccctgcggggctagtctaagcgcctattattaccagcccccggggcggcgttgcactgcgcaggcgcgggcggggcgcgggcgcgcgcgcgagcgagcgagggattccctctgacgtcattgctaggataccaaacaaacactccgccgcgccggccgagctccttatatggctaattgcgtcacaggaactccgggaaggcggggccgggatcccctcccgccgagtggcccggaacgcaacccccgagacccccagggccccgagggtcatgcaagtgaccagatcgagtctagaacagacctcttgctggacagtgcgggactcgatttggcggggccggagatttggggaagtttgtccagcaaggggcgggtgacgtaagcaggggggcgggtcccgggcatataaatacaggctggcgggtctgtgcttcattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggtaagtttttgatagtaggggtgctgctttgtaggttttattttttaagtcaagggtgaaaagaataaaccccaacccccacaaaaaggcgcatcagaaccctagatctgagatggaaaaggctcacagcgcactttgcaaactgcaaagagtcgggagatgtttgcaattggttgcgtgcgtggagcgcaaggagggaacgcggcagggagggtaggctttggggcgaggtgggggtggggtgggtaatgcgctgctcaatgcaacgtgtatgcggtagcggggctgagaactttgagccggccccgggactgccccctgctcgggtcccagacctgaagctagcgcagttaggcaggtgggggaaatcccggggaagcttccagcagtctcttttcctttcctcctccttcggagcgcccacttcggtgccgggtcgccctccacccatcgggaagaggggcctcgaaccctcagccgcgctgcctccgcctcctgcgcggagacgtaacgggggacccgtgcgtaacggctgacgcgctggaatcctccgtctgacgcggggcacgcacggcgcgcggcgcccccttcgtccgccccgcccctgacgtcccgggagcgttctattttggaacgccggggccacgttgctaagggagggggcagcccggcgtttcgattggccgccggggcgcacgccttggccaatcagctttcccttcctatttgtagggtgcattttccttcccccctctctgtccccggaacccgtggttccttggcggctgggtctcttttcggcgcctctagaggcagagggaggggatccctgtcgtgacaagagcgcctgtctgcgacccaatggatctgcgaggcccttgcggggatctagtccctgggctctcaggagaagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtctccaggagctccgccccctctgggttcccaggactctgattggtcggcgagccagcccttccctcaccacgccccccgagagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgttgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcctcagtttctccatctctgcaaaccctcatcaaatctcccgggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtgatcccagcactttgagaggccaaggcaggaggattgcttgagcccaggagtttgagaccagcctgggaaacatagggaggacttgtctctaccaagaaaaaaaaaaattagttgggcatggtggtgcacaccactgtggtcccagctactatggaggctttagtgggaggatcgcttgagccgaggaggtccaggctgcagtgagccatgattgcactattgcactccagcctgggggacagagcgagactctggctcaaaagcaaaacaaaaccaaccacataacgattgttcattcattcaacaaacctcctgcacaccagaaacttccccataaacctggccccttctgtaccatcctttggacagatgggggaaactgaggttcctggaaggcaagacccttgccccaactcccatggccaccaggactccatctcaggaggtgttttttctcagcccggggctgccttccagcagcaagtccaagggagccatgacccgagtttcccggtcactgacatgcttttttctccttcctctctctcttctgtgacctggcctccctggcctcaggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgcattcgccaggctacagtgtttatttcctcctaacacccattgcctggcttccttttagtaagagaggatgaggttagattgtcgaaggactacacacacacagagatcatacacccatgcacacacacacacagacacacacctatgcaggaactccttctagtcaatgggtctacagcaggataaaaggaaggcagacagtcaggaggacttcctgtactcgcaggcagtgcctcctactagaaaaagtaagtggctacagctgggcgcagtggcttgcgcctgtaatcccagcattttgggaggccaagatgggcggatcacttgaggtcaggagtttgagaccagccttgccaagatggtgaaaccctgtctctacaaaaaatacaaaaattagcctggtgtggtggtgcacacctgtaatcccaggctacttgagaggttgaggcaggagaatcactttaacttaggaggcagaggttgcagtgacacaagattgcaccactgcactccagcctgggtgacaaagtgaaactgtcaaaaaaaaaaaaaaaagtaaggggtcagaaggttagcctgcaggtgtgggatcacagaggtctcctagtgatggagcttgtatgctctatgggttaaaaacagacgctaaggagataaactatacacagaagaagcttaatgggctgtgcacagtggcttgcacttgcaatcccagctctttcggaggccgaggtaggaggctaggagttcgagaacagcctggggcaacatagtgagacaccccccaccccaacccatctcattatgttgagaaaaaaaaaaaaaagaggatcttgagaaacttgcacagcaaactactaaagaccactcaggctaggaatgaggcgtcatcttggattttttacaaactacaactacaaaaaacaattattttacactgaagatgtgtttccttttgttttccatatgaccactattggggccaacccaagactgactgaagcaaatatatgaccattttttttttttacacatagagtggagccatccccattgcaaaatcctagccgtctcttatttgcataacagcaagtcctctgggaattgaggtgagggtccaggggtcgctcagacgctttggtaaatcaataagcaagggaatttgtcatggtggaatccatttattaattcactcaaaaaaatgtgctaagcacctacccaactgtgctgggagttggggacactatagggactgagcctcaggtcttgccctcctggggctcacagtccattgggggacacacaccgttgccagtcagggacaacctaaagtggattgggtttgggaagcccatggggctagggaagcacagcagggacacctagcttggactgggagtcgggaaaaacttcctggcggaggggacagctgagctgagtcctagaggaggatagagagtatagaaagaaatagaaaaaggccaaggccaagaaaatagcacagccatagatctgttggtggggagaaggcttgatacattgagaacgcttagagggtcgggtgcgatggctcatgcctgtaatcccagcactttgggaggccgaggtgggtggatcacctgaggtcaggcattcaagaccagtctggccaacgtggcgaaaccccgtctctactaaaaaatatatatatatatatacaaaaaattagctaggcatggtggtgggcacctgtgatcccagctactcgggaggctgaggcaggagaatcgcttgaacctggaaagtggacattgcagtgagctgagattgtgccactgcactccagcctgggcaacacagcgagactctgtctcaaaaaaaaaaaaaaaagaaagaaaaaaaagagaaaactcagagattcgtggagactggaaccacgggtgtggagagaggggttagtagagaccagattctgcaggtactataatgacattcccaggctaaggagtttagatcttttct

SEQ ID NO: 13161 - DNA, 15661 bp, Human
gcccgtttccacgcggggccagagggagcgcaggcgctcgtcggcgctcaagaaggctcggcgcagcgcctcgcgcacgccctcgggctcgctaggctccgggcccagctcctggagcacatggcctggcaaatggcgtgcaccgaagcgggcagctcgagccccaccgtggccgtcgaggacggcaaacaaggcccagcccgggggcagaccaggtaacgaaagccaagtgcagtgagcatcctccatgcgcgcgcgccagccttgcgctgcgctcgccccgaagcgcaggcccccagacgcctcggcacccccgtgcggccgctgggcgcggcgcggcgctgtcaacagagaccgaggcccttcgggggccctgcgccccgcctcctcctcctcctcttcctccctcccctccttctccctctcctttttcttgcaagcggtccagaggagacgctgcagctggcgggccaggaccgccatccttcagccctgggatcaggaaggctccaccctgtacacctgcccgccccctccattaatcccctccgctgtgagattttaaaccatctaaatctccttcctgtcctttgacctgctctttaggcgggtcactagaaggaattacacttctgggtctcctgtttcctgcacctacaaagcggggtttgggatctgaatcaggaaaaaaaaagaaaaaagataatactgtaccagtggcaaactattacatagtactaatgtgtcacacactgttatacatcatcatctccagtttacatatggaagaagaaacagagtcacagaagtaaccggtgttccagggaaactaattctagaatctgtgttctcaacacaacactcagtccaagctcctcccacctcagtggtacagcccccagcctcaaaacctgtaaataccatacttggccgggcgcggtggctcacgcctataaccccagcacttagggaggccgaggcaggcggatcgcttaagcccaggagtttgagaccagcctgggaaacatagcgagaccccgtctctacaaaaattaacatttagccaggcgcggtggaacacacctgtgatcccagctactcaggaggcttaggtgggaggatcacctgagcccgggaggtcgaggctgcagtgagccgtgatcgtatcactgcatccagcctgggcaacagagcgagaccctgtctcaaaaagatatatatatatatatatatatatatatatatatatatatatacatattttttttttctttactgtttttagttcgacccctcccctctggggcttcgcttattttctcttccaggccccgcccatccaggattcaggcacacagctccagacccttctaattttcgcagacctggaatcgcctggaatccgaccccacccagttatatttgaataattccctgttgctttagccctgcccacgtttgagctcctccgcgtgccccaaaagtttctgaatcgtttcattcggccccctttctcgctccctctgcaaatctaggctcggaccctacctcagagcattagaatctttccaccccctcctcaatggcaccccgagcaccaccccaacccacccagggatccacgctctcatcctctctgccgtggctcgttcaccatcctctcccaagtccctcgccagactccaggcctccttccctcttcccctaaaggctgcgccctctgcgatctaggccccgcccttcaggccgctttcccctccttcctggctccgtagcccaccctcttggttccgcccctttagtaagaaggccacgcccctccgcctgatcctcggcgtttccccgcccctcaccctccctctggtaccgccccgcccgtcttctggccccgcccccggccgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcagtgagtagaggaagactggggcctggtgtgggccccagaggttcaggtggggtactccccggtgtcccctcggcgcttgcccgcaggagagccgggatggggggaggaggcataggagacaaaggaagctctcccctcccccgcgctctggcggcgacgggggtagcctgacccggaggacctggacgaaacagggcggaggtgagggggcactgagacagcaggcggggggcgcgctgcgctctgggacgtaccgcccggccccgcccgggagcgaggacgcgcgcggggagctgtcccctggctctggtgctggccgcagctggcggggagggggttgaacggagggtagagccaggatggaaaacaggggtctggctcccaatcacttgccttcgcatcccatccccgttttctgtccaagaggcagccccgacctcgcccaaactgtccaaccctgtcccgggaaaacagccatccgtggtttgggggcaaggactcatgggttcttagcggtctttaccactggttaatggtaatcctggggaagacccacaccattccaggcctcctattccccagctgaggaaacgaggtgagggcacagggcgtcagatttcaatttccaaaccgcattgagcatcatctatgtgcaaagctctgaactagctctaaggggctggattcccagctgaaaacgcctagcctcacaatctctgagctcacagctataacagtccatgtctaccgttctctgtcccacacatgggggttctgacagctggggatttcaacacccttagatctagccatttccatgtctcgcgtgtccagatgccaaaattctaagaattggtgatttcagcattttcgagtatcatcccaacattctatgatcttgtcgttaacttcagattacaaagggaggaccacctcgtctgtctctccccaccgcccttacctctctgttctcacctcccactcctctcctcctcagtcactcttctccagtcatatcttcgcacctctcagttcctcagatgccaagcatggtgcctggctcagggcctttgcactggctttcttctctacctggaagacgtccctgaacatctgcatggcttcctcacttccttcagatctctgctcaaacgtcatcttatcagagaagccttcttgaccaccctatgagaaacagcaccccttcactttctcttcccctacccttctttactttgctccctatgctcatctgcacccgacgtcatatattcacttgtttattgtttgtctatcccaaagagtgtcagctctaggagggcagggattttgtctgttttcttcacagctgtatccccaggacctagaacagtgcctggcacatagtaggtgctcaataagtggttgttgaacgaatgaatgaattgaaacctcctaagattcctactttgaagactctaagattaagattcctggatttggacttcaaagactctgagcttcatcaggcagtgatgctaggttttagagtctgtgtgcagaatgttctaaaaatcccgtgattcaaatattctaagattccaggactgggacacttctgtgattcggacagtctaagcttctaagagtcttcgattctttccctctcgcagaagaagctccgtctacagcctcctcaactcctgattccacagaaggtaagtggtggggagcatgtgaaggggctcagggctgggcagctcagggacctgctgagggaaacaaggctctccttcacccactgcaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaaggtgagatgtccgaggtgctgggaccaaagccaagaggggtgggtggtttctccttggggcacctccaagaagaaagctcacggcctcctctctctaccgtatcagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggtaagcaacgtgtatgaagatgctgcattggcccacagaaggcaaaaggtgagaggattttgaattaaagggaccaacctcgcaaaggaacagtacatagtggaaaagggaagagatagacgtgatatcacatctggctagacgtgataaactccgctttttaaaaaaatttccccggccgggcgcggtggctcatgcctgtaatcccagccctttgggaggccgaggcgggcggatcacttgaggtgaggagttcgagatcagcctggccaacatggtgaaaccccgtctgtactcgggaggctgaggcaggagaatcgcttgaacctggaaggcagaggttgcagtgagccaagatcgcgccactgcactccagcctgggcgacagagcgagactccgtctcaaaaaataaaaataaaataaaataatcctccctcttctggagtgctcctcctagtggctgattttggacaggccaaatccctgaaaaaatacagttctctccttatttagatgtggccgtagaatatttataagtaaactctgtgccttttaaaaactcttctttttggccgggcgcagtggctcatgcctgtaatcctaaacactttgggaggccgaggcgggaggatcctttgaagccaagagtgcaagaccagcctgggcaacatagggagactcgatctctatttgaaaaaacaaacaaaaaccctctttttcctgaccacatctattggccagttgtaaaatgacccagccttactttaaaatatgctccgcctccaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaaggtgggcttgcggaacgggctggacgggggctgaggtcggcggaacggggtccaaactcgcccttatctcctgcacatccggagcatttttattactgatctgcttccgcagcgctgcaggctggggctagggggccgaggggcagtatagggaggacccagagggagcatggggtcccttctccttcgagccagcactttggggcccaggagcagggaggaccccctcccccagcctcggccccaggcagcgctgtcactcaggggccagacgggccagaacagctgcggggaggccccctccccccagcgtgcctaaacttagcccccgcctcaggcgacctggcccctcccccatccaccggcgccggccactaggagcctgcctgggagggccctgctatggggagggaggggctgccctatttggaggtaaatgagaggagatgcattggaaggagacggaagtgaggggtgagcctctaagagggaccggtcggaggggtcagttggagggagtgtgggaggatagagaggatctggaaagaaatagaaaggtactgagttcctggttttcaggactcaaaggaaagcagattactaaagtttctttttctttttaagccacagagtctccctctgtcgccctttctggagtgcagtggtgggatcatagctcactgcagcctccaacacctgggcacaagtgatcctcccacctcagcctcccaagtagttgggactagagccacaggccaccacgccctgctaattttcttattttgtttgtagagacagggtctcactatgttgtccaggcctcaggtgatcctcccgcctcggcctcccaaagtgttgtgattacaggagtgagcctaaagtttagacagatgagatgaaggttggggtacaaaggtcactggtcagggctgaggttgggtttaggaggtgtgttttagggtctcagaaaggggtcagaaatttgagttaggccctggaaaggagtatggcgtgattaatacatttaggacttagaaacatgtgttgctaagggtatcaaggggatatcactttacacctgacagattggcaaaagttaaaaagaactgcaacccactgcagggcaggatgctgggaaaagatctttctcttgcttcttgtggaaataagaactgttatggtcttactagtaagcagtgtttcaaaatttatgacattaaaaaaatatatatgaccgagcgcggtggctcatgcctgtaatcccaacactttgggaggccgaggtgggaggatcacttgaagccaggaattcaacctgggcaacatagcgagaccctatctctacaaaacatttaaaaattagccaggtttaggaggtcgaggtgggcagatcacaaggtcaggagatcgagaccatcctggctaacatggtgaaaccccgtctctactaaaatacaaaaaattagccgggcatggtgacgggcgcctgtagtcccagctactcgggaggctgaggcaggagaatggcgtgaacccgggaggcagagcttgcagtgagctgagatcgcgccactgcactccagcttgggcaacagagcgagattctgcctcaaaaaaaaaaaaaaaaattagccaggccaggcatggcagctcatgcctgtgatcccagctagttgggaggctgaggcacaagaatctcttgaactcgggaggcagaggctgcagtgagctgagatcatgccactgtactccagcctgggtgacagaggaagactttgtccaaaaaaaaaaaaaaaaaaattagcacgatatcgtggtgccacctgtagtcccagctgctaggaggccgaggtaggaggtttgcttgactctgggaggtagaggctgtagtgagccatgatcacgccactgcactccagccagggtgacagagtgagactctgcctctaaaaataaaaaaaaaaaaaatgtggccgggcgtggtggctcacgcctgtaatcccagcacttttggaggccaaggtgggtggatcacctgaggtcaggagatcaagaccatcctggctaacacggtgaaaccccatctctaactaaaaataacaaaaaattagccaggcatgatggcacatgcctgtaatcccagctactcgggaggctgaggcaggagaatcgcttgaacccgggaggtggaggttgcagtgagccgagattgcacaattgcactccagcctgggcaacaagagcgaaactctgtctcaaaaaaaaaaacaaacaaacaaaccaaggtcaggcgtggtgtctcacgcttgtaatcccaacactttgggaggccgaggtgggaggattacttgaggtcaggagttcgagaccagcctggccaacatggtgaaaccccatctctaccaaaatataaaaaattagccgggtgtggtggagccctcctgtaatctcagctactcaggaggctgaggcaggagaattgcttgaacccaggaagcggaggttgcagtgagccaagattgtgccattgcactccagcctaggcaatagagcgagaatccgtctcaaaaaaaataaaaacaaaaacaaaacacacacacacacacacacacacacacacacacagacacacaaccagtccacccagcaattccaccctgggaatctgtctcagaaatagtcactccaggaggtgagaatatctgttggaggatgttgcttgcagccctgcttgcggtgaaggggttaggaaacaaactgaatgacccagcaataggtacatggttaaataaaatgaatgagagcacaggagcacagccacaacacagaatactatgcagctctttaaaagaatgaattaaggccaggcgcggtagcacatgcctgtaatcccagcactttgggaggccaaggcgggtggaccacgaggtcaggagttcgagaccagcctgaccaacatggtgaaaccccgtctctactaaaaatacaaaaattagccgggaatggtggcacatgcctgtaatcccagctacttagaaggctgaggcaggagaatcgcttgaaccagggaggcggaggttgcagtgagtcgtgattgcgccactgcactccagcctgggcaatagagaaaaaaataaaaataaaataaaataatttttaaaaaattgcaaatcgggctgtgtgctgtgcctcacacgtataatcccagcactttggagggctgatgcaggaggataacttgaggccaggagttcgagactagcctgggcaacacagtgagagccacctacctctaaaaacagaaacaaaaacaaaaattagctgagtggtggtgcacacctgtagtcccagctactgaggaggctgacgtgggaggatcacttgagcccaggagatcgaggctgcagtgagctatgattgcaccactgcctccagcctgggtgacagagtgagaccctgtctctcaaaaaaaaaaaaaaaaaaaggaaatcaggttatgctcaaacaggtgtgtcgagaagtcattttcagctgtaggacagggaaagggaggtgaggagaccagccaggtcaggtacaagccctgatgccccccacccctccacagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccagtgagaacccccggcccctgacctgagcccctgtcctgaccctaaagcatgacccacgacctcaaatcaggcaccgactcccacccggaccccgactcatcttgatcatttttcatcccgatcccctaacctacccttcaatcctaatctctgatcctaacctggtacccttcatcctcgatcccttcccctgaccctgaccctgaccccagccctctacatgtgattcctctgagctgcccctcagtcctaactctggtcttctcccaaccgccattcctctcccttgtttcagctgcccctgcaccagtctgagctggtcacccactgagtcgccccacactcctttgtccccgcagggcctacctggatgtggacctcaccctgactcgggagcagacggaacgtttgtcccaccagatcacctcccgcgtggtctcggcggccacgcagctgcggcacttcttcctggtagaagacctcgtggattccctcaaggtggcctggagctctcagcccctcctgggttcccccattcacctctgcatggctagggggtgggagggcgactgttgggtaaattcacagcatgagagggaattcccggtgggctctgctgaccctgaccttcacccccagctggccctcctcttctacatcttgaccttcgtgggtgccatcttcaatggtttgactcttctcattctgggtgagctgggaaggccgtaaggggcaaatggggacttggagtctggtgggggacagggctccagatggaactgttcatctcttgggaacaccctgacgcccccatctctgtacccacaggagtgattggtctattcaccatccccctgctgtaccggcagcaccaggtgagtgtgacaccctcagttgtcagcaccccagctaaacatgggggtctgaccatctccttccagaaccggggtcccattgacagatgtcccggccagacacaggtgtcctggctgcagcaccttcccaatacaaccagagtctaagtaacatgtcttatcagcatcagccagggacaggctttttgtttgtttttgttttgttttgggttttctttgagacagagtcttgctctgttgcccaggctggagtgcagtggtgtgatctcggctcactgcaacctccgtttcctgggctcaagcaagtctcctgcctcaatctctgagtagctgggattacaggcatatggccaccgtgcccggctaatttttgtatttttagcagagacggagttttgccatgctggccaggctggtctcaaactcctaacctcaagtgatctgcccaccttggcctcccaaagtgctgggattacaggcgtgagccactgtgcctagcctttgctgcctttttttttttttttttttgagatggagtctcgctctgttgcccagactggagtgcagtggcacgatcttggctcactgcagcctctgcctcccaggttcaagcgattctcctgcctcagcttcccgagtagctgggatcacaggtgcctgccaccatgcctggctaattttttgtatttttagtagagaccgggtttcaccatgctggccaggctggtctccaactcccgacctcaggtgatctgcccgcgttggcctcccaaagtgctgagattggccttcactcttgattttaactgacatgtcagttaaatgctactgcattccagcctgggtgacagagcaagagtctgtctcaaaaaaaaaaaaaaaaaaaaccaaaaaataaaaaataaaaacataaaaataaaatcaagagtgggatggctgttgcccacaagactgacattagcaggactgctgacatccatcctatccagagacaggcggatggactgacagccccttctccagcacagctgggagccacatgataatatgccctgccagttagtcctaactctgtccttcacaggctggaatcaccaagactcacaattaaactgtatttaaatcaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaaggctgggcatggtggctcacgcttgtgatcccagctttgggaggctgaggcaggcggatcacttgaggtcaggagttcgagaccagcctggccaacatggtaaaaccctgtctgtattaaaaatccaaaaattagcaaggcttggtggtgtccacctgtaatcccagctactcgggaggctgaggcaggagaatcgcttgaacccgggaggcagtggtggcagtgagctgagattgcaccactgcagtccagcctgggccacagaacaagactccgtctcaggaaaaaaaaaaaaagaaagaaagaaaaagaaaaaaaaaagaacaagaaaaaaataaataaataatccaaaaattagccgggcatgttggtgcacacctgtaatcccagctattcgggaggctgaggcaggagaatcgcttgaactcaggaggctgaggttgcagagaaccgagatcatgccactgcactccaggctgggtgacagagcgagaccctgtctcaaaaaaataaatacaaataaataaataattttttaaaaaacacgagtatataaatcaatccactcagggactcggtgaccaatgccagtgccttctgttctcaccctaccccacaacacacacgtatgcaaactcactcaaagattaaccatcgtgcccaggacacggcctcactgccagatacttgtgcgttccacctgacatcactctccatacagagtatggcccaactcactgaccctataactggcatctctggcatctaatgtattctatgaagtttagagccgggggtggcgtggtgggccactcttcacaactcctaatttggaggttggggaggaagcagcctcctatgtgactaaagagaagaaacccctccaatcccttctttcacctttctttggtctccccaggctcagatcgaccaatatgtggggttggtgaccaatcagttgagccacatcaaagctaagtaagagcatggggcggaggtcgatgggagggggaagtgggggagcttgggaacctttcctttctactctcgctgtccgcaaatctcctggggtaatgtccccttgaaaaggctgaggaggcaattccaatgtaggccactaggtggagggcaggagctggcttcgggctcttggtcagtttcccacccagctttccccgttgtccccagatgcccaccccgcgtctcttgccccacctcgtgatcccacctgtttctccttcaggatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaagattgcgccactgcactccagcctcggcgacagagcgagattctgtctcaaaaaaaaaaaaaagaaagaaatgattgaggggaagatgctgacagaccacccattccagggttagccaagccttggcagccacttcccatgcctgtgctcaaggcagacatcactaatggatcccacaccctgcctactgtgcagccacctcaactgagcccaaacccacgtgtccaacggcctctggatgccccttccaccctaaatctaaccaaacgtcttcttcatcctacctgatttccaactcagagatgttttcactgcccacggtgtcaccaggccagacacccaggtatggctctggacttctacacactcacctcccacaaacaatcagtcacaatgctgtgtctatcctgcctcacaaacttctctcatccacccacgtctccccaccctgattgcctcgggaacaaatacagggcctccctggacttccagtttcaacactaatctgaggcctggcatgatgactcacatctgtgatcccaacacttcgggaggccaatgtgggaagatcacttgaggccaaaagttcgagaccaccctgagcaacataacaagacccccgtctctaaaaaaaaaaaaaatttatccgggcgtggtggtgcatgcctgtagtcccaggtacttgggaggctaagacaggaaaattgcttgaggccaggagttcgaggttacagagagctatgatcacaccactgcacttcagcctgagttacagagggagaccctgtctctaaacaaaaacaaaaacaaaacacaaaaaaactacatactgggcgtagtggctcacgcctgtaatcccagcactttgggaggccaaggtgggcagatcactgaggtcaggagttccagaccagcctgaccaacatgatgaaactccatctctactaaaaatacaaaaattagctgggtgtggcggcgcatacctgtaatcccagctactcgggagcctgaggcaggagaatcacttgaacccaggaggcagaggttgcagtgagccaggatcatgccgctgcactccagcctgggcaacagggcgagactctatcaaaaaacagcaacaacaagaacaacaacaaaaaagacaactaaactcggaaaggatgaagcaaagggacccgtggggagactgggagaacactgaggtctaaagatccacagacttgggtttgaatcctggctctactaccccttcgctgtatgaccttgagcatatgacttcatctctcaaagcctcagtttcctcaaatggaaaacttattaggccgggcacgatggctcacgtctgcaatcccagcactttggaaggccaaggagggaggatcacttaaggccaggagttcgagacaagtttgggcaacatagacctcatctctacaaaaaaattaagtaagaaaaaaagaggccaggtgcagtggctcacacctgtaatcccagcctttgggaggccaaggaaggtggatcacctgaggtcaggagttcaagacaagcctcgccaacatggtaaaacctcgtccctactaaaaataccggatgtggtggtgggcacctgtaagaccagc

SEQ ID NO: 13162 - DNA, 13335 bp, Human
ctgagtagctcagactacaggtgcacaccaccacgcccagctaatctttgtacgtttttgtagagacgggatttcaccatgttgcccaggctggtctcgaacacctgagctcaagcgatccattcacctcagcttcccaacatgctgtaattacaggcgtgagccaccacacccggctgtaccaagccctttaggtgcccagattcatgtgcccctcccccactgccctggaggtggggactgtcattttcccagttcacaggcaagaagaggtcttgagtgggaaggtcatgtgcctgagtcacatgaagtaggtggctcagtggggatttgaacccaggtctggggatatcagctcctgaactctgcaccagtttactgacacctcccacccaggctaagtcagacgttgccttttccaggaagtcctgcctgactctccaggctggggcaggcgttccttcagggcacccccagaccctgggctccttggtcctaaacctgggttggtaccgtctggggacagctgtgtctcccacactggactgtgagccccaggagggtggtgccggagctgtctgggtcactgctgtgtcttcatccccagccccacccaatataggccagacacagagcagggagtatctggggaatggccgctagtgccctggggagccaggcgatgggtgggcagcgggaagtccctttggaggaagagctcagaggtctgggatgggtccccaacctgctgcaggcctcacacttcccctcccaagcctcagcttcttcctgagcaggcagtggtggaggggggtgcgtagagatagggaaactgaggtcaggcaggggctggtccctagtgcagctctgggctcttggcctccttctggcccctctgtcttccctcctgccctctgctctgctaacccgcatccccccactggcattggcctcggcctcttacacccctcagcctgtctctccatctttatcttttccttcttattagttttgttgtgttgtgttttttatttttcattaaaaaagtttttttgtggactgggtgtggtggctcacccctgtaatcccagcactttgtggggctgaggcaaatggatcacttgagcccaggagttcgagaccagtctggccaacatggtgaaacctcgtctctactaaaaatacaaaaaattagctgggcttggtggtgcatgcctgtgattccagctactcaggaggctgaggcggagaatggcttgaacctgggaggcagaggttgcggtgagccgaggacagcccgggtgacagagtaagactctgtctcaaaaaaaaaaaaaaaaaaaaaaaaaaaagattagtcgggtgtggtggtgcatgcttgtagtcccagctacttgggaggctgaagtgggaggatcgcttgagctcaggaggtcgaggccacattccaacctgggtgacagagagcaagactctgtctcaaaaacaaaaataaaaataataataattattattattattagagatggggtctcactatgttgcccaggctgctctgaaatgcttgggctcaagtgatcctcctgcctcaacctccaaagtgctgggattacaggtgtgagacaccacgccaagaccatctttatctctttctgtgtctgcctcttcctccaggtcccctgtctgcccatcctttttccccacccctcccccatctgttcatctgtctgtctgccttcagtctgtctctcctctttgtcaacccgactctccctttcccacctctctctgcgtctgtctcttgcatctcgtttgtgtgtttgcctgtctctcctgatctgattttctctcctgatctgtctcccccgtctccttctgtccacgtggctcctgcctccctctgtgtcactctcttccttccacacactgtctttgtcccttggaatctcccaggagagacccagataagaaggtgaccggcccctctcccttttcctcccgcctgcagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtgcagcttcccgccggccccctctgtgggctgaacccctacccgccccacccctgcgcccgccgcccctcacccccctttcccctcccaccaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggtcagaaatggcggcgggcaaaggggaccagtgaatgcggctgtgtggcctggggctgccgctttaccctgctgggacttggtttactcgtcggtaaaatagagcgaattcattgttatcatggaaaattatcactagcattttgtgcattccagtgtgactgtgtgcacctatgtgtaaaatgcaccattggcccggcgccgtggctcatgcctgtaatctcagcactttgggaggccgaggcacacggattacctgaggtcaggagtttcaccgtgcccaacatggtgaaattgcgtctctattaaaattcaaaaattagctgggcgtggtggtgcgcgcctgtaatcccagctattcgggatgctgagggacgagaagtgtttgaacccaggagatagaggttgcagtgagccgagatcaggccactgcacttcagcctggcgacagagcaagattccgtctcagaaagaaaacaaacacaaaaaaaatgcacgattactcagggatcagtactccatgaactttacacaggcacactcccgggaaaccacctcccagatcaagacataggtaggtcctgccccagaaacaggatctcgctctgttgcccaggctggtgtgcactggcacaatcatggctctctgcagccttcacctcctgggctcaagtgatcctcttgcctcagcctcctaagtagctgggaatacaggtgtgcaccaccatacttggctctttttttgttttgttttttgagacagagtcttgctctgtcacccaggctggagtgcagtggtgcaacctcagctcactgcaacctccacctcccgggttcgcgtgattctcgtgcctcagcctcctgagtagctgggattacaggcatgtgccaccatgcccaagctatttttttgtattttgtttttatttttatttttttgagacagagtctcactctgttgcccaggctggagtgcagtggcacgatattgcctcactgcaacctccgcctcccgggttcaagcgattctcctgccctagcctcccgagtagctgggactataggcgtgagccaccacacccgggtaattttttgtatctttagtagagacaaggtttcaccgtgttagccaggatggtctctatctcctgaccttgtgatccgcccgcctaggcctcccagagtgctgggattacaggcatgagacaccatgcccggcccttgtattttagtagagaaggggtttcaccatattggccaggctggtttcaaactcctggcctcaagtgatccacctgcctctgcctcccaaagtgctgggattataagtgtgagccaccatgtctggccacctggatcatttcaaattttttttttttttttactttttgtggagatggtctacaggctggtcttgaactcctgggctcaagtgatcctcccacttcagcctcctaaagtgctgggattacaggcatgagccactacacccagcccagttgcttttttttttttttttttggagacggagtctcgctctgtccccaggttggagtgcagtggcgcgatctccgctcgctgcaagctctgcctcccgggtaaatgccattctcctgcctcagcctcccgagtagctgggactacaggcacccgccaccacatccagctaattttttgtatttttagtagagacgggatttcaccgtgttagccaggatggtctcgatctcctgacctcgtgatccgcccgcctcggcctccgaaagtgctgggattacaggcgtgagccactgcgcccggccttttttttttttttttttttttttttttaatatggagtctcactctgtctctcaggctggagtgcagtggtgtgatctcagttcactgcaacctccgcctcctgagtttaagcaattctgcctcagcctcctgagtagatggaactataggtgtgcaccaacatgcctgtctaatttttgtagttttagtagagacggggtttcgcagtgttggccaggctggtctcgaactcctgacctcaggtgatccactcgcctcggcctcccagagtgctgagattacaggcgcgagtcacgcgcccagcccagttgctatttcttaaaccttaacgtgcacatgaatcacctggggatctggttaaagtgcaggctctggtgcaggtgggctgggcggactgagactccacattctcacaagtgccctggtgatacccaggctgctggtctgcggacgtgactgagtagtgaggttttaggtgactgccgtgcatctggcctggaatcactgctgtagaactgaaagtcaccaaatgcaggggtgtttgcttcgtgggacaacttctgtgctagtgcggaaggggcttgctcctctggggcacacagaaaaatacagtgggcttcagttgagtcatctgtaaattggggctaattcattgttaattcgtagccaattcaattcaggtgctagggccagaggcctggaggtaggtgaggaagaagctctttacctttccaggttcttaggtaaggtccaagtggctgtaacagtggttaagagctagccaggggccaggtgcggtggctcacgcctgtaatctcagcactttgggaggctgaggcaagtggatcacttgaggtcaggagttcgagaccagcctagccaacatggtgaaatcccatctctattaaaaatacaaaaattagccaggcatggtggcaggcgcctgtaatcccagctactcaggaggctgaggcaggagaatctcttgaacccgggaggtggaggctgtggtgagccgtgattgcactgctgcactccagcctgggtgacagagtgagactctgtctcgaaacaaaccaacagtggttaagagcctggctgctggaatcagcctgaattcaagtcttgttcctgcacattccaccctggagaaatctggggcaagtgactgttccccgggccttagcttctcctgtcactgggacatcacaacagcacctaccttagggcaactcaggccagggaagttggtgctgcctcacctcccaatgtgcgtcctcctgggcctggagcctcagggcctctggaaggaggaagtgagcgcctctgggcaggattcctgggaggcctgggagagcaagggaagcgccaagagctgagcagagttctgggactgatccatggccctttctctctcacctttcaggaggtgggccccctccacccccagcacttcccacctggtcggtcccgaacggcccctccccggaggaggtggagcagcagaaaaggtggggctgggccctgggtggggaaccttagccgctgccagagttccatatgttctggaacccttgactcctagagttcagaacccagccaacttgcagttttcagaatgttcaagaaacttctgacactcagagttgcagaacctcctggtccctgcagattcctggaaatcagaatatggtggttgaaagaatcttgtggctgggcgtggtggctcacgcctgtaatcccagcactctgggaggccgaggcgggcagatcgcctgaggtcaggagtttgagaccagcctggccaacatggcgaaatcccgtctctactgaagataacaaaaattagccggtcatggtggcgcccgtgcctgtaatcccagctcggcaggccgaggcaggagaatcgcttgaacccgggaggcagaggttgcagtgagccaagatcgagccactgcactccagcctgggtgacagagtctcaaaaaaaaaaaaagaaaagaaagaatcttgggcattttgtaattcggtgttcctgacagtttagtgactgggatctcgcatcctgatctctccctgtcgctgccctgccctccattccccctactctcacccagcccccttcttggttccctaggggaggaaggcttgggtgagtattaggagccagccaccctggagacctctgagagagaggacggaggtcgctggccccttcgctggccatccttaggaccctgattgacggcagctctctcgcctccccccacaggcagcagcccggcccgtcggagcacatagagcgccgggtctccaatgcaggtgatgctcagatagcttcgggagttgggagggggcctccctggaggaagtggccagccagctggacagtgaagaatgaggcttctctctctcagctgcccccttttctgtgtttgtttcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaaggtgaggggccgggagaggtgggcagggggcaacagggcttttatgggggatgaggccagggctgccggcggtgtcattgggctggaaggccaaaaggcctgcccctaaagctcctgccccttttaaatttctccagcaggaggaggcctcaggggggcccacagcccccaaagctgagagtggtcgaagcggaggtgggggactcatggaagagatgaacgccatgctggcccggaggtgagcctgagcctggacccccaagtcacctggagttccagttcagtagggcccagtcagaggagggctccaattcctgtttagtttgtttcttttggtgaatgttccccctttgataaccaggtttgggatataatggtggggtttgtcatgaaatgcctgaggcttgcaaccacctaggtagcctgtagatgttctaaaacccagaattctagaaccgtaggagatcttgcctcagaattctgggaactcaggttcctgcaatctcagtgttccaacacagcaccgctccaccctcggaatcttactgttccctaatataagaatcatagaacctcctccaccctgattctagaaccacaatctcttgaattttttttttttttttttttttttttttgagatggagtcttgctctgtcacccaggctggagtgcagtggtatgatctcggtccactgcaacctccgcctcctgggttcaggcagttcttctgcctcagcctcctaagtagccgggattacaggcatgagtcaccacacccggctaatttttgtatttttagtagacacaggatttcaccatgttggccaggctggtcttgaactcttgacctcaagagatccacctgcttcagcctctcaaagtgttggcattacaggccactgcgcccagcacaatctcttgaatttctaaaactagagtttccttaggttttcggagttccagaattctatgcgctaggatctacatttctagaactcccctcagaaggggatgggttgggtgacggaagcacgtgtttttgcttttctctcctgcagaaggaaagccacgcaagttggggagaaaacccccaaggatgaatctgccaatgtaagtcagggactcttcttgccctacatctcttaggccgtaccatgagggtagggatagtgggatgtgtggggtttgaacctgaaagaggaaatgggcagaggtgtggcaggggctggctcatggcagttttatttcctaccagcaggaggagccagaggccagagtcccggcccagagtggtgagtagagtgcccagtccagccacaggaactacaaatcccagaatactctgttctcacatgttaagcacccttataggagagtcagggcgaatggtgctggggattgtagtctcctgagatggggctttgatcaggggctgatgaggttgggggagtaagattgattggggggcagtcttttgtccctgatctttctgatttcttgcctatccccagaatctgtgcggagaccctgggagaagaacagcacaaccttgccaaggtaggccatcggtcctggggcccttggggaggtaaaggcgggcagatcgcttgagcccaggaggtcaagaccagcctgggcaacatggcgacaccccatctctacaaaaattagccaggcgtggtagcacttacctgtggtcccagctactcaggaggctgaggtgggaggattacttgagcccaggaagttgaggcctcagcgagccatcatcatgcctgcactccagcctgagaaatagaatgtgactgtctcaaaacaaaacacaacaaaccaaaaccaaaaaaaaaaaaaactggggccccaaaaatacttggacttgcccaatttataaggcagagctcaatgtgatccctggaataggaggcggggaagcaggtcctctctctaatctcattgctgtcccaaaccacaccaactcccccaggatgaagtcgtcttcttcggtgaccacttccgagacccaaccctgcacgcccagctccagtgattactcggacctacagagggtgaaacaggtaacttgggggggaagttggggaccacagcaagagagatctaggtctggcccctgccactggcatgccgtatgatcctagataacatctcagaaacctcaggtttccaatctgacaaatggagaaactggattgggtcaaggatgaccgagactccacacccccttttctggcacctgtgacagacattattaatctatcaccgcgctcattccagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggtaggtctcaaacctactccccctggcttttccatcaacaagaaagaggggactctggcagggcacggtggctcatgtgtgtaatttcagcacattgcgaggctgaggtgggagcattgcttgaggccaggagtttgagaccagcctggggcaacatcgggagacccccatctctaaaaataacttttaaaagttacctgagaaggccaggtgcggtggctcatgcctgtaatcccagcactttgggaggccgaggtgggtggatcacctgaggtcaggggttcaagaccagcctggccaacatggtgaaacccatcgctactaaaaatacaaaaattaggctgggaatggtggctcacagccataatcccagcagtttggaaggctgatggggacggatcacgtgaagtcaaaagttcgagaccagcctggccaacatggcgaaaccctgtctctactaaaaatacaaaaattagctgggccttgtggggggcacctgtaatccagttatttgggcggctgaggcaggagaatcgcttgaacccgggagccagagattgcagtcagccgagattgggccactgcactgcagtctgggtgacagggagactctgtttcaaaaaaaaaaagaaaaagaaaaagttacctgattgtggcggcaggtgactgtggtcccagctacttgggaggctaaggcaggaggattacctgagcctgggaagttgaggctgcaatgagctgtgatcatgccattgcaccctagcctgggcaacagagcaaggttccttctcaaaaaataaaagaagggggattcattcctgcaagtcccggtaccccctcctgattagttttaccccattaattttaggagcttctggaagaggtgaagaaggaattgcagaaagtgaaagaggaaatcattgaaggtgaggtggtttgctttggttttgttcttaaacatttacttattttggaggcatcatgtccctgggcaagagccctgttttggaagggaggaggcagagactctgcccctgacctctgctccttgtttccttccagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagatatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaagatctctggagtgatttgaaggcctgttctgatggggatggaggtgtgctcggcccccggtgcccctccaggaagatttggtcctctgctgagaacccctgcctcctcccaggaatccaccttcccttcatcttccttcccaccctgcatattgcgcctgctcactcatcctcaggcccgcagccaggatgatctctgccccctccagcctccctccccatgccccttaggaggccacttcctccccatcccaccctgcccttcaccaccctaggggaggccagaagcagcctcactttgtgtagccttgggcaagtccatttgcttacctcaggcctcagtttctgatttgggaaagggctcataagatgattctctgcccccactctaccactctcccagcttctttcctctttttttttttttttttttttaatgagttggggtcttgctctttcacccagtctggagtgtagtggcaggatcacagctcactgcagccttgaactcctgggctcaagggatcctcctgcctcagcctcccaagtagctggaactacaggcgtttggtatgacgcctagctaatattttcatttttcgtagagatgcggtcttgctgtgttgcctaggttggtctctaactcctggcctccagcagtcctcctgctttggcctcttaaagtgctggaattacaggcgtgagccactgtgtccggccttctttcctaatttcaatgacattttgcagacgcacattatggttctcagacacgttcttaagatctttaccccagagctcctttaattagaaaacgctgacagtcgatttataaagtagcattcagagtcacagagctcatccacgcccccttcagttgtcgggtgggtaggtcatatggcctggtggaataccccgcttggacagggggacctctgggctgagggacaggtagtccccctggaggaggcctttgcgtgaaggagggcggaggaggacctggaccagtccaaaggcaggaaggaagggcgatccctgcgtaccgtgaggggcagatttggagggaagttgggcgaactgacgatgacttaggtagtaaagggacaggccggtccctagcaaaggcaactgaagaggacagcgagggaggaccggataaaaggacagtagcagtaggtccaggactggggactggtgaccaagtgactgagcctgaaagccagaatggactagccctggtcaagaccggtttttcctcccaaaaggccacgtcctgctggaacagaccacagaatgccgggctgggaggcgtttccctggaagacccagcatagccatgccagtggggtgcgccataggcggaagaagaggggggttatgttggatcgatccactcagggaggggaggatgtcaatgacaggtactaagatggattaaggtcaggagccgcagggtggtgactcattggagctaacgcagtccaggattcacccccacctttccccctaagactgaggtagatggaagggggcgggtcgggaagtccgtaggaactttgtgcatctttacaatggtctgtaccaatgaggaggaggtaggtggtgttcggtgcaaaggatgagcgtcctaggggaagggtccactcaggtgagtgagggtgcgggtgacagaatgagaggtggctaaatccgggtgcagaattttgttttgccaaaagaggtggacgtcctgctggcctacctagcggtagggaggtggggtctgataaaagacgctgtctttccaaagtgctcaacaaatgcgctggcaggggcggggtgggatagggcggggtccttcttggaacgttccacctgcaggaggcggagagtcccagtggaaggtaccactgggcaggttagtagggaggttcgatcagctccagcccaggatctctccggcgcccccgaaggactgggtggtgtcagctgggccggtccaggatgggacagtgcggagaat

SEQ ID NO: 13163 - DNA, 18302 bp, Human
catagatgaaagactgatgtgaacaaagaaacagagggatgtcatgtacatgcaggcaagaataaataaaaagatcaatgaacataacagaaatgtcagaaatagacgtgtgtgtatgggaatttggtatgtgataaaggtagaatttcagaacagtggagaaaagatctacctttggtcaacttgagacaattggttacatcactcataaacaacgacctcggtgcactttcaaaaataaatcttggccaggcaccgtggctcatgcttgtaatcccagcactttgggaggctgaggtgggcagatcacttgaggtcaagagttcgagaccagcagggccaacatggtgaaactccgtctctactaaaaatacaaaagttagcctgtaatcccagctacttgggaggctgaggcaggagaactgcttgaatgtgggtggcggaggttgcagtgagcctagattgctccattgcactccagcctaggcaacaagagcaaaactccatctcaaaaaataataaataaataaataaatcttacatagattaaagccagatgacctgctcattctaggtcattactgtttgggaccgtgtctgtgtccctcactgaactgtaagctctgggaggacaacacggggcttttatcttttacgtagataaaagaaatgatagaatatatcattatagccgtgcactgtaatcccagcactttgggaggtcacaaagtgacctcaggatcagctgaggtcaggagtttgagaccagcctggccaacatggtgaaaccccgtctctactaaaaatacaaaaaaaaaaaaaaaaaaaaaaaattagccgggcatggtggcacatgcctgtaatcccagctactaaggaggcaggagaatcgcttgaacccgggagggggaggtgcagtgaactgagatcgcgccattgcactccagcctgggtaataagagcgaaactccgtctcgaaaaaaaaaaaaaaaagaaaaaaaagaatttatcattatgaccctgggttatggcagggctcttaacacaccaaaagcaaaagtcagaacggaacagattgataaatagttgcgcataaacacaaataacttctgtgccaaaaataactaaagttaaagcccaaagtagaaactaggaggaaatgtttgcaatatgggtaactaaggattagaatcagaatccataaagtacccctagaaattaatagtaataaaaaagccatacaacccattttaaaaatggacaaggaatatgagcaagcaattcacagaagacaaaatttacaagaccaatactttcacaaaaaacattccatttccttagtaatcagagagctgcaagttagaacagtgtgatactatcctttcaggaagtgactaatactaactcatcagccaggcccctgctcagatgtcccttcctccaggaagcccttccggactccggggctgagtcaggcgctccccctgacccccatcccacggctctcccgggatctcccatcccagacctgcccattctgggtcagcactgggaacgtgtctgtgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggtgcgggaggcggagactgcgggtggagattggcgccgcggaagccaatcattgccgagtctgagagatggacaaggccaggcgtggggagggcgtccagatgctagcctcgggggccggacgaacggaaggcgggggatggtggggacggagccaatagaatccggtgggggcgaggggcggagcgatgggacttgtggacctgtaaggggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggtaggacaaggagatgcggggcccctgggaggctgggggctgttaggacgaagaggataggatggggcctgtgggaccagggtgtgggttagtggatttgggggccacggacgacttggggaaacagtccttggtcctccccaggtcccagtttccccatctgtgaaatggatgggtggttctaagagagggctaaggcagaggccagacactggcattcagcaggtagcccctgatgtgttttacgaggccagcaccctgatttttcaagacatgaatttattgctcgtgtttaagaatcgccaggttttgcaatcttaaaaaaatctacactttagacatattttggtaaatggaaggacctggcaatattgaaatctccttcccaagggaaaacaatcgacgggtgatgagcattggctatgaagaaaaggaaagtgggctaaggatgtagggcatgatgggggagaggaccttcctactctatttatttatttatttatttatttttttgagacagagtctcgctcttttgcccaggctggagtgcactggcaccatctcggctcactgcaacctctgcctcctgggttcaagcgattctcctgcctcagcctcccgagtaactgggattacaggagcgcgcctggctaatttttgtatttttagtagagacgggtttcaccatgttggtcaggctggtctcgaacctcaagtgatccgcccacctcggcctcccaaagtgctgggatgtacaggcatgagccaccatgcctggccccttcctactttagataggaaggtcaagggagggcctctctgaggaggtgacatcttggtagagacgtgaaagaggtgagggagtgagccatggcgacatctggggtagagggaacagccagtgccaaagccctgaggtcagagagagcctgccgtgttcaagggcagaacgaagtctggtggggctggagtagagaaagcaaggagaagtggtagaaggtgtagtttctgaggcaaggagcagggacagatctagagccttgtgggtgatggtgacagctttggctttcactctgaggcaggagccacccaccagctctgagcagaggagggacatgaggacttagttaggggacagacttccagggggcgagggtgtgggcaaggagctggtgaggaagtgacttcagtggtccaagggtgaaacgctggtggctgggaccagagtggaggctgaggagtgggggagaagtggctgaattcagattttgagctctcagccttctggaagggacattaggaggaaggaggatgggcagccctgaagaggggagaggggtcaagtgctgtggctcacacctgtaatcccaggactttgggaggccgaggcgggcggatcacctgaggtcaggagttcgagatcagcctggacaacatgttgaaaccctgtctctactaaaaatacaaaaattagccagcgtggtggtacacgcctgtagtcccagctatttgggaggctgagacaggagaatcgcttgaacctggggggcggaggttgcagtgagccgagatcacgccactgcactccagcctgggtgacagagcaagactccatctcaaaaaaaaaaaaaaaaaattagctgggcgtggtggtgggcacctgtaatcccagctacttgggaagctgaggcagaattgcttgaacccgggaggtggaggttgcaatgagccaagatagtgccactacactccagtctgggtgacagagcaagactgtctcaaaaaaagaaaaagaaaggggagaggaactcacagggcctcagatgtcctctgctcaccccaaccagtcccctgcaaactccctttctccccacaggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcaggtgaggagggagacggagaagtgaggccttgaggttttcagtgggaaacgctgttctagggatgactccagtggaaggaggtctgagttccagccactttgttctccccattcattcattcattcattcattcattcgacagcagtgtgtgggttgagagtgccccagctctacttgctggggctgtggctgtattggtgtagctctgtttcctcaccccaggtttgttaatttattcaaaatgtactgaatgaggctgggtgtggtggctcacacctgtaatcccagcactttggagaggctgaggcaggtggatcacctgaggtcaggagttcgagaccagtctggcgaatatggtgacaccccatctctactaaaaacacaaaaagttgctgggcgtgagggcaggaagtgttcaggaccacaggacacgcagactggggctggagggagagggctgagctggagacagacccggggaccctttaggaaaggcctggtgccagtgggcatggaggggaggagcctggatcagaggatcagggactgtccagggttaggaggagagagaagctggaaaagaccctgccacaggtgggaggagggaggaggtgtgggaagaggtgcgaggaggcaggaggtgtgggaagaggtgggaggagggaggaggtgcaagaagaggtggaggagggccctgtggttatcaagggtcatccctattgatggcttctgcccttcgtccctccccagaggggcaatcccgtactgaagttcgtgcgcaatgtgccctgggaatttggcgacgtaattcccgactatgtgctgggccagagcacctgtgccctgttcctcaggtgagctctgcggcgccaccccagacttcaggaagggcaccccactggcctgggagggtcatgtcccagtgttctggactgttctatgagaagcctctgggcatggtcctgcaggttctgggccttggtgggaccctgtgttggaggcagggggtcttggcctggaggtgcccagtgcaacaagagctggagcccgaactcctgggtctcaggaaggaggggctgggggccggactcctgggtccgggggaggaggggctgagggctggactcctggggatctgagggaggaggggctggggcctagactcctgggtctgaggcaggaggggctgggggcctggactcctggggtctcagggaggaggggctgggggcctggactcctggggtctcagggaggaggggctgggggcctggactcctgggtctaagggaggaggggctggggccagattcctgggtctaagggaggaggggctgggcccagactcctggatctgacggaggagggactgggtcactcatgtcccagacatccttgactggagttgatgagaagcaggatttctcccatctctaccctagttaaacaactttcccctccaacctaggggcccctctgcagacagggccagacagaggaagtgaaacctctgagttcctgtgctccctgcaggctgtgacagctgcagactgctgggcagagccagtcctagttccctgggtcatgaagccctcaccgtagccctccaaggccagagcagatggtttggcagtgggccctgcttcccaccgcgagccatgcagtgtccccgtgcccacactctctagggcccctggcacctgttctccccttgaagcccaagtctcttcccctcttcatgaagaagccaggggtctggtcttctaggtaagcacagccatgtggccctggctgccaatccctgcggagcatcttcttggaagagtgacctggggcaagtgacttaccctctgtgggcctcaggaccctctgtcccccatgccgtactctgagcccttagtattccagtgagagggaaaagggctttgggggtcttgaagagactgagacctctcaactcccgctccctgcccccaccagcctccgctaccacaacctgcacccagactacatccatgggcggctgcagagcctggggaagaacttcgccttgcgggtcctgcttgtccaggtggatgtggtaagcaggggctgctccctagccagcctcaccgggctttgaggttgtgcagtgggctgttgaatcccttccaagaggaaatgcagctaaaacctcagcgaggaacgtttttcacatctgagatgacatgggtcaccaagacattatgttggcaaggagaggggagggcaaaattgtctatttcctctttccccacatccccttcaattagtcccagatctctgccacctaaatatctcttctttttgttttgtgtttgtttgtttgtttgtttgagacggagtttcgctcttgttgcccaggctggagtgcaatgacttgatcttggctcactgcagccttcacctctggggttcaagcgattctcctgcctcagccttctgagtagctgggattataggcatgcaccaccacgcccggctgatttttgtatttttagtagagactggttttcaccatgttggccaggctggtcttgaactcctgacctcaggtgatccacccacctcagcctcccaaaggctgggattacaggcatgagccaccgtgcctggccatatctctctcttttatttttttaagacggagtctcctctgtcgcccaggctggagtgcaatggccagatcttagcccactgcaacctctgcctcctgggttcaaacgattctcctgcctcagcctctcgagcaactgggatgacaccatgccttgctaatttttattgattgattgattgattgattgttttgagacagagtctcgctctttcgcccagactggagtgtagtggtgcaatcttggctcactgcaacctccacctcctggattcaggtgattctcctgactcagcctcctgaatagctgggattacaggtgcgtaccaccatgaccggctaattttttgtatttttagtagagatgcggtttcaccatgttggtcaggctggtcttgaacttctgatctcaggtgatcctaaagtgttgggattacaggtgtgagccacccccaccaggtgatttttttttttaatttttagagacagggtcttgctatgttacccagtctggtcttgaactcctggcctcaagcattcctcttccattgggttgggtgcagtggctcatgcctgtaatcctagctctttgagaggctgaggcaggaggatcacttgaggccaagagttcgagactagtctgggcaacatagtgaagacccccatctctacaaaatacaaaaaatatggtggtgggcacctatagtcccagctactcaggaggctgaggcaggagaattgcttgaacccgggaggtggaggttgcaatgagccaagatcatgtcactgcactccagcctgggcaacagagcgagactccgtctgaaaaaaattaaaaagatcataaaactcacatggctcctaagcaccctaggagaaagttctgctcccttccatgacctatggggccctgtgtgacctccaacctctacccagttctccaggcccgtctctaagattccatgctcctcatggaatttcacatcctctctcccgtagggagcgaattataattcctcaagccctctttcccctcccatcctttgcccatgctgttctttatgtctggaattcccttttctggtctccttttcatcctttcctcctcctcatcctcctttgggtctcagctctaatgtcccctcctccaagaagccctccctgatcccccaggcaggctcagtccctcctctggctcccacatcgcagccctggccactccagatcatcagtgtctggggacaggtctgtcctgctcatcagactgtgagccctgggagggcagagtcagggctgtctcagccactgctgggtcctagcactgcttagcacgggccaggcacccagtaggagcttagagagtgacaattgggtgagaggctcttggcatcctgagctactgtgttttcaggctttaattctttttttgttcttctttttttttttgagacagagtctcaccctgtcgcccaggttggagtgcagtggcgcgatcttggctcactgcaacgtctgcctcccgggttcaagcagttcccccacctcagcttccctagtagctgggattacaggcacctgccaccacgcctggctaatttttgtaattcctggcttctaggtttctaattctgattttctcctccagaaagatccccagcaggccctcaaggagctggctaagatgtgtatcctggccgactgcacattgatcctcgcctggaggtgagatgagggcttccctgcctcattcaggctccacctgggattggtccctgctcccccatcccaccctgcccagcccttcccttctccttcctgtgtgggcctggtgcaggcactgcctctctctggccttcagtttcctcatctgtaaaacaaggtcttaatttttttttttttttttttgatacagagcctcactctgtcccctaggctgaagtgcagtggcacgatctcggctctgccttgggggttcaagcaattctgcctcagcctcccaagtagctgggattacaggtgtgcaccaccacgcccagctaatttttttgtatttttagtagggacgggttttgccatgttggccaggctggtcttgaaatcctgacctcaggtgatcctcccgccttaccctcccaaagtgctgggattacaggcgtgagccactgtgcccggttggaagctgaacatttcatgaggttggcttcttgctgcagcgggaaaataagcagtgtttctggttttcctcctgtcaaacccagtacaaacactttgtgtgctgacttcccttccaaaatagctaacatttcttcagcagtgccaggcgtggcttttggcacttacagagcattccagagtattctctgatcttcaaagtcataccatcctccccactttattattatttttttgagacagggtcttgctcttttgctgaggctggagtgcagtggtgctatcacaggttactgaagcctcaacttgacaggctcaggcagtcctcctgcctcagcctcccgagcagctgagactaaaggcacgcgccaccacacctggctaatttttaattttttgtggagacaacaccttgctatgttgtcccggctggtcttgaactcctgagctcaagtgatcctcctgcctcagcctcccaaagtgctgggattacaagcatgagccactatgcctgaccaccccactttacagtgaggaaacaggcccagagagcaaaccactggcccagggttacccagggagaagtggggttgggctcccaagagctggcctgtagccagaaaagatatcaagatgcgcccagcagtggttactaccaggttgtatttggcgggggatgggctggaattttgatttttagcaaccacaattgtttttttttttttttttttttttgagacggagtctggctctgtcgcccaggctggagtgcagtggcgtgatctcggctcattgcaaactccacctcccgggttcacgccattctcatgcctcagcctcctgaaaagctgggactacaggcgcccgctaccacgcccggctaattttttgtatttttagtagagatggggtttcaccatgttagtcgggatggtctcgatctcctgacctggtgatctgctcacctcagcctcccaaagtgctgggattataggcgtgagccaccacacccggcctttttttttttttttttctgaaatggagtttcactcttgttgcccaagcgggagtgcaatggcgtgatcttggctcactgcaacctccgcctcccgggttcaggcgattctcctgcctcagcctcctgagtagctgggactacaggcacgcgccaccaagcccagctacttttttgtatttttagtagaaacgaggtttcaccatgttggccaggctggtctcgaactcctgacctcagatgatctgcctgcctcatcatcccaaagtgctgggattacaggcgtgagccaccgcgcccggcctagtattggcaattcttatgactgaccataatgaagcaaatctataatctgatacctcacctcccggctgccctgtatcctgttatcccagccccgaggaagctgggcggtacctggagacctacaaggcctatgagcagaaaccagcggacctcctgatggagaagctagagcaggacttcgtctcccgggtgaggccacctcacctcccatccctgcctgggcctccccgcagctcctgggtggttgagcttcagttccaattttaaggcactgtccattcatccctgggcctcgtctttcctggcccatcccaccgaaactgcagctagaggggttttcctgagcacaaatctgctgctaccctccctagctcaaaatcctcccatggctccccagtaccccgagagaaagcccagacttctcaccaggctcaacaagggcccgtcaggctcagaagccccgtggcctccacttcacacttcacttctcccaggcctagctcgcttctccaagcacttgccccttctgttccctctgcccaattacctgcctaattccttttttttttttttgagatggagtctcactctcttgcccaggctggagtgcaatgacatgatctcggctcactgcaacctctgcctcccaggttcaagtgattctcctgcctgagcctcctgagtagctgggactacaggtgcccacaaccatgcctgtctaatttttgtattttttagtaaagatggggtttcagtgtgttggccaggctggtcttgaactcctggcctcaggtgatcctcccgcctcggcctcgaaagtgctgggattattaggcatgagccaccacgcccagcctgagatgactttttaatcagttgggaaaaaaagcgtttattgagtgcttcctgcacgccaggcagtctggggacacagctgtgacccagccctgccctcctaggctcagtcttgctggcctttcttcttccgacacactcctgcctccaccctttccaggtgactgaatgtctgaccaccgtgaagtcagtcaacaaaacggacagtcagaccctcctgaccacatttggagtaaggaatggctcccctgccccataggcatttctgtccccttgccttttttagaaagcctgtcacccatttccttccatctccctgcccaccccttgcccgtcctgccttcccacaggccctcatctcccctggggaatatctgaggcccctcctcagctgggacaggggaggcttttgtgctcaactgccctgacccctcgctttcacctttcagtctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggcatggtggtgtgagcttgctacgtgcctgtagtctcagctactggggagactgaggtgggaggatcgcttgagcccaggaggttgaggctgcagtgagctataagcatgttactacgctccagcctgggtgacagagcgatcctgtctcaaagcagaagcaatccaatgaggaagaatgaaactagatagctatctctcgccatatacaaaaatcaaattaaaatggattacagacttaaatctaagacctcaatgcatgaaacgtctacaagaaaacattgagaagctctccaggacattgaactgggcagagatttcttgagtaatgccctataagcataggaaactaaagcaaaatggacaaatgggatcacatcaaattaaaaagcttctaagccaggtgcggtggcttgggcctgtaatcccagcactttgagaggctgaggcggctggatcacctgaggtcaggagtttgggaccagcctggccaacatggagacaccccatctttactaaaaatacaaaaaagtagccaggtatggtggcacatgcctgtaatcccagctacttggaaggctgaggcaggacaatcgtttgaacccgggaggtggaggttgcagtgagccaagatagcgccattgcactccagcctggacaataagagtgaaactctatctcaaaaattaaaaaaaaaaaaaagaataaaaggcttctgcacagcaaacattccacaaagtgaagagacaacacacaggatgggagaaaatatctgcaaactaaccatctgacaaggaatcaataatcagaagataagagttctaacaactctataggataaaatataataatccaatcaaaaagtgggcaaaatatttgaattaacatttctcaaaagacatacaaatggcaagcaggcatatgaaaaggtgctcagcatcattgatcatcagaaaaatgcaaatcaaaactacagtgaggctgggtgcagtggctcatgcctgtaatcccagcactttgggaggccgaggcgggcagatcacttgaggccaggagttcaagatcagcctggccaacatggcgaaaccccatctctactaaaaatataaaaattagttgggtgtggtggcgcatgcttgtaatcccagctacttgagtggctgaggcaggagaatctcttgaacccgggagacggaggttgcagtgagctgaaatcacaccactgccctccagcctggacaacagaagcaaaactccatctcaaaaaaaaccaaaaataggccgggcatggttgctcacgcctgtaatcccaacactttgggaggccgaggcgggtggatcgtgaggtcaggagattgagaccatcatggctaacatggtgaaaccccgtctctactaaaaatacaaaaaaaaattagctgggtgtggtggtgggcacctgtagtcccagctactcgggaggctgaggcaggagaatggcatgaacctgggaggcagagcttgcagtgagccgagatcataccactgcactccagcctgggtgacagagtgagactccatctcaaaaaagaaaaccaaaaaccaaaaataaactataatgagataccatctcagctctattaaaatggcttattattattttttgagatggagtctcactctgttgcccaggctggagtgcaatggcatgatctcagctcactgcaacctccgtctcctggatccaagcgattctcctgcctcagcctcctgagtagatgggattacaggcactcgctaccatgcccagctagtttttgtatttttagtagagatggggtttccctaggttggtcaggctggtcttgaactcctgacctctggtgatccacccacctcggtctcccaaagtgccgggattacaggtgtgagccatggtgcccggccttaaaatggcttttatccaaaggacaggcaataacaaatggtggacaggcaataacaaatggtggcgaggatgtgaagaaaagggaaccctcatatacttttgatgggaatgtaaatcagtacaaccactatggaaaacagtttggaggctcctctaaaaactgaaaagttgaggttccacatgatccagcaatcccactgctgggtatatccccaaaaaaaggaaatcagtgtatggaacaggtatctgcactcctgtttgttgcagcacagttcacattgccaaaacttagaaccaacctgtgtccatcagcagatgaccaggcaaagaaaatgtggtacttacacacaatggatactcttcagccataaaaaagaatgagatcctggctgggcgcggtggctcacacctctaatcccagcactttgggaggccgaggcgggcagatcacttgaggccagaagttcaagaccagcctggccaacgtggtgaaaccttgtctctactaaaaatgaaaaaatgagctgggtgtggtggcgcgtgcctgtaatcacaactacttgggaggctgaggcaggagaatcgcttgaatccgggaggcggaggttgcagtgagccaagattgtgccactgcactccagcctgggcgacagagcgagacccttttcaaaacaaaacaaaacaaaacaaaaaaaacatgagatcctgtcaattacaacataatgaactggggattattatgttaagtgaaataagccaggcacagaaagacaaacattgcatgttcttatttatttgtgtatctaaaaatcaaaacaattgaactcatggagataagagtggatggatagttcctggaggctggggagggtagttaggggctggcagggagatggggaaggttaatgggtaccacacacacacacacacacacacacacacacaaagaaagaatgaataagacatactatttgataacacaaccaggtgactatagtcaataataatggtacattttaaaataacttggcagggtgcggtggctcacacctgttatcctagcactttgggaggtcaaggcaggtggatcacgaggtcaggagttcgagaccagcctggccaatatggtgaaacccctgtctctactaaaaatacaaaaattagccgggtatagtggtgggcacctttaggcccagctactcgggaggctgaggcaggagaatcgttggaacccaggaggcggaggttgcagtgagccaagatcacaccactgcactccagcctgggtgacaccaggagactgtctcaaaaaaataataataacttagccaggcgcagtggctcacacctataatcccagcactgggaggctgaggcaggcgcatcaggaggtcaggagatcgagaccatcctggctaacgtggtgaaaccccatctctactaaaaaaaaatacaaaaaattagctgggcaggggcctgtagtcccagctactcaggaggctgaggcaggagaatggcgtgaacccgggaggcggagcttgcagtgagccgagattgcgccactgcactccaacctgggcgacagagcgagactccatctcaaaaaaaaaaaaaataataataataataataacttaaaaagattgtaactggattgtttgtaactcaatggatagatgcttgagggtataggggaaaataaagaaccaaaaccccactctagatttacccaggaaacagctcctttaatgactggttcctcatttttttctccctcccatccaggcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtgtcaccttctggtggcccaggtgggcaccttcagctttctttagttcctcagtttcccgggggcagactacacaggctgctgctgctgctgcttccgcttcttgtcccggcctgtgggagcctcctccccagactctgaattcagtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctctttcttcttcttcttcttcttggtggatgtgggagctgcctgaggctcaaggtcatccggcagctcaggccccaccacctctgtctctggctccactgtggcatcttgctgtttttctttcttcgtcttctttttgggagctgccagagctgcctgggcctgaggcttcgctccttctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttcttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgattttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccac

SEQ ID NO: 13164 - DNA, 37319 bp, Human
atgagaacagagcattaaactaagtatggcaccccactaagcccagccctatgaatgcccagcctttgaatgtccaaagacaagtttctgcttctatctaatcacaccttctttttttagaagaaaataatataatgccatgaaagtaggccacatttcctccttagacactgccattcttacctcctgagctgttgccctccatagacagacatgatcattagcttcctggtttttgctcattctgttgtcttccttttagctattcaaatatatttgtacctcaagacccaacttaaggtccctatctgccatgaaatccttccttaccaccttaacctactaatctgtctttttaaacttatctagtacttattttatacaaaacatttagctctttttgtatatattgagtgctgatcactgtggtcatattgtttcttgagtttgaatataagcatcttgagctttgaaacagtgtcatcattgtacaatggaaagggcacatacttttgagctcaataaagcttgggtgtaaatactctcccatttacttgctgtgactgaagaaattaatcaacttttgagtctcagaatcttctctgggaaaatgggataataaaacctagttcattgggttgttgtgaggattcaataatatatgtaaagcccttggcatatataagggctcatcaaatattacttcctctatcacatgtatgcctccatatatctgattttgcttcagccaacatcccagtgctgagcacaaaggcagcattcactaaatacttgctcattggaagagatatacatatatcttccattaaatgatatatatatatttaatgtactattttacattcacccaagaagtaaaccaatcctatgttgaagttttgtatgttatctctgacttgtttgtaagtttttgccttcacatgctgacttttgtaaaaaaaaaaagtcgaattttgtagacttcatattttcaaagcatttgcacagccattatagtattaaagacactcttagtgggtaaaaagatagatcttattcccagtcaagaaatggaaaaaactggcactggtggctaaggaattgttctaaatgacagaaccagtgtattttaatatacagaaaaatgtccaagaggctttatctaaactgagatctactgactccttttccattgttttttccactataccaatctcttaggcaaaaaagactatatctgtaaagtatacgcaggaaaaactattttaattaactaaaatagtacaaatgagtctatttctttttattctgggtacagagtaggcacttgatgactggattaaaaacagcacatgatatatcaattgcagttcctggtttacagttttaagtaatcgagagtgagttatttaaactgctctttttgataaacatattttaaagagggctttttctcccaatgaaaatgtaagaacaagtttcattatttttaagacaatttcaatttggggcctagcacatcatgcttgagagctggttttttccttatgcaaatggatcctttctctaaactggtgcaaaccacactttgcctgccaaacttatgactcaaaggccctgaagggtttctgtagcctcccagccacagcccagaaaccataagctgtttccacgtgaaacatccaaacacggtctcccaagcctaagtctgctaccatcaaggcttctgtataaaaggcaaatgaggaggcagcgcccccttctgctcccacccccttctgctcccacccccttcatgtcagcagcagccaatcgcttttctctgtcgtgcagtcggctcctgggattggccagggacgggacaggcgcggaaccactgcgcgcacaggcggagcgcggagacttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccaggtacggtcaggccacggcggcctctgaaccccctgaataaccgcctcctcactcgctctcctgcggggtggtctctcgcggccttgcggctcgacgctgtctgcgaggcccgcggtgcggggccttggcgttcagcctcgcgggggaccccctgtattgttcgctcggggagccgcgggggcccggccggcagcgccgctctcctcaggccgcggtgggggaggggcggcccgcgcggggcgtagcggcccaggcagccccttaacggtccggtccgcgttcggaaccggcccggcgtcgcgaggggaatcggcgagccgagggcgcgggagcctctttactgcacactcatcctccgtcctcccgcccggctcaggggttacaaatcgcggaggggacagggagcccagggccaggatcatcaacgtggggctttataggaggcgatctttacctcagcgaccgatcacccccagttcccccaacattgctttgcatctggcatctttatgtggagagcagtcagggcaataggcatacgttcaaacgcaggttactgcttatcagttggttttaaaaatatatagaaattaacaaattattcttttgagattctgtgctatttgtataatgggattattaggattgttttaataaagtactaataggtggtaacttagtagttactaaatttcgctgaacagttaccagcagaggggcatatcgatgtgttgattattggtttgatctcaactctgcttctaaacaagcatgaccttagtccagccctttatcttgtctggcctaagttaaatctttcataagatggatgggttgcctaggtgacccaagacctatatcagtcccaaatacaagattttaggcagaatgattatttacatccacagtgcatgtgcattagaatacactcctaggctgttggaatcatttttatgaaggaaagtggttaactcttattgtagatgatcacctattgaggcatattttcatatgtgtagttcttgagaagaataagtgaaaactacctgcatagtgcctggcacctgttaagtgctgagtaaatgttatctcccgtcctcctttctttcctgttctcctattataggaactcttagttttatttacttttgtcttaacagggagtgagcaccatattaagaccctgaagttttgacttctgtaataccatagtttgccttgtgttattatttgttcttttttccgacttccttctaggatttaatttttgtgtgttctttatgagcaactgagttatccttttagccccactccctgcttggagttgagtagcggggcgtgagtgtttctattaagcatttaatgaattctgtacaattgtacaaagctaggtgaaaataagaaagccagccactagcatgtacttaaaataaacacatgtctcatgcttttcatcagttagaaggattaaaagttgacaagaaggatcagtacagactgttactcagacacgtattcgtgttagagattggactgagattctctccccacgaaagctgactttatcatacctttttgtcttttatgggccagaaataggggctatatatattggcagttgcttttaatcagagtatcatgtcagtggtaggcctattaaattctgattagcaacagtgttttaataacattcttattttctgagtactgtcaaatgtggagagtttcgtactgatccgtaaatgcatcattctatgagttctaagccaaataaacaagccacttaaccattttttaatcccattattaactttaagcttatgtgttaaccaattttctaatatgccagtgggacaatcaaaatgtaagctcagtgagatcactgtgccagagacacactaggtgtttaataattgtttgatgaataaatgagatccctcgaaaatgtaatggagtggtaggaatgatgaagataaaattatatttgaaatgactcttagagatcatctaggttagccttatcattgtatagatgaggatttgaggcttggacaggtgagattatttatccataattatacagctcgccaagattggagataagaccctaacataagcttgtccaacccgaggctcacatgtggccaaggatgggtttgaatgcggcccagcacaaattcataaagtttcttaaagaaacatgagatatttttgcaattttgcttttaagctcatcagctatcattagtgttagtgtattttatgtgtggcccaagacaattcttcttccagtgtggcccaggaaaaccaaaagattggacacccctaccctaatagatttctgagctcccagatcagtcttccaccaatagaactagacttaatgcaagttgacatcatatttagttttataccaaaatgttgcttgccacaagtcaatggacaattctgaataaatgttgtctagggctaagcctagttgcttaggcagctgtctcatttgtgctctccatggatttttctaaaagcagtgctaatactgaaaagtaaaactttaacaataatgttaggtggaaaaaccaaaataagttactttcatctttctcttttctttgatgaataaatgaaaccctagaaaatgtaatgagagtggtaggaatgatgatataatagtcctcaacaggctttgaatttccaagtggcagagactatatcacactatatcatattcgttttttttttttgtggtagagtatcactctgtcaccctggagtacggtggcacgatctcggctcactgcagcctctgcctcctgggctcaaacgattcttctgcctcagcgtctcgagtagttgtgattacagatgcgcaccaccatgcctggctaatttttgtatttttagtagagacagtgtttcaccatgttggccaggcagtctcaaactcctgacctcaagtgatccacccgtctcggcctcccaaagtgttgagattacaggtgtgagccaccggcgcccaggtactctcatcttttgaaagttgctatttatggtggtttctggtttccttcaaacttgtgttgtatttctgttgaggtaatttagcatttatactatgaaaatcattgagaacttttagaagaagcagttgttttgggaaccagacaagcttttgtgcagttttttttttcaatggtggaaaataatttatttctctaccttgagtgtaaggcaagggaaaaaaaactcttaccaattgcgttttggaaaacgcagttggtaatatctctagataatatctctggagacgtacataactttaattttcctcgaaatttgcaatatgacaaaattgaaaagggaaataatacctctcaccattaaatacaagaatataataatctgaacaattgaaattatacttaaatatgttattgactctaaaataatagaaatgccttaattccagacagtctttaagaaagcataatgtggctaggcgtggtggctcatgcctgtaatcccagcactttgggaggccaagatgggcaggttgcttgagcccaggagtttgagaccagcctgggcaacatggtgaaaccctgtctctacaaaaaaatacagaaagtagccaggtatggtggcgtgcatctttagtcccagctactcaggaggctgaagaggggagatggcttgagcccatgaggcagaggttgcaatgagctgagatcacactactgcaagccagcctgaacaacagaacgaaatcctgtctcaaaacaacaacaacaaaaaacagaaagaaaagaaagtatgttttacatatttccattttctccttactcttctgaaaaacaaaaatgaaaagttttcattttttttaacatttcctttaaatgtaaaattttatataactgttcttggctttggtagtctgttgtcagaatcaagtacagagattgtactgtcagacgacctaaaactgttttaaatcttaagtgtcctaaagagagggcacatattagcttggaagcaactggtgaaacttgatattcagagacaaggccgtagaggttaaatgaagttatatagtaaaaaacagcctttacgagttaatgaaatgttacaaccaacgtatgctgaagtgaagcagtataaaagaaggaaagaactggaaggtcatccttttgtcagtgttgttacctttgtctctgttcttcagattgtttgagaaaatgaagtgatttccaccaaagacttcatacccagctttcccccctttttgtgccctttggcattctctgcttctctatccccctcatgtcagcagagatgaattaggaaataggtaggagggagagagagcaaaaacagaatttttccattgttttctagctgttttggatgaatttgagcagtaggcccttggacttcacaaagtgctagtattgttttgaacatcccagcaaccattgcattatattagtatttcaaagtgaaaataagaaagactacaagtgtgggaggatgggggtaaaatccaacttagatggacctgcagaaaagttgaaagattgattttcaagtatttttatttgtatatataagagaaagaatgagctaaagactctaaaagagtagctggtgcatattaaaaattatagattagcaagccacaaatttctgttccgaaaaatgttttaaagtaatgtggctgaagtattagattattaggaatattttgagtgttctaacaagagtgccaaaattaatttggagagtaacgactgtttctactctttggactcttgccaacatttgtgggtaaggtttaaggagaaggtgcctatctttcccacctcactcagtagtagttttctcatccttgtaaaatacttagggagattctgtgttgtattgcttgaacctcacaggtttaaaagacaggaaggtgaatttttgcactcaaagaagttatttactaattttagaatagagactgagggaatacaataagcagagatagagtgatgtgaatgaataaggagtgtatgtgagagagagtgagcacaggtatagcaagagattattgtcatctccctattttatataatcaaatagttgaaattctaaaaattcagtttatttggccaaagattaatttagtcagtcacaggtatttgttatgaatctgttatgacctaatattgtgctaggtatcaggaattcattcagtagtgaaccaaagtgcctacctttatggagcttacattgagtggtggatatcaataaatagtaagcaaatacaagctgggtatggtggtgcatgtcgtagttctgggtactggggaggctgagttgggaggattgcttgagcccaggagtttgaggctagcttgggcaacatactgagacccctgtctcttaaaaaaaaaaaaaaaaaaagtaaaagcaagcaaaacacaatcaatataatttcagttagtgataaatgcctttaaaaaacaccaagataaactgtgtgtcggttaagatgcaatcataagtcagaagccacaggtattttcaagagggtaagtttaatagagttactgactatatcagggaaattaaagaaaattaaaagaatacaagaatagttttaagaagcagccactactgatagggctgagatagagtgcccaagtaagaaccttttttgccaaggctaagattcttaccttattggaaggaatatggccatgactcagtagcagagcagtcactggtgttgctctggtggaacttactggaaatgcatccttcaaaacttggtgggaaatatgccctctaggtcacgggttggcaaactgtagtccttttgccagctgttttataaaaaaaagtttaaatagaacacagctatgcccaatctatttacatattgtctgtatctgctttctcactacaaaggtagagttatgatgttataatctgcaagcctaatttactatttgtccctttaagaaaaagtttataaatccctgttctggagtactctaaaaaactgtttatggggagatatcttgttagagatactctgctttgaaacctcccaagggagaggaagcaccagtgaaagctgatggtctttgagtgttgctgaccaccattaatatcaagagctaggcactggagaagctgcctccactgcagaagcttgccaaggatacatgagtcaggaacaagagctcctttttcttgtaatatctctcttttatcccctgctgacagaacttaacatcatggcacctagaaaaagaaagatatttatttaaggaaccaagctctatgcttgtagagcagacaatgaagaatgaatttggagcaataaattgataactggcccataaacagactaggatttgtgaatattttaggtaaggtgatgaggaaagcctctccaaggagacgatgtttgaggagagatctaaatgattagaaaagatgggccaaaggggaatgacaaaaggtaaggccttgaatgtggctgttcaaggaagcaggaaggcccatgtgattagaatatctttagggaattaggagagtgagagtagggaggtaggcaggagcagatggtatagggccctagatctatagtaagaagattggaaatgaggggaccagttagaagactatcacagttttcctgtatggtattgaaaatattgatggctgagactaaggtagcagcagtcaaggtattgagatgtagctttgaaatctttgaaggcaaagctgcaggatttgctgataaattgataaattggctatggttggaggaacgacaattaaaaatgattcataaatttggtttgaactacaggataaatccatttgctgaggaaagatgttagagattctttttggcatattaactttgagattaaaaatggatctctagtagtatttgaaacaacttgaaaattgtttaatttttcttaaatttgaccatgcctagtcatatggccacacctaatttcaaaagggatgaggaagtgcagtgctagaaaaaaaaacaggagtatttttgaacagcttgactgacttccacactccaaaatgtccaagtggaaatgttgaataggtggttgagtataagactttggcattcagggtggagtttagaccttgtaactggtaaagccaggagacttaatgaaatcatcttctgtgaagatagaaggaaccaaaagatgtattattccaacatttagagagtatgaagacaaaagccagcaaaggaggctgagacggaacagtgaaaaagaaggaaaatcaagggagtgaacccacagaagttaatgaaagaaaatggctcaggaaagagatcaactgtgtcacatgctgttaggaatattcttgtatatctctcctggtgtatataagcaagagtttctctaaggtctgtacactcatgtgacttgctgggatataggatatgaaatgtctaacctcaagatagtgtgaattatcttccaaagagatcacaccagcttattccgctattagccatgtatgagattttctgttaatctgcctcttcaaaactgtgtattagttatcgttcttactttttaccaatctaattgatgtaaagcattgtctcaatgaggttttgatttatattttcttgattattaatgagttctaaaaccttttcacgttcgttggccatttgtgtttcctgttctgtgaaatgtttgttttgccatttttctgttttttttttattatttgtgagaattcctatatattctacatattcgagtttatgttttggccatatcttccagtttgtggctttttacattttagttgtctagcacctttactgagtagttcttccttttccaatgatctatattgccacttctatcttacgtcacaagtacgtgtagatattgtcttaatcagttgggctgccgtagcaagatatcatagaccaggtggcttcaacaacaggcgtttattttttacagttctggaggtggagaagtccaagatgaaggcagtggccatttcagttcctgtgttagagctttctctgctttgcagacagctgccttctctctgtgtcttcccaatggcagagagagagagagagagagagtgtgttctggtctctcttatcttataaggacactaacctaacctggggggtcctatcttcattacctcctctgaacctaattacctcccaaaggccctaactccaaataccatcatatcaggggcaagggtttcaacatagaattttgggggacacaaacattcagtggttttgtttctggagtctttatgccattccattggacaatttatcctgtgcctgtcttctgctgtcttaattactgtagcttcagaaaaagtcttttggtagggtaatctatccttcaggagtgccttaagtatttttggtctttagctcttccacatatgttttaaaatcaagttccataaaaaaaaaaaaagccttttggatttttgctgcaattggatcaaaactatataaatcagattagggaaaatcgatatctctgtgttgtgtattctcatgacaaggcatatttctaaattcattttgttgatttatgtttgctattaggccttgtggatctttgttcattttcttcctggatatcttatatatgttgtaaatggtgttcttgacttaaaaatagatttctagctgttgctggtaattagaaatacaagtaatttttgtatattgataataaatcagtgagcaaatcattttactgatttcagttttctgagtacacccatagtatctgtgattgacatttattttcttcctttcagacctttatgccttccgtttttcttttggcagtaactaagagtgagtagaagcaattatcatggcattctggctttgttcttaatttttaaagggaatgttttaatgtttcccccttactagctgttagaatgagagtttttaacttcattttttttttttttttgacatcaaatgtagtcgggtgacttagtgaggaagggacttggtagaatggaagacacaagaaaagattgacttccggggaaacaggaaatgggtttagaacatactgagttaaagaacatagtgtaaaaaatgttaacattttaaattgaagtgtgtaatttgagatgatcagggacagagctgtagatgtgtttattataaaataaagtcaataataagataccctactgtggatgaattctaaggaaagaatatgaatggtgccacgattaaggataaaaacctggaaaatacagctacctcttatttgataggtggaagaaaattgaaaggaaatatgagagataagagactcaacagtgtttagcatcaaagcccagagagtcgaacatttaaggaggagattgttagttgtaccaaatgaaatgccacagagaggtgtaggaagatcaggactgaaaagagggcattgaatttgatatttgacattttagaaatctggtttcagtcgagtgagggaaccaaaagcagttttcagtgagagtaagtggatggtcctgaattggagaaggggggtttaaaatacctgcttgttaaattttgcagttaaggaaaagacagatgggtagaatgaaaaagaaggtataagagggaaagttcttttaagataggaaaagacgtatgcattttaagcattttaattttgataattacctagttgccaatactggttattgtcaagggttgtaaatttaatctaataagggaaaatcattatttgttttgctctacattcttcatttatgagtctgggtctcttctaaatttcacaatgtgtttttcatcaaaattgtgtttctgttaggaagaaagtagaggagagtagagatagagtaggaagctagcagtctccatggataaatttatattttatctatatgtcttctgggtttattatgtcatgtctccaaaagcttgcttgtaaagagtaagatgacatcgagctcttatttttcttcccaaatggaaaatttcttaatccttttctttcctgattatccccccatttgaatgccatcttgacttactacctggtaaattctcagatagatttgctggttcatctgtcctctctagtcagtccattcatctatgtaatcacttcttcttttgtactaaattgttaacactataattttataatctgtattgggtagggttaaaatactcctccccattgttctcaatattttctttcctgttgttatgtaattatttttacaaatgaacttatgtacctaacatttggttatgatagcatcaattcatctttactccacaaatcatttttttaattaagacagaatttaatgtattggttaatttagagagaattgacacctttacaatactgcatttgtcttccttttgtatttctatagttttaatatttttaaagttcctgtatatttttaaattttatttttagatacttaacatttttctattattattgggatattttattccattttagtttctaatttttttaattgtggtaaaatatacataacataaaattaaccattttaagtgcattaagttagattcacattgttaggcaaccattaccaccatccatctccagaacaatttttatctttccacactgaaactttatacccatttcacaataacttctaactccttcctccccgcagcccctgacaaccaccattctactttttgtctctgaaattggctattatggaaacttcatataaggggaattgtacagtatttgttcttttgtgactggcttatttcacagcataatgttttcaaagttcttttcatgttgtagcttgtgagaatttccttttttaggtgaaataatatttcattgcatgtatataccatactttatccatatatatttcaccatgtgttggtggatactgaagttacttctaccttttgcctgttgtgaaaaatgctactgtgaacatggggtacaaatatctgttcaagtcgttgcttttatggttttttttgttttgtttttttgttgttgtttttgggttttttttttttttttgagtatatacctaggaatggaattgctggattatatgttctttgtttaatttttaaaggaactatcatagtgttttccacagcaaccacactattttaacattcccaccaataatgcaccaatattccaatttctccacttccttgtgaacacttgttttatgcgtttttgataatagccattctaatgggtgtgcagtggtatattgttttagttttgattttcatttccctaatgatttgtgttactgaccatctttttatttgcttattggcagtttgtatatcttctttgaagaaatatctactcacatccttgctcgttttttatcgggttgtttgggttttttttgtcttttgttctttttgaattttaagagttatgtctatgttctggatattaactcctgaggtatatgatttgcactttcttctttccattctgagggttgccttttcagtctgttggtagtctttagatttgatgtagttccatttgtctatttttgcttttgttgcctgtacttttagtgttacatttaataaatcattgccaagtctaatgtcatgctctactattgttaaaagtttctttagctcttgtgtttaggtctttgattgatttgaagttagtttttatatatgttatcagataagggtctaacttcatttttttgtatgtagatatccagttttcccagcaccatttgttgaaaagactgtcctttttttattgaatggtcttgacactgttgtcaaaaatcctttggcagggtttatttctgggctgtctattttatttcattgatctatatgtttgtcagtatgccagtaccatgctactttgattactttatttttgtagtgtttccaggtgtttgttttttgtagagaaaaacactagtgacttttaatattaatttagtaaccacgtatcttactgaattcttaaagggtttttaaattgattttacaaagatacaattatgtctactatgtctactgcaaataattataaaatggtacttcctctcaaaatcttttttttttattttggtcttaattgcactagttttaaaacaatgttaattatgctgtctacataattgtatttcattttctcattgctggtttaatggaagttctaatatttcaccatagagtgtgatgtggcatttggtttgagatatgttcctaaacttttgaggttgacatcaaaaagcttagttgcaatttgttgcttaattgcaattttgtttcttgttcctgttgtcaagaatagaatgttggtctgaagacatcaaggagggactggactactcaagacagttgtgggatgtataaatatatcaccatgtgtcataggaacttaactaatttactttttctttttttttttccccttgcagaatggccaaagttttctggtcttggatgagcaacgatttgcaaaagaaattcttcccaaatatttcaagcacaataatatggcaagctttgtgaggcaactgaatatgtgtgagtatggacagcagtttattggagtaccattatcagctactgatgaagccattttttttcccattagggtggtaaaggaaaattattccatacaagcaccaccaaattttgacttgtttattttagtcatttgaattttgaatatttttcagatggtttccgtaaagtagtacatatcgactctggaattgtaaagcaagaaagagatggtcctgtagaatttcagcatccttacttcaaacaaggacaggatgacttgttggagaacattaaaaggaaggtgagctattgtgaacgtgagctaattagggtattgacctggagtgtgcttggccaagatttttatttcagctgttgaaagtacagaaatgcacaactgttccttgttgggatgaattaggataataaagttttacttgtttccctgtatttttttcctaagttagcttaaaaaaaaaaaaaagtttaagttcctgctagaatatgagctccctggaagactttttctatagtttgtaattgtacatccagtacctacaataagtctcttctaataatataaatatgcccacatagtaggcattcagaaatacattcagtaatatattttttaatgcataatatcttttggtaaaataagatattttactaaatctgtaaaaggggtggaccatgaaagaaaatggcctagcatgaaccttttactgcataaatttaattaaatgtggaatgtggtaataaagaggcttgggggaaattgcaaggagcttggcataaggggagaataaaagactctaagatattcctgcttgcggaaactttttaacattaaaaaaaaatttttttttaagtagattattccttgcgttctctcccattgagctctgaagtttattctttccctagcatttcatcccgggcttttggaaccagatctcacttcctgaacaggctacgaaaacctcttctaatagggaagctttgaattacaatcatgggtgtttactgtttctttgattttctaaatttactttttcaaaggtttcatcttcaaaaccagaagaaaataaaattcgtcaggaagatttaacaaaaattataagtagtgctcagaaggttcagataaaacaggaaactattgagtccaggctttctgaattaaaaaggtaaagtgttatttccaaatataattttaatctgggaattgggtatgtgtctatgtgtgttgagtttggaggttgtctgatgttttattgtaagtactcagatcactttgttgaagccaagatcaaaggtcatttttctgcaagtattggttccctttactttgatttgtggccactgactttactctaatattgttttaattatgatagtcagaagaagatataaacctaagcgtatcaaaacagtttgatgtataagtcttagcaataaacagtaggtctttaagatgatgtaggaaatatgattctatttaggttagctcatatggtgctcatagacaatgagggcatacgacataaaaaccctgtatgttacccatcctttgtttaatggctgtctcttaagatttctttgtgtggactcttaggaaaaagtaggacacaaaaaaatcggaaaacgatgcaggagagttgccatgcttgatacttatttcgtatagacttggaaaagtgttattcagagcttttatctacagaaagatgcttcgttttattttactacatttcttggttaccattattgtaacttgccatactaataacttgtgtatagagtagatagtgtattactcttcttagtaagtagctggaatttttctgtatcctaataggtgccaagggcttaagagtggttactttacatattctctcttccatatcagatgtgagacgttactttagttaatcataactcaaatatcttcattaaaagaggaacctataactttgatttcttttttaaataagctttaggctttctcttcttgtgtatttaacaacttgtttactgtatgtatcttgtgtatactagctgctctttgacccagttccttgggaccacagtttcagcctttaaagaaagtgatccccaaatcattttttgtaccttagagggaactttcttctccttatctttttgtttgtttgtttttgttttgagacagtctcactctgttacccagtctggagtgcagtgacttgatcttacctcactgcaatctccgcctgccggttcaagcgattcttgtgcctcagcctccctagtagctgggattacaggcatgtgccagctaatttttgtatttttagtagagatggggtttcactgtgttggccaggctgttctcaaactcctgacctcaagtgatccgcccacatcggcctttcaaagtgctggaattacaggcacgagccaccgcacccagccctacttatctttatttagtaagcagataacaacattttttaatttgaatcagaaaaatacagtagttattcagtaaatattaaaatctcctttggtatacccttatatgtaaatctccagttccttttatattagtttggattaaagaagatgacttgtggagaataacaaaagatggaaaattaaagcatttaataggtattcagcattctccgtgctgcgaacatttaacaacataatgcagtttcaattaaaaaaggtgaacgaagaagaagctattcatatttggcaagttattagtttattattggatatgctttttcagaataacattttagtggtttacatatgctgttgtttgagatagatcttaagatagttttagaatctgacagactttagtttgatttcaacacttaccaaattatttgtatgatcttgagcagttcccctcaattctctgtacctcagtgtcctcatctataaaatagagatgatgacttatttcttggtggtttttagagaaattttaaataagtaatacacataaaatgtctagcatagtgcttagagtatagtaagtgctgggtatatatcactaccctttatttcctaaggtgattaggaaggcctgaattcacttggtaaccacagttgaaagattagcttatttttttttaagcaaaaaataatgagccagattgtcaaaagtagtaaattgccaactactatattgatgtaggcatatgtcttaagtttctgtgtatctattgtcatgagtagcagatactacacttaggaaggaatgattctggtgctgggtgcggtggctcatgcctgtaatcgcagcactttgggaggccgaggtgggtggatcacctgaggtcaggagtttgagatcagcctggccaacatggcaaaaccccgtttctactaaaaatacaaaaaaaattagctggttgtggtggcacatgcctgtaatcccagctacttaggaagctgaggcacgagaattgcttgaaccctggaggtgaaggttgcaatgagccgagatcgtaccactgcacttcagcctgggcgacagagcaaagctacaccttttttttaaaaaaagaatgattcaggagttgtgtcaaggtagttgtcattcctatgtaattgaaccaaagttttcttggtctcataaatacatatagtaaaaacaagtgtagttcagttgtctggtattcttaattaaagatactatggtctggttttttgattgattttttttttgttttgttgcttaataaattataacatagtgagaatgagtccctttggaaggaggtgtcagaattacgagcaaagcatgcacaacagcaacaagttattcgaaaggtaagaagctcttttccccaggaccataatttgcatttgtttaatgagtactgtttgtgacccaaaaaggtctttattgagtgtctgtgattgatcttagtttcttacatattggatgcacagatagaagtaaaaaatgaaatgaaattaagccaagtgttacacatttttaataaaaaatttctcactagctaaagatggttattccatactcgcagataatgtctcagtagcttttagtaaatgatcttttgcctaatataacaattttgaaatactttatttttatgagcataatgaatacactaccaatttcttttaaaattagaaaacatagccttactggttttttttgttggtttttattataaaaggcatagttaaggtctcagaagataaatgacaaatattttcaaatcagttgaccaaattatgagttcagaaaatgatttctcaatgtatgctgttattagtctgtggagaaaagcagttaacatagtgttgtaaaatgaattttagattttagtatctgagctgaaaatttaatagaggagttggaatccctccgtttcattgtgtccttgtgatttaatctttgcatatcagctttcatttgctaataagagatgaaacatagtaattaaggcagctattttttgctcatgagtaaactagactctgagtttaagcaacaggttttttgagggggagcttctgattgctcctgcttagaaggcccttgaactaaaaatagggttgtgactgacaggatcagggtctaatggagaaggctttaaagcagagatgagtagcagttgcagcctgtagcctagtcaacatagatttactgtgtttttttttttttttaaagtgtgcaagtgaaggttgaatgtagtagaattcagttctaagtgtttagtccaagtacatgtatttttaaaactttcataggcaactctaatgtgcagcctggttaagaatagttgacttaaaacaatagatgtaccttaacctgtactttatggaaacagtctgttaatacttttcagaaacagtgttttggtaatatattagcttacaacactctataatgtgtagattttttttttcctgaaagcaagaatagttgataaaatagctatgtgacatttcagtttttcatgaatgctaacattctgtctgctaaaatttgagtttgaatctctgtgctttggtgagtggtgtttatataatgcatgacgacaaccaataatttttactctgctcctggaatttactctcagccatggattaattgagaataatatgtgtgatggtccagttataggacttaacaggtacagaagttacatgctgtaagtgttagacgccttatcttcttcagataaaaatccctgtgtaatgtgatccagaagtgtcaacagagaactgagatgtagaataaatttaatttagccagtgattgatgttcttataaattcaacctgaagtttttagaatattcccataacatttattaattaaaaaaactgaagtcgaattgtatcatagatatctttaagcttacatattgtcttttcactagctgttaacattttctcttgaataagcaatttagtggctaccctccttttcatagactctaatactatgaacctcttcagttaaaatgtctatatttttttccattgaaaaattgatattgattataaggcagaccatttagtagccttttttgtaaggaaatgctcactgttagaacctgtacaatagatatttttaattgataatactctatttaatcatgtaacttcacaaagcttataagcacactttctgcacagagtctaaatagtgctccaatcaattttggcttttatttatagcttctcagtgatatactactttttatagtttaccatatgatcctcaccttttatagcacctttaggaagttggcaatgtaatttcaagacatactctaagccagtagttcttatactcacatcagtatccagtctacactaaagggttttctaaacatactggatcccatgatccgaatttcagattcagcagttctgtagtaggattgagaatttaacatatccaaagttcctaagctagtgttcctggtattatgggccacactttaagaaacactactataagatatgaaagcttgtttgtgtgtcttcacaattttctctctaaatttaattaaatattaaagattagcttcccttgtcagtaggaagttttgacagataggtctcaacattaatctttatagaatcagacaataaacttttatctttttcttttttttctttggttgcaagcagagtttgtttgtttagaaatggagcatcacgatgttgcccaggctggtctccgactcctgggctgaagcaatcctcctacctaggcttcccaaagtgttgggattacaggcatgagccaccacgcctggcccatcacctttttctaactcgaaaatttcatgattattctgaaggaactgacggtttattttgcctctgttacctggtataagaaaaatgttgcctatcaaacaccagttttctcttttgcaccgtagtgtaatcttcaaagtacttgaagtaaaaaagttgggatctatagccaggcaagtttggtacttatcaccaaaacaaataaactgcctggaagctggtatgtttctttagacggtggttctacggtgcgtctggatttcaagtgttaatatgtgagaaattatgagacttagaggacaaattattatatgaatttgttttataagacttggtaatagagacaaaagaattaacagtataatgaaataatttttgtttatatttttttcagattgtccagtttattgttacattggttcaaaataaccaacttgtgagtttaaaacgtaaaaggtaagtttttatgataaagtattatgtcctgtatataggcagtcacactttttagtgtttaaccatgagtagcctacacttgctgagtatgtgcttgttgtccaaaaagaacaattctcctttgttaaattatactcttaaaatctctagagtagtattattttttagttttatcattctgctgatgtttgtgagagataagggtagcctaaatggtcactttatagacatacatacagttaatacaaaatattcacttttcattcacattattaaagtagcattagaaggcctgagtgaaggaaatttttaaaaagaggccatatgttaaaaaaaaaatgaaaatttgttttacttgacctctcttagtttaagccactcatagtctttttaaatctgtatctcagccatgggtcgtgatacctgtaaatgtcagtagctactattgtcacagctaaaacattagaagaataatggacaaaaggaatagttggaaggaaaaaatgatctgtaacactaagatttgggaaaaacttgattatgatcagagctttatggccttaactacttccactaattagttcttatgatattatctatttttttctatataaatacagttcatagagttgtgtggttcggtaagcaatgaagtataactggagagaatagcttattataacaaaaagagtgtagaaaagtggagaactgaaagtcctagatattctcatccagcagtttctgttcctaagatgtaatcatttttaagtttatttattgttactgaaattttttattcattattaagtgagtgtgcatgtgtgtgtgtttgggtaagttaatagagggagtttaaattcattgtatgtttgcttcactgaactgcatattcttctggttttcaggcctctacttctaaacactaatggagcccaaaagaagaacctgtttcagcacatagtcaaagaaccaactgataatcatcatcataaagtaattttttagttagggtctattttatatttattgtctcagactaaattttattatggcagtgtttcatgcattcaaagaagtgtggtgaataacaattcaagtgttcatcccacagctttgttaaattgtgacattttttattatttgctttagattattgtaagaaataaatcatcacaaatctagttgttccagttgcctgtttctaagtttttctctctccccgtctcttgtctcccctctttactcttcctcgcttaccctagaggtaatcactatcttgaattagtatctatcattctcatggccattttgtatatgtgaatccaggagcagtacttggtattattttgcatatatctaaacttcatataaataatatcattttgtgcatatcattttatagtgtggcttttttttttaacttgatgttgcttttgagatttattaaacatagcgatttagtttattcatttctttttttttttttttttttttttttttttgagatggggtttcactctgtcacccagcctggagtgcagtggtatgatcttggctcactgcagcctccacctcctgggcccaggcaattctcctgcctcagtctcctgagtagctgggactataggtgtgtgccaccacacttggataatttttgtatattttgtagtgatggattttcatcatgtcacctttgctggtctcgaactcccagactcaagccatctgcctgcctcagcctcccaaagttttgggattacaggcatgagccactgcacctggcttactcatttcaatattatataataattgaatattttgaaaatgtaattattataatttaatgtgattatatattcttacattggttattctattttcaacttttttttattaatgttcaccaactagaatgctttttactccagcaatttaaatttttaccttcattttgtcacaggctttctggataatttgtcagatttctatccagtggcaaattggtccagtccaaagtccagatcttttttattatctttttgttactactttcaaacttcagaattcaaaatagttctttagatttattattaaagtaataagatttttgttcttggacaatcaaacttaacctcacatctgatttcttttccctctactgttagaaaataatcaagcatacctattttgtttttaggattgaaggctcatgtaagtggatgaagatttttatatttttaactgggtttatatattttaaagtacttcacatcctttgcctctttattatctagtattggaatttatagttttttgcattttaataatgactttagtttgctttacaggattgaacttagtttgattaatacagctgtagcctgaatatatctgtagcttaagtttaaaaaaaaatcattgctaaaaagccaagctaacatgtaactgagagaggtgaagtgcgtttttttctcttagtgaaggtatttaatgaataagaataaaacacatttcaaaacagagcatcttgagctgaaacaatatccctatcagcatggtggctgtctggtcgtgcttgaaatttctagtgaagtcctaagacttttttactctttaggcataaaaaatactttaaaatttgaagatctttccatagaaacatttttaggggtgtcatcttcagggtcccttacagtaaaagaagtagtaaagtgtagaatgcagttaatatacctcatacctctgtgaattggtgctgctagtaccaattattatgtaagttccgtaagagcagagaacacacctgttttgcataccccgagattcagtaaatagtagttgcctagttattttgtagatgatatcttgtttggtagtcaatgattttgatttttagatatatttttctctctgaatttttaggttccacacagtaggactgaaggtttaaagccaagggagaggatttcagatgacatcattatttatgatgttactgatgataatgcagatgaagaaaatatcccagttattccagaaactaatgaggatgttatatctgatccctccaagtaaggagtttgtgagataaaatgtatgaaaatattgattacttttcttattacagagcaaaattcaaaactactttgttctttgaaaaataataatctttctcacatttggattattaaacttgataattaagctaaattattcaaccagataaaacctcacctcctcttcctctcaaaggaggtatactgaaaactaattgatttttaatttttattttggagttaagcacttctcattcaatctttatggtcttctatactatgaagtaccaatattgtgattaagctgctcgctcaagaaatttaagcctttcagtatgtggtatggggagagagtttccatttagaatgaatggatagtatgaacttattaaatttgaaaatgtaataggttccttcttttattgctgatttagctgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaagtgagtgcttatctagatgttgtctaaaattatttgctttctttgttcacttcacatgttctgtttctctttgagtaatcttcctttcagatgatgaacccacatagtccacctttctctgttttggtcagtgttgagttctgtaatgaatgggatttaatcatcccaagaatagtcttggtattttcctggtagtttctcagattcctttgatgatatacttcctttgagtgtacatacagtgtttgtgattatatatatttgtgtatccaaactacagaataatgtaatttctagtaaggtacttataacaaagaaaacttaatagtaataatcagtaatgagattaaacattttatatagtatagaggaaaaaggtaaatcagactgttctgcagggtgtgtttttctgtaaatactaaagttttctgtaaaggctatgaattttcagttaaccagattttcaagaattcctactctagaataagatctcttaagattaagaaccggtaaggatgcagcagctgctagaaatatcttgcctagccaagttgtaatggtgatttttaaacataaaaacaaggatatctaatatttgattaaaaaaatttttttttccttagggttgagctgttggattatcttgacagtattgactgcagtttagaggacttccaggccatgctatcaggaagacaatttagcatagacccagatctcctggttgatgtaggtactttgggtaatctttgctatactggtagtttgtgtgtttatgtatattatttaaaaaccagtacgtcattttgttttgtattctacaggttgtttttgcatttcttttttaaattaataattttgtttatcagaaagaatgaaaaaataggtttgggacattgaaggagtgtgattaccacctgccttggagtagcaattgaactaatttccctgtgagaacatatcagatcttttcagcagtactgttaagttcatgtcttgtctggacttgttgctcttttctgttttgctctagaatgaattgtcagtaaatagaaatttgtggaaattagtaatagaggtacttagctaggaaatagcatggagacaccttttgatactttggggattaacattttttactcaaatatgttttaatatatttgccttattttttacatttttatattttgagttacaaggttcccctgctccagtccccaccaccatccctatgaagttgacttcaatattgactggactgagaattcttatctaccgtttctgccactaaccacctttcttactctattctctcttgttcctgctattcctcccttctttatctaaagcttcctacgtggtctggtcgcgcttagatgaatcttgttctgtctcctatttccattttctgttgtgaacagttttctctctttatcctggaaaattttgttgtctttttttctgtgtttctttccttacattgcagcttctcttacccttttacaagcctctcaggctaaacaagaattagttctttctgctcttcaatcttatttcaagttcattaatttactgcattactcctctgcttctcaccagtccttgtcagtgccccaaggacttgttcttactaaattgttagcacctcacagaggggattttactttctttgaagatttcttttccattttgacctgtgtttctatcttatgaatacatgttaatttgaattttgtatccatgttgataacctacttcaacttagcggtaacctgacagtgttttttgatcctatcagcctttctcccttctttagatccagagacctttcaaaatatttttcctttagatcaccaagaacgaaataaaattctataattctggccatgttcaaatccttacagtcttcagctaggtcattttaattcaactttaaaacatttgccacatttatttgccctaaagaccttatccagtcaacaaccccttattcacagaggataattaactatactctcattctctcataagtaatgactctgtttccaatcttgtatcctttcttcttagaagtaattccttaaaccaatgtgtacccctatcctttgcctctgtatttgtctcctctatccttaatctttcccgtctgccttcagtagttagagatctgctccatcttaaaaaacaaccattttgacatcttgctttgttcatttaccattctgcttctctaactcctttactacaaaactttagaaacgagtggctgtatttacctcttttttactctattttgtctgaagctttgtattgtgttgcttattaactcaaactctgcactgcctgtgttgtcttggtttttttcattgtaagtacgctgtgtgtgatttttcttttctttttgctgtattagtccattgggctagtggaaagtttgttttgaatcagacaaatttgggttctgttataggctcatgttacttactagctatgttactaacctttgaaaagttattctctctcgcctagtttctccatttgttaaatgttgctaatgtctaacatgaagggctgttggcaagaattagaaataattaacactattattaacattattgggcattctgtacaatagaacttttattgttgattttagaggtgctgtacttttttgttctctccctgtctccctaatcttctctgttttatctaagagcttttcttttttctactatcttctacttaagggcatcccctaatgcacccaatctttcagcctcttttactttttctatctctcttctttttccattcttcctctgtgaagagattttgtcttgtaagattgctttcaaatgtgtatatccagctcttaacatttttctaaagtaaactggacttgaattctaattccgttactttgggatcatcagttagctcttacctcagattacttgatttaacaataaacttctttattctctgtattagttacattttacagctttctgattttctgtagtggtattacttctatttacttaggaggatagttatcacagaatcaccttgaattctctttctctcatcattcactaaatccagttttctaaaatagcattcacaagccatccctatattctgttttcactattgcttttctcatccaagaccctcattattttatccttgaattacgctgtattgtcataaataaaaagtccacctatgctgctttgttctctgagatgacaaaaatggtaagaatgtgaataagtgtgctgaaaagtttacagcttctctctgaagagtttagtaccagtactggtaacccagagtggggtcacagcaggagaggcctggccttagaattcaaccagctgtgtcagcttatatatgatctactttttctaccatttgtctcctaggaatacatgtaggatatccctgagttagtgggtaggggttgctgggcaaagaggagaatagaggagcttacagtgctggtcctcctcagatgccactctctgtagggacaaaatttgggttaggcttcttaggcagtgataagctaaactggcagagattgattattatgagtcactatctactctcaaggatctgagctttcttccttttctgaggttagtagttggtaagaaaggagaaggaaataaaaaggcaaagccagggaattttataggactaccatgaatatggaactttaaagagaggaatcagtgtctagagagaatggaggaagaatctgcctgtggcttttttgcacctcattctatcctgtgaaccatttggtgtgttcattctcataaaaggctaactcagtgagtgcatttcatcattcaggccattcccaaggctcttattgctgacaggatgtggcctctacttttcgaacctatgtatataacttattcaacttagaacttctgtgttatttctatttctggaacatatcctaccttctttgttgatgccgctagtattatacccgtgtgttcttcccctagtcttctcctttccaagttctaacctaatattctccaggtactgatatatatcacatagttttatcagcccttttatttcattatgtatgtttctgtgtgcgctttcctcccttcccattgtcttaactccttagtgcttttgagcgccaccatcttctgttaaaatactggattatatctgaacgtgtgttgctatttgatgttggtcttaccttgtcctttagattgtaagctcctagagagcaggaatgatgtctttatgatgtcagttatttgttaaagatactcagtaaatttctatggaatgaatgactttaaagcttatgacttatagttacatctgtgaactggctggactgaggagtgcagtaagcagtgatcttagcacttaaaattttccttgcgaggtgtggtgaaaagaaccaacaagtagatatgccatctgtcagagggcttcacttgaggcatagtttaggagccactgtcatagagcagattctgtaaattttttacctaaccaggtattcagtgaaggctcagtgtcagggcagaggtctcaaccctgcacaccacttaaggccaaagacatttagagaaaaaaaataaaggaaatgaaattgaatgataaataatgaagaagggaggaggtgaaaaccactatttgtctcaagtgatttaccccaatgttttttagagaaattcttaccacatgaaattttatctaatgcatgggctagcttgttctgcttttgtttgtttttctttctgcttttctctttcaaacttgtttaactgtatagaagcttcctagtgcaggggctacatctcttcacccaacatggctgtataaaattttgaacacacaattatttttaattattttttaaacttatcatctttcttgtttggtctttcagcttttcactagttctgtgcagatgaatcccacagattacatcaataatacaaaagtaagttttaattcatgttgctcaggacccatagctataaaaatctacaaaaacgtcctaataagtagagagcaatgtcactcccagccacaaaaagcattttatattcttacccagtatgtgtgatcaagataataaaattctagttgaaaaattagcttttggttatgtggtgaactattacccacttttggcacttgtgggattaactaccagtatgaaattaacttcttttggtgctgggagatcacctgactaaacttggtatattgaaaccaataactaaaatatgatttcttcatgttttatgggcagcattttacattcttatttttcctattctcaacttttttattaaaaagttatagtacccatattttttgtgagttctatcattagcataaagtaaaaattcaggaattcttatttattgcagaaaagggaagttgaaacgtatgaatatttgactttttttaagtaataaggattttttttttgacatataggaactgcacttgggcttagcaagtgttgacaagagattttgcggaacttgtttttaatgagtagtaaggacaatttgaagttattagagcaggtgttttatatcattgtattttatataacttaattgtcatgaataggtatacactccctttatcttttatttgtaccaaattgtttagtaagccttgttaaaggtaaatcaagtccagattccagattagtgaagccagaattttattttgattctttttctttatagtccaaaaatgagcacatctcaaatatatataagtgattagggtgaggggtggaatttatacgattattgtcatgtgtaagcctgaccagactgtctatatcttcaaagttacattgtggataacttagagcttaaaaaatttgtgaatttgtgaaataggaagttgattatacattcagtattcagataatttatattggaggttggcatactttctccataaaggggcagctagtaaatacttttggtttttcaggccatatgttctctgtcataactatgcagttctgcaattgtaatgtgaaagcagatacagacaatatgtaaaagaatgtgtggttgtgttgcaaaaaaacttcatttacagacaggcagcatgctgaatttggcatatggaccataagtttacctggatttatattacaagattttatataacatgctctgtgtttcagtaaatatattactgaatgttattctcatggaccatttaagttgaatggacccatatcatttgttcatgtagtgaatgtgctttgttgtttatttgcgactggacattgagtccttatttgtggatcatcatcttattcctgaaaccaagaccttgattatagttttcaaaaactataagcagttaagcaacaaattgcattttgctctacaatgctgtagaaaaattacatttgagagtgacttttcattatagttctgaatctagattttaatgttttcaaataattggcacatcagctgtccttcccttgctcatgacaggtattacataacatggattacaacactttcctaataaatcagatgccttatacttctcagtacagcaatcttaattggccactatgaatgaataagaatttgcatgggaaatgaaatctcattcagtatgatactggctatgggtttgtcataaatagctcttactgttgtgagatatgttccatcaatacctagtttattgggtgtttttagcatgaaagagtgttgaattttattaaaggcttttctgcatctgttgagataatcatgtggtttttgtcattggttctgtttatgtgatggattacgtttattgatatgtgtatgttgaaccagccttacatcccagggatgaagccgacttgatggtgatggataagctttatgatgtgctgctggattcagtttgccagtattttattgaggattttcgcattgatgtttatcagggatattggcctgaaattttctttttttgttgtgtctctgccaggttttggtatcaggatgacgctggcctcataaaatgagttagggaggagtccctctttttctgttgtttggaatagtttcagaaggaatggtaccgctcctctttgtacctctggtagaattcagctgtgaatccgtctggtcctggctttttttggttggtaggctattaattactgcctcaatttcagaacttgttattggtctattcagagatttgacttcttcctggtttagtcttgggagggtgtatgtgtccaggaatttattcatttcttctggattttctagtttattcgtgtagaggtgtttatagtattctctaatggtagtttgtatttctgtgggatcagtggtgatatcctctttatcattttttattgtgtctatttgaaatccatttgttatcaggttctcatgttttagaataacggtgacgtctttggaaaatacctattttaggaagcctaaaaataaagatggtattatttcattaatgtttatatatttattgtgaatgctaagtgatgaaatatttttatgtacacttttggaaaggtttcgtagtttttattatatcttggagcccttattttctcttaaatcctaaaacttacacagcttcattttatgttaaatatcaggggaattactggaattagtttacagttggttacaccatatatatttagccagcatgtagatctgggacttgcagatgtctgggacttacaggaaaaattaagaacctctgcacctcagagtttgaacatgaaaggagcactgaagaaattaacaatggtaaagatataatttccctaccacagtcagatgtgaggagagaagaaagtggttcaaagaagcaatttaaatgacagaaaagaactgacagagctacagaaaggacaagaagaaacaccacctcaactttgaggcttctaaatagtgataaagagttttaaggatgtcattatgtcatcctgagctactctaaatatgttcacttatgctaaatattctgtttatgagtgaaatgtataatacattttttaaatcaaaactacttaaaatgaatttaattgcttagttaattatctctcaattaacattttgaaaccagtcatctttgattcattctgatcttttactcgtgacaaattctatctgttctgctgctgaaatcccccttcatttcatacttaatatagaacatcttaattcaggttctttgttttatcccctcagtgacagcaatagttccttaaccagtcttgttatctctactcagatctctctctgtagcccattttccctgatgtttccccatctcatatatttcagataatataccagtatttacatattgtatcaatttttcatttttttcagaaacataaaatatgaaacaagtacttatatatatattttttttcttttagtctgagaataaaggattagaaactaccaagaacaatgtagttcagccagtttcggaagagggaagaaaatctaaatccaaaccaggtaggtataaatatagtattcagtctctgtaggtttttttaatcctatgcagaaacaagtgcaagccgagggtagtcttaattgaatatgctggctttagttctgtgaatagtgtgtcgaggttctagtatatagagaaagttgaattggtgaggtaacaattctttaagttttttttttttttatcctatttaactttaggaaactaaagacccctcatttcttaattgttgaataagagctattgacttgcacattttaaaatttattgacatagtgcatcatgtcatttcttgtttggctatatgagagtagtaattgcctatgtgtacatctctgttttcatttttttcccctcagcttgaactcagtataagctggtgataaaagagtgtttttctgatctttatagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtactagtgtctgttatgtgtcttctttagaggtgacactcacatgaaacaattttttcttctcataggaagcagtagctttaaactgtctgtggttcattattctcaatatgaatcataccaagatatttgtgcctcatctcgaaaatatattgtatattgcaacaagggagaaatataatctctaaatttaatgtattttaaagttctttgtttaaaaattatactgggttgctttctatgtttctaataaaaaagtgagagaattatgcctctcattgtcccaaatagtgtaagaatattatcactggatgtctggagagaagataagagaaatagtcaaatcacctctttcctttgaaacagttgcccaagagaattatggagacttaatgcaaggccagggcactttatcatgtgaagaatttcacctttgggcaaagggctgaaagcagtacaattaatattgtatagggctatttaatgagtttcaaggcaggttttcctattggccatattctgtcagtgtcttagaatttcttttattatgatgtaaagattcaaagtaagggctagcacagaagaataggaaaattcccttaggagagttttagttagatcctaaaatacttggctctgatggtgggatcttggtgaattaattcaagaccctacaacagtgctctgcgtgagctgaagaggttatgtttctaagggtgataagagtttagaaactgagaggagaaaaccttaaaagacttttcttcattcctttctcattgtgaaatacagtcaagtttcttcttcttgggggcattttggaactctagaagcacttaaaaaataattttgaaaaacttgattatgaccctggtacttttaaagttgacatttaagatttttcatcttaagtttaaatagttggaaggaatttaggatatagttaatattgctgttttaaaacataattgttatatgtttctttaacatttacctaaaggaatttgaatgccatagtgatttgatctctatcatccactctacttcctccaaacaattttttttttgagacagactttcactctgtcgcccagggtagagagcagtggcgtgatctcggctcactgcaacctccgcctcccagattcaagcgattctcttgcctcagcctcttgagtagctgggactacagtcatgtgccaacacacctggctaattttttatttttagtagagatggggtttcaccatgttggccaggccggtcttgaactcctgacctcaggtgatctgcctgcctcggcctcccaaagtgccgggattacacgcatgagccaccgtgcccggcttcctccaaagaattttatcctgcttttttatgtttgaaagttagacaatgatgatctttcgtgacacctctttacatctaaatttgagattgtttcccataactgtaagattctaggcattaaaaaactttccctccaattttatactgtataactacacagtggattaaaaccatataaatatatatggtagagacttaactgattgccagaccgtttccttttcctatcatgtggctagattatttccaccactgcagatggggtagccatgtaactgagttttaatcagtaaaacaggagaagtgatgtgtagcacttccagttctggtggtgtaacttcccccatgcattcctcccatgccatttacccctccactggcttgatgcagagttgtatgtagctttcaaatatacaatcaagaaggaaaaaaatggcttcttgaattactgcttagaggaaggccacctatcagtcctggataaccattttacacttcaggtgaggggaaacaaaccttttttctacctgagtttttgggggttgatctgttatagcttgtaatgtttactacaattagagtctaattttgatgatctgttaaacaaaaagttttaccaaaaatatatcttatagtggaataaacagctcttcctgagtt

SEQ ID NO: 13165 - DNA, 346112 bp, Human
  misc_feature (1)...(346112): n = A,T,C or G
gttacaagatcccatccacattcaaggggtgaataaattccacctcttcttgggaaaagtgtcaaagaattgatggccatttttagtctactatgctaagtgcagccccttcccccaaagttatccttaatgcagtccctttgtgcctccactctcctcttttaattcccatgcttttcttatccttttaataataagctctcacttcacatcacccaaagcttcgttcattcacttgacaaatacttactgtgtgccaggacctattagtgaacaaaacaaagcccgtgctctaatgaatctaagattctagtggagagagcggacaatcaagaaataaacaagaacacagtgttgggctatggtgaacaataggtgctttggagaacaacagagcagactaagtgcggactgtgtgtgaggatagcagggcagtgggtggttcctattatatggagtggtcggctgtatcaatgaggtgatatataagcagggtattgaacgaagtgaggagcaagaagttccaggcagagcaaatagcacgcgcaaaggcctgaggctggcatggagaggcaattccttacaatttcatatgtagtaaaaagtaacaaaacccagaaaaacaccaaccttaatacatctcattaaagaacaatacaacccaaacatttaaatatggtaaaatcttgataagcaaaagctttttattttacttcatttttacttttataaaagctcctaatgcaatgacgtgtgtcacctctctgggcttcagggtgttcacctttcaaaaggcctcggtgcctgtctgtcctgcttcctggcttgtggttagcatcaaaatgacaccataaaaatgaaagttgcagccttgagggttcttctggtttcatttccgaccacaaggttgccagagtgacttttttttttttttaaataacacaaatcagttatcacttcctgcttaaagccctccaaaggttccctgttgcctaaagaataaactccaggcacctaagcaagccccacgcagccgtctgcatttttcaatccctccaacctcgccttttgctatttcccccaccccacctacggcacgttccggtcataaccaactagctcctcgctgaaactggctcacaccgcggaagcccgggtcggtgtcggggcgagccttccctccttttcctggagcccgtctcaggtctgtagccctcgggagggattgcagggctcgttccctgctggcgttcatttaggtaacctgtctacctccagtggacttctaagtccctttcatgatttttcatcttccaaaatcaaataatggcccagcccaacttagctataatgccatgaaaagaatctctgagcctcagtttccttgtctgcaaaaagggcccaggaaccgctcgttagggtcggtgtggtgcctggagagtgcactgcaaggcccggggcccgcagcgggtgcccgacagcgggcgtccaactctgggggcggggccgcagggccgctcaggagggaggttctccagaggggaccccttcgggatttgggggcagggaaggagatggggaggactttcccgaagtccgtctaatcccgctggcggagagcgaggcaggtgggaccccaggatgtccgctcggcggggcgaccccggccacccccgagaccagggctttcctcgtccggccgccacgcccgcgcgcagcctcgggccaccccgaaaccccggcgcggtcactacaggacaaattacgcgagcagagcctagcggcgcgctgggcatgcgcgggggcggcgcgcatgtccagtccccccgagaggcgggaactccggactgagaccgggtcgggcgtgcgctgccgagagaggacgcgcgcctcagccggctgccgcgcacgcgcgcgggcccgcgccgacgcagcacggcctcgagggcgcgacgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagtgagtgcggggcgccgggcgcggggcgcgggtcgggggctgggcgggctccttctgtgcagcggtcgtgggctgggccgcggccctgagggcggaggggcagagcggggccgcccaaccagtcccggggcggatgcggcggagaccggcccctcccgcgcccccggcccgggttctgggaggaggggaggccggtggccgtgaggaggttgggggccctcgcggaggccgagaggcttaaggaggtcagggggcgcgctgggaggcgggggttcggggcgctgggtggtcgggaggcttggggaagactgggaggctgagggacgtggggaggccgggagctcgaggaggtcgggggttttgggggcgcgcggggaggccaaggggttcggggaagacagaaaggctgggggacgtggggagtccgggagacgtgaggaggaaggggggggcggctttcgaaaaggccgggcgcgcggagaggccgaggggcctgaggaagacgaggaggccggggctctgggggcgcgcagggcggacagaggcgcggggaggacgggccggcctccgccggagcggacccaatgcctgaaaaacaaaaggggagaggcaggaggaggaagagggaaatcgcagggacgtcggcagggttcgcccggacgcgagagggaggctcgcgacggcccgacctccgtcccccgggcgcggcctcgcgggcagccaagggtgggctccgagcggcctgccggtgcccgagccccaagcccgccgtgtccccgaacgcaaaccctcaagtttggtagagccccgtgggcttcttggcgggagccctggagccctcactgaagtcctcactggagtcattgtgcttcccaagttttctcctcttccccgcccccagcccccgactctgccgcggtggcttaggcgcaactgtttgccgaatttctctctgggttccttgtgtagcggcatcctgttctttcttagaagaagggtgtgtgtgtgtgtgtgtgtgtgtgtgtgtgtgtgtgtgtgtgtgaattggtttcatttaattgcagaattttgtagctaaattcagtgagggtaaagtttcttttttttttttttccgagtcatttcaacagtgtctcattcttgcatagttagcctgcagctgggtttttggcaatgagactaagataatagtaatattgtagtaattatgggaactggttatacattcaagctgaaagctgaaggcagtgcaagagtttggggatttgtatttaagacttaaccatcgctaggatttttacttagaatgtaaacgttttcatggctggaaaaacagaccagtactatttgaaatgaaataccagagcctcaaccttaatattttatttgggaaacgggtaatgaaaatgatgtcttcgagagttgagcactccgtcccatatttgaaaacttatgagcagtgcgatgcaagcacacggatgaactagttacaagacacataaaagtaaactagcattcaacgtatttttgttggggtacagtatagataatattttcatccagttatactagccaattaattagaaaagccctatgatattcaaacaaggaacattttaaggatgtttgtgtcccaatatctttgtgttttgtatttgtggttatccttggtggggaaaaacaggctgaacctaccatcactttgaaccttcttgtttattaaactgcagaaacaacaagatcaatattacaaggttttcctttaaagaatttcaggtcactatcaaataatctagtttaataatgaacacaggcacagattatttaaaacacatgcttcctttataagggagccgacaatcacctaagacttcagtgtagacgctgattagaaggacccatacatcattcagtggtgatgcatcaagaagcaagtcattggttaaataaagacatggaaatcaaaactccatgtttacggtttggggcaaagaatactggggcaaactctgagaggagatgggacttaaaaagccttattatttgaggctggaagcccattgaaagtgaataatgttagattaggagtgaagttccatgaatccagcagtgaaattgtgaggaggcagtgaggatcattaaaacgttttatactaaaatgttttctgaaaagcaccatgcttcttgatggaaattacataacttactccctcagtcctcaaaatcatgttctccagctagtcagataactgttctttctagggagttggagaaattgtctaagaaaatagtttttttttttttttttttgagacggagtctcaccctgtggcccaggctggagtgcagtggtgcgatctcggctcactgcaagctccactgcccgggttcatgccattctcctgcttcagcctcccaagtagctgggactacaggcgcccgccaccacgcccggctaattttttgtattttttagtagagacggggtttcgccgtgttagccagggtggtctcgatctcctgacctcatgatccgcccaccttggcctcccaaagtgctgggattacaggcgtgagccactgcgcctggcctgaagatcctgttgttttaaaggtagcctctttaaaaaaaaaagattaggtcctgtagatgaaattatttatattgtattctataatgtaaaaaataattttgaaaactgtcctttcctgaatgttgatttgagttagagaggtaggatcttagttcatatctctaaaggttatggaaacctttttccccttgtattttatgatgtcttaatttttagaaaataattaaaattatcttgagttacaaaagatgcatttcaaagtgtttataaagtttcagttttgaaatttaacattttcagtttaggcattctaaactgatgtagatttagacctagatcaattcttgttttaaatttcagtaacattaaaagttatactgtttgtatcatatttgaagtgaatttttcttttttgctggtgaaaaacatctgagaagtttagttcctgtagtataggcatatcttggtctgtttctagaccactgcgataaaatgagtcacacaaattggtttcccagtgcatataaaagttaggtttacactatagtaagtgtgcagtaacatgtctaaaaaagcaatgtacatttcttttttttgagacaaggtcttgttctgtcacccaggctggagtgcagtggtgcaatcatagctcactgcaacctggtcctcctgggctcaagtgatcctcccacctcagcctcctgagtagctggcactatacgtgcataccactactcccagctaatttttacatttttcgtagagatggggtctccctatgttgcacaagttggtcgtgaactcctgggctcaagtgatcctcccaccttggcctcccaaagtgctgggattacaggcatgagtcactgtgcccagctaatgtacatgacctagtcaaatactgttgatcatctgagccttcagcaagtcataatctttttgctggtggatggtcttccctcagtggtgatggctgctgacaaatcagggtggtggttgctgaaggctgagatgtcaggcagtttcttaaaataagacaacaattaggtttgccacatcagttggctcgttctttcattaaagatttctccagagtatgtgatgctatttgaaagcattttatccacagtagaacttctttcaaaattggactcaatactcctaaacactgccattgctttatcaatcagtgtatgcaatattctagatcctttgttgtcatttcaacaatgttcacagcatcttcaccaggggtagattccatttcaggaaaccactttctttgctcatccctaagaaggaactccttatccgttcaagttttatcatgagattgcagcaattcagtcacatcatcaggttccacttctaattctagttctcttgctatttctaccatatctgcatttactttctctactgaagtcgtgaatccctcagagttatccatgacggttggaagcaagttcttccaaactcctgttcataatgctattttcacctcctccaatgtgtcatgaatgttaatggcatctagaatggtgaatcctttccagcatgttttctatgtacttagcccagatctatcagaggaatcactatctatggcagctatacccttatgaaatatatttaagacttaaaagtcaaaatgtcttcttaatctatgggctgtagaatggatgtggtgttaacaagcatgaaaacctcattgatctctttgtacatctctctcagagctcttggacaacaggtacttggccaatgaacagtaatattttgataggaatctttttctgagcagtagatctcaacagtgggcttaaaatattcagtaaaacatgctgtaaacagatatgctatcatccaggctttgttattccatttgtagagcacaggcagagtagaattagcatcgttcttaaggaccctgggattttcagaatgggaaacgagcattggcttcaacttgagatcaccagctgccttagcccctaacgagagtcagcccatcctttgaagctttaaagccaggcattggcttcatctctctggctatgaaagtcctagatggcatcttccaatagaaggtggtttcttcatttaaaatgtgtttagtgtagccaccttcatcagtgatcttagctagatcttctcgataacttgctgcagcttctccaccagcacttgctgcttcatcttgcacttttatgctgtggagatggcttttttccttccacctcacgaaccaacctctgctagcttccagcttttctgtagcttcctcacatcaatttacagaattgaagaggaggagctttctctgaattaggccttgttaggccttgggtcaagggaatgttatggctggcttgatctatctggaccactaaaactttctccatatcaacaataaggctgttttcttttcctttcttttgttttgttttgttttgttttaagagacacagtctcactctgtcacccagtggcgcgatcttggctgactgcaccctccgcctcacgggttgaagtggttctcgggtgtcggcctactgagtagctgggattacaggtgtgagccactgcacccggctaaggctgttttactttcttatcatttgcgtgttcactgaagtagcacttttaatttccttcaataacttttcctttgcattcacaacttggctgtttggcacaggaggcctcgcttttggcctatcttttttattttattttattttatttatttattttgagacagagtctcgctttgtgccccaggctggagtgcagtgatgcaatgttggctcactgaaaccttctgcctcctgagtagctgggactacaggcatgcaccaccatggccagctacttttgtttgtttgtttgtttagtagagacggggttttgccgtgttccgcaggctgttctcaaactcctgagctcaggcaatccgcccgccttttcccaaagtgctaggattacaggcatcaccactgtgcccggccctatcttggtttttgacgttttttctcactaagcgtaatcatttctagctttcgatttaaagtgagataggcgggactcttcctttcacttgaacactttgaggccattatagagtttcttttctttttttttttttttttgagacggagtcttgctctgtcgccaggctggagtgcagtggtgcgatctcggctcactgcaacctctgcctcccaggttcaagcgattcgcctgcgtcagcctctggagtagctgggactacaggcacgtgccaccatgcctggctaattttttgtatttttagttgagacagggtttcatcatcatgttggccaggatggtcttgatctccttatcttgtgatccacccacctcggcctcccaaagtgctgggattataggagtgagccacgtgcccgtcctttttttttttttttttgagacagagtttcactcttgttgcccaggatggagtgcaatggcgagatctcagctcaccacagcctttgcctcccagttcaggcgattctcctgactcaacctcctgagtagctgggattacaggcatgtaccaccacaccaggctaattttgtatttttagtagagatggggtttctccatgttggtcaggttggtcttgaactcctgacctcagatgatcctcccacttcggcccattatagaattagtaattgttctaattgcagtattcttgtatctcagggaatagcaggccacaggagagggaggagagcagaagagacaggggcccagtaagtggaatagtgggaatgcacatgtttatagagtaaatgtgtatctcatgtgggtacaggtcatggtccccccaaaacaactacagtagtaacatcgaagaccactgatcataggccaggtgcagtggttcacatctgtaatccattgttttgggaggattgcttgaggccgggagttcaagatcagcctgggcaacatagtgagaccctgcctctaaaaataaaaagagatccctgttcacagatcaccacaacagatgtaataataatgagaaagtttgaaatattgtgagaattaccaaaatgtagcacagagactcaaagtgagcacatgctgttgaataaatggcactgatgacttgctcgatgcagggttgctgcaaatcttaagtttttaaaaactttttagtaaatgctgttaattgtagcttgatttgcataaatactctaatgaaatggtttgtagacaaaagcaggaaatagttgtttttgccttagtggcactgtcctcccccttagcagttggaagcctcagagagacactagtagcatcactacaaagtttacatgtttttaagaacatgaaagtatttccttacaatgtttaattaaattttatttaattgaaatcctacccgaatcttactgatacacattttctttactataaattcacttttttcagaaacagataaatgacaaaaatcatacctttgggtggggtgcggtagctcacacctgtaattccaccactttgggaagccgaggtggacagatcgcttgagcccaggagtttgtgaccagcctgggcaacatggcaaaacttggtctctacaagagatgcaaaaattagatgaatgtggtggcgtgtgcctgtagtcccagctacctgggaagctgaggtgggaggatcacttgagtctgggaggtcgaggctgcagtgagctgagattgcaccattgcactccagcctgggcgacatagtgagactctgtctcaaaaaagaaaaaaaagtcatgtttgtgggttatctgtgcctagggtctcttttttgccctcatattcttattaaaattcctgcattttgggtttggattctgctgtgaactgtaggtgcttgttgtgtctgtgtctctcttgaccaaaacactatatgtttgtctttgttggtccaatgaaagagcttaacagttttatgtgttacatattttgtagtaaaatgtgtgttgtcttgtgagaatgtaagctccacgagggcataaactttgttttatacattattgaatcaccagtgtcttacacagtaatatttattgaatgagtaaatgaaagaacccaggtgtattgattattggagaactgttacttgcatcagccaggtgtttactgttttgtttgccctggtaaagaacgtcacttaaaaatcacataggggccaggcacggtggcgcatgcctgtaattccagcactttgggaggcagaggccagcggatcatctgagctcagactcacatagggcttgataccagggaggaacttggagttatctttttcacctttgtctactgtatttaaaattactactatcagacttgggccaggaaaaaaatattgctctgctctttcataattttggaactttttttctagaaatcaatcttgtaggaattgattgggactcatcctaagttctgaagacatggaaaattgtttgaggtgacacaaaatgatggaagtttttattactgatccagaagctctaatgtaccttttgctaatcaactggattgattggatgctttacaaaggtttaacattatgcccctaaaccatttaaaagaacaaacgtcttcttaatgttgaagtgtgagttatgcactgtgccgctcatccttgaccttgttcagagtcttttgctgctgtgctgctgttcagataaaacatttggaaagtgacagttcaaaatacattcactcaggtaatggaagtcaacatttgggtacagaatctctccctgagattttgcagtttgcctctcagtgaattccaccatagtcttgctatagtgtgagggggtaactcattcacactgttcacgcacacgttccagtaagctccaggggctttcagtggttttcagagtagtgacggaattgtagcatcactatcatctagaaacttgctagaaatgcaagtgctgaggccctacctctggcctcttgaatcaaacactgagggtggtgttcagcaagcttttttattttgttttgtttttgagacggagtcttgctctgtggcacaggctggagtgcagtggcactttcttagctcactgcaacctctacctctagggttcaagcaattctcctgcttctgcctcccaagtaactgggactacaggggtatgccaccacgcccagctaatttttgtatttttttttttttttttttcccgagatgaagtctcactctgttgcccaggctggagggcagtggcgcagtcttggctcactgcaacctctgcctctcgggttcaagcaattctcctgcctcagcctcttgagtagctatgattacaggcgcacaccaccacacccggccaatttttgtatttttggtagagacggggtttcaccatgttggccaggctggtctcaaactcctgacctcaggtgatctgcccacctctgcctcccaaagtgctgagattatgggcatgagccactgtgcctggcctattgtttcatttttttttgttttgtttttctttgagaccgggtcttgctggagtgcgtgatcacagctcactgcggcttcgacctcccagcctcaggtgatcctcctgagtagctgggactacaggcgcatgccactacgcctagctgatttttgcatattttgtagagacgggtatttaccatgttgccagggctggtcttgaattcctgggctcaagcagttctcccaccttggccttctgaagtgttggggttacaggcatgagccaccatgcctggcctcgcaaggtttttaaacttgccatcttggtgctttgatgcatgctaatgtttgtgaaccactgctttagggtgttttgaaagaaatgcaagtcataggaggcaaaaattagtcttaatttgaggtatgtgtatgttgtcttcttgaccacttagatttgctaaggagattgccctcacttcaggaatctaaatatgttttttaggattttcaaaatcttggaaagatctcaaaactgcttttgttagggattttgaatgttttatgctaatactgattaattatttttaatcttggtttggaatttgaatgaacaattttacattgaaatagcagtttgtatggctcctggacttgtggcttttggcaaatatcaggagagtgtgtgtacatgttggtgcttaaggcacaagctccctggtggttttgttttggtgctgaaaaattggctagcatataataacagggtcagggtgattgccaagtcttggggtaactaatgaagctgtattgtgtgaattgatttttattcctggtgttgaattattgcctaaattcaatacattcttttgccttttgctcttttctcctaagaaaagggtaaataaaaattagacagtccacaaggatgaagttggtgatgtcgcttaaatctgttatatcttatgcagaattagacgcataacttggcagacagaatgttgtgagctcagagatgaggattctgtattatctgttaggtatctttgagtcccccacagcttgatcataatatcattataggtggtcagtaaataatgtaaggagtgaaaaagagtctcccgtccattctctgggttttcagcatgttgataattgaggaatatagatatgtgaaagccccgtaaagagtttcaggaaagatcaaatatctgaagggaggcaattagaaagactaaaatgactttattgtatagtctttgttgtaaagggtatttaagtatatgaaagttaacaagatagagaagaagagtagggataaacaaaattaaaataatgtaatctaaaaacaatgagaaggatgtttccacatgaatttcctactgtgatctttcactcaactgtgcagctcaatgaaagcaaaaataatagaaatgagatggtgggaaaatcgacctggaacaatttcttcttgagacaatttgttggcctggcatgttgactcacgcctgtaaccccagcactttgggaggccagggtgggaggatcacttgagcccaggagtttgagactagcctggtcaacatggtgagatcttgtctctcccaaagaatataataataataattagccaggtgtggtggtacatgcctatagtcccagctattcaggaggatgaggtgggaggactgcttgtgcctgggaggtcaagtctacagtgagccatgatcacaccactacactccaacctgggtgacagagggagaccctgtctcaaaataaaaaaaaaaaaaattggtcaaggagagttaaagttataacttatagtcagttatattctgcgatgaccattaaatgtacttttaagagtgcttggcctgtagtagcttttcaggaaatgttagtaaataagtgattcttctgttacttgtcactaaatggttaggctccaatcattgaccattttctctggttacttcagcactgtttcctcttctctgctcttataacctgtctcccctctgcaccccttttgatggtttatatagtgtaccaccttgtggttttaaatactctttttctgattataatgaggttgctcttttttttttttttgagacaaagagttttgctcttgttgcccagactggagtgcactggtgcaacctcggctcaccgcaacctccgcctcctgggttcaagcgattctcctgcctcaacctcctgagtagctgggattacaggcatgcaccatcacacccggctaattttgtatttttagtagagatgaggtttctgtatgttggtcaggttggtcccgaattcctctccttaggtgatccgcccgcctcggcctcccaaagtgctgggattacaggtgtgagccaccgtgcccagccgaggttgcactttttaaaataaatttgctggccgtttgcatttactgttttgccaagtgcctgtatttttctattaggtcttctttttttttttttaaattcattaatttgtagcttctgtatatattcagaatccaagtcctttgttggtttatatatcttgccagtgtctcctgctttgtggcatgcggtttcactgagtctcagtagtttttttgtttgtttgtttttttgagatagggtcttgctttgtttcccaggctggagtgcagtggtgcagtcatagctcgctgcagcctcctactcttgggctcaagcaatcctcctccctcagcctcctgagtagctgggaatacaggtgtatcaccctgctggctaattttaaatttttttttttttttttttttttttttagagacagggtcttcctatgttgcccaggctagtctcaaactcctgagctcaaccagtcctcccgcctttgcttcccaaagtgttgggattacaagtgtgagccgctgtgcccagcctcaaaagtgttttttggataaacagaagttaagtttaatgtagtccagtttatcagtcttttcctttatagttcctccttttttttgtcttccccaccctgaggctgtgaagtaattcctctgttattttctaaatgtttaataattttgcattttatctttaactgtataattcacttggaatagattttggtgtatagtataaggaagggattaaatcaacttcattttaatatgtggacatctagttatcccaacaccatttattgaaaagagtatctttttccctacttctctgcagcgccacctttgttgtaaatcacttgtccgtatacgtgtgtgtcttttttttttttttttttttttgggatggagtcttgctctgcaacccaggctggagtgcagtggcacgatcttggctcactgcaggctccgcctcccgggttcacgccattctcctgcctcagcctcccgaatagctggggctacgggcgcccaccaccatgccctgctatttttttgtattttcagtagagatggagttttactgtgttagccaggatggtctccatctcctgaccttgtgatccgcctgccttggcctcccaaagtgctgggattacaggcatgagccaccatgcccagccatgtgggtgtcttgtagactctgtgtttttagattctttgattccacaagcactaagctgtctaagttattatagctttataataagtcttatctcattgtggaacccttcctacttgtctcttcttcaagagtaccttggctgttcttgaccttttgcagatcaatatatgttttagaattacttgtcaacttctaaaataattcttccagatgttgtttgggattacattgaaggtctacatctattcgtggagaactggattattatagatctctgaatatttttgtacaaggctttgtatgggtgtagactttcatatctcttgggaatggttggactaggactggaatggctgaatcatatggtaggtgtatgtttaacttttttttttttttttttgagacagggtctcactctgttgtccaggctggagtgcagtggtgtgatcactgctcactgcagcctcaacctcccaggctcaagtgatcctctgacctcagtcgctggagtagctggaactacaggcacccaccatcacacatggctaattaaaaaaacatttttgtagagacgaggtctagtcatgtttcgcaggctggtgtcaaactcctgtgctcaagcaatcctccagtcttggcattccaaagtgctggggtcataggagtgagccacgtcacctggcctgttgaaattcttaaagtgccaaactatcttctagatttgtaccattttgcattcccaccagcagtggatgagagttctggttgctctgcatcattagggcaacactcgttattgtcagtcttgtacattttagccattttaattcagtgtgtaatggaatttcattgtggttttaatttgcgtttcccaaatgactgatagtgttgagcatcttcttatatggttatttgccatccgcatatctctgtgtttaaatcttttatgcattttaaagttgttagctgggcaccgtggctcatgcctataatcccagcactttgggaggccgaggcaggtggatcacttaaggtcaagagttggagaccagcctggccaacatgacgaaaacccatctctactaaaaatacaaaaattagctgggcatggtggcggacgcttgtaattccagctactcaggaggctgagacaggagaattgcttgaacctgggcggcagaggttgcagtcagccgagattgtgtcactgcactccagcctgggagacagaatgagactctgtcttagaaaattttaaaaaaaggtgtttttttcctccatttttttgggttttgagagttctctatatgttctggatataaattgtttatcagatacatactatatttttctcccaggttatggctggctttttcattttcttaacagtggcttgaagagcataaattatacgttttgatgatgtcccatttatgagtttgttgctttacgggttgtgtttttgtgtatgtgtcatatttaagagttgccaaatcctaggccacaaaggtttttctgatttttttctcctagaagttttagattttacttttaggtttatgatttaattttcatttatggtataagatttggatccaaatgatttgtaggattcttttgaggcctggaatgagggtcgcttcctccagagaacacttacttttgcgtcagccagtgtgggatctccttaaaccgaattcaaggcttgagattgtttggacccctcatagctctagttctgctggatagttggttcattactggtttactctctggaggtgtgtagccttttgggttcttgcttactgtagtggggttttgggttatatgttttggaggacccagtcttttattcctgtctccccctctctgcactgtcttaaaaatgaaagttgagacttttcagaattggcaagtgcactgagggcagaggtagtttctgtgcttatctctttgacttcctggtttcacttcaatttttgcctgttatttatttcttgtcttgtcaggttgtggttgcttttaagattataaaaatattctgtccatattttcttttagtctttttcagaaggagggttggaccaaataacattgcttgaaattaagaagccaaaacacgttcttttttatttcactccagagtctagacctgaacctgatgtttgatatggtaactgctagccacatgtggccaattaaattgaaattaattacagttaagcgaagttgaaaggcccattcctcagttacactagtcccatttcaagtgctcattagccacatgtggctagtggctactacattgggcagcgctggtatagaacattttcatcattgcagaaagttctagtggatagatatggcttgactatcaaaacctcatcagggacttgcactggtacgtggatctgcatttgaaaaccactaatatgggtatccttgctgtttaaagtttgaattttttggaatctatatagctagacagatgattgagttcctttaatagacttactgtgaaatctatccctaaggtacagtgtagattcttagactgatttaggtggtgaaatgtgaatctgtggcacactgagtagataactattaagtattgatattttaacttacaaatatgtcagttttaactgagaaattttgtgaaagcatttattatatgttgatctgtgtcttagacccagtgtctcccattgcacttgccctgccatccctgcccttaggcagtcatagtgctgtgcaaagttgcagggcactgtggggttctggcgggggtgtcacagcacccactcttgagggaacaatgggaattagccaggtggggagaggaattagccaagtggagaggggaaggatgggggaaaaggttctagggagaagaaaaacatgggcaaaagcctggatgttgatgagaaccgtgtggagattggtttgaagcatcttaaatttgatttctagtatcaagagaggtagctgaaaccatagatttttaaaaatgtcatgaggccaggcacagtgactcaatgcctgtaattcgagcactttgggaggcctgggcgggaggatcacttgagtctaggagtttgagaccagcctggggatcatagtgagaccttgtccctacaaaaatttaacaaaattagttgggcatggtggtgcatacctgtagtcccaggtactcaggaggctgaggtgggagtattgcttgagcccggaaggttgaggctgcagtgagttatgatcatgccactgcactctagcctgagtgacagactgaaacccgcatctcacaaaaataaaaaaataaaaaaagaagatgaaaagctatgtcaggatattctgtccattcgcacagtatttcctattaactggtaatataatgttattacagttgtgttgggatctctcattctagctcacagagtaccaatcttttgattatgtgtccacagttgttagggtcagaggacatgcctgaagtagtcccagctgtccctttctgccaatttaaccgtgcactagattcatgcttggtagttcctgggcacatttcaaggaactcgggggatgttgagtggagtcattcccttattgtctattactctaggaggaggaagggttcagataagtcagtaagttgagctgtggtttaggctctgtacaagaggggcggtaaagatgaaggagtgggactgaggatgggtgtggaggaaaggttagggccacttttcatcgccacctggggtagcttgccagcacatgtttacctttggtttgggatcacagcaagcagaagagatgaaagctccctttaaccgttctaggatatgtatttgaattggagaaactacctcaaaatagagtgtgtgcaggcactatatgaaggcttctcagcgtttaagtgcatacatgccacccagggatctcgttatattttaagttccaattcagtctgtctgggaagggctcagacttgcatttttcctaagttcccaggtgatgccagggctggtggtctgtggaccatacttggagtagctaggcattggttttcaaagtgtgggttgcaaggtggcactgagtcttagtttgaaagttgaataaccactgttgattgcggtagttaagggcatggcgttggggtcagaatcctggctctatgatcttgggcttgtttgttaagttttctaatctctatttccttgtgtggcatgtgattgtactacatgatcatgtaatgcttagtctttttttttgttttttttttgagacagagtcttgctgtgtcgcccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaaggtaacagttattaaaagtaaatgtttacattaaaagtttgccagttttcaaagtgctgagtcttccctgcatctttgctcagtttgtaaaattgcacctccctccctccctcccttcttctctccctccctccttccctccttcctcctttccttccttccttcttccttccttccttccttcacttccctctctctaggacagtgatgaaccagccttcttgtactggaggaatacaccatccgtcttcataaagactggcaggcacatggacaagtttaccagttataatgcttttcttacacattaaagaagtaggtgtttgtattggggcttcaacaaggacttggaaaactttaagataatacaactacatagtattcctttaggtgaatatcgtttcagtttctcagatcattgatgaaagccttaacaaagattttttttttttttttttttttgagatggagtcttactctgttgcccaggctgaagtgcatgatcttggctcactgcaaccttcacctcctgggttcaagcaattctcctgcctcagccttccgagtagctgggattacaggcacctgtcaccatgtgtggctaatttttgcatttttagtagagacagggttttgctctgttggccaggctggtctcaaactcctgacctcagaagatccgcctgccttggcctcccaaagtgctgggattgcaggtgtgagcccccacacccggcctagattttaaaataagcatctgtttgtttctttttttagttgccactagtaaggatgatggaaaactatattttgtactaaggattttgaaagatagaattctttcaagtgagaattctgtgacttttctgttaaatgcgtatttaataactaaaaatacaaagcttcaatgtgaaaaccttgtagaagttttcaaacatatacagaaacaatgttgtaatgaattccctgtttattcattaccactttcagccatggttattatttaataagtattgttaactctttaaaggtactggttcatacttaaaagttgtgaagtaacttgcttctgaaaacgtacgctaacattggacaactcctgctaaaatgtgacataattcatgatgcatttctttaaaaaagatagggaaggaattgaatatggctctgctgcttttctaaggttcttctgtgagtgggtgatgcagctgactgtcctgtgtctttctttctttctttttttttggagattgagtcttgctcagttgcccaggctggagtacagtggtgctatctcggctcactgcaacctccgcctcccgggttcaagcgattctcctgcctcagtctcctgagtagctgggattacaggcacccgccaccatgtctggctaatttctgtatttttagtagagatggggtttcaccatgttggtcaggctggtctcgaactcctgaccttgtgatctgcccgcctcagcctcccaaagtgttgggattacaggcgggagcctccgcacccagcccccgtatctatcttaatgatgcagtgtgtatctatcttaatgatccaatgtgtatcttaatgatccagtgagctaagcaaggcggtggggactctccacagacttggagcctttagttggaaggttcttttcttaaaactgtacttgaatcaaaataaactgtagcttgctatgctttgctgtattggtttaatgttcctgatagcagtacatgtctgtttttaactgagtcattgttttttttttttttttttattgagttggtgaagcgtggagctttaatagagcaatatttatgaaagaaatatgctaatctttttcaaaaaatgattaaactgaagaaatacaaaagaatatgtgtaaaatataaggtagagataatctctaccttcttcaagaatgctctgagctctgagaacctggaggaaggacacccaagtcagccttggttaagtccctagttatgccctaggtcaggggctagcagactttcttcgtgaagggctagacagtaaacattctaggctttgcaggccacctgtgacctctcacaagtactcagctctgctgtacagtgctacagcatccatgggctgtatgtaaaggaatgagctggctgtgtctagtaaaactttagacactgaaatctgaattttctataattttcacatgccgtgaaacattgttttagtttctttaaccatatacgatgtaaaaccatttttagctcacaggttgtacaaaaacaagtggggccacattggcctgtgggtcatagtttgctgttctcgtgtagagggtgataacaaagcaaactcctaggtacctcctgcccagcttcaacagtgggattttcccatgcccttgaaaggccagtgtgtgttccctgatcacatacccttccctcctgccccacaggttctgtcccatcccactcccacccctcacaccggtgccactctgtaagtgaagccttatgtcacctctcctgaagacatccttccttggccccgctcagtgtttcatttcttttcaagcccttttcaccatctgttactgtttgtattttacttactttttagtttctttctctcttggtggtgacataaagtctgagggcaaaatgtttctctgttccctgttgaatccctgacatttaaaacagtggtcattgaatgatattgtttttttccatttctttttcttttctttttttttttttccagagcaggagtggaagtttattaaaaagctttagaggctgggtgcggtggctcatgcctgtaatcccagcactttgggaggccgaggtgggcggatcacgaggtgaagagttcgagaccagcctggctaacataatgaaaccccagctgtactaaagatacaaaaaaaaaaaaaaaattagctggccatggtggcgggcacctgtaatcctggctactcaggaggcnnnnnnnnnnnnnnnnnnnnnnnnnnnnnnnnnnnnnnnnnnnnngagtcccaggcaggcgacttgaaggacaagtacctgtttttgccatttcttcgtgttttgtctgttttgaactttattttattttttatatttttgagatgaagtctcgctctgtcgcccaggctgaagtgcagtggcgtgacctcagctcactgcaacctccgcctcccgggttcacaccattctcttgcctcagcctcctgagtagctgggactacaggcgcccaccaccatgcccggctaattttttctatttttagtagagacggggtttcaccatgttagccaggatggtctcgatctcccgacctcgtgatccaatccgcctgcttcggcctcccaaagtgctgggattacaggcgtgagccaccgtgcccggccgaactttatactacgggtatcatgctatatgtctttatatgacttgattttcttttttcctcccatcctgcactctgattttaaaacttaggtgctgtatgatagttttcattcattttcactgttgtgtaatctagcctacaattgatgggcagttggtttgcttgcagtctcttgctgtactgcaaacactgccacacaaatgtgaacactcttattgctcatagacatggatgtgcatagcctatgtatctaggagtgtgattgctgagttatagggctggccagtcttcaacctgactagttactgccaaattgcttcccaaagtagttataccaatttatatcaccactaatataatgactccttgtattagtttgttttcacgctactgataaagacatatccgagactgggtaatttagaaaggaaagagatttaattgacttacattccacatggctggggaggccccacaatcatggtaggaggcaaggaggagcaaagtcacattgtacatggatggcagcagtcaagagagcttgtataagggaactcccccttataaaaccatcagatctcatgaaacttagtatcacgagaacatcacgggaaagagcccgccttatgattcagttacctcccaccggtccctgccacaacacataggaattgtgggagctacaattcaagatgagatttgggtggggacacagccaaaccgtatcactcctgttgttccacatccttgtctgtagtttattttgtctgactttttcagttttgtcattttggaggttgtgtcatatcttattgtggctttaatttgaacttcccttattagtaatgatgttgagccacttttaatatatttgctatctgttttgtcttctgtgaaggacctattaagtttctggcctttttttttttttaattgacttgtagctgttctttctatgtgtggattgcaatcctttatcattatgtgttgtgaatattttcttccagtttgtggtttgttttttttacctgtgaggtgtcttggagctaaagttctttttttttttcttttttttaatactttaaggtttagggtacatgtgcacaacgtgcaggtttgttacatatgtatacatgtgccatgttggtgtgctgcacccattaacttgtcatttaacattaagtatatctcctaatgctatccctcccccctccccccaccccacaacaggccccggtgtgtgatgttccccttcctgtgtccatgtgttctcattgttcaattcccacatatgagtgagaacatggggtgtttggtttttttgtccttgcgatagtttgctgagaatgatggtttccagcttcatccatgtccctacaaaggacatgaactcatccttttttatggctgcatagtattccatggtgtatatgtgccacattatcttaatccagtctatcactgatggacatttgggttggttccaagtctctgctgttgtgaatagtgctgcaataaacatatgtgtgcatgtgtctttatagcagcatgatttatagtcctttgggtatatacccagtaatgggatggctgggtcaaatggtatttctggttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctcttggctgcataaatgtcttcttttgagaagtgtctgttcatatcctttgcccacttgttgatggggtcatttgatttttttcttgtaaatttgtttgagttcattgtagattctggatattagccctttgtcagatgagtagattgcaaaaattttctcccattctgtaggttgcctgttcactctgatgatagtttcttttgctgtgcagaagctctttaatttaattagatcccatttgtctgttttggcttttgttgccattgcttttggtgttttagacatgaagtccttgcccatgcctatgtcctgaatggtattgcctaggttttcttctagggtttttatggttttaggtctaacatttaagtctttaatccatgttgagttaatttttgtataaggtgtaaggaagggatccagattcagctttctacatatggctagccagttttcccagcaccatttattaaatagggaatcctttccccatttcttgtttttgtcagatttgtcaaagatcagatagttgtagatatgcatgcggcattatttctgagggctctgttctgttccattggtctatatctctgttttggtaccagtaccatgctgttttggttactgtagggaactaaagttcttaattttaatgtcataagctttatttcttttttcctttatgatgagtactttttattgttttgatttttttaaggaatctctctttatccaagggctaagttttgatgtgaagtatttttatttagttcataaagcatttattattattattttgaggcaaagtctcattctgtcacttaggctggagtccagttggacgatcacagctcactgcagtattttttttttttttggacagtcttgctctgtcgcccaggctggaggggagtggtgctgtctcgtctcactgcaacctccgcctcctgggtgcaagcagttctcctgcctcagcctcctgagtagctgggactacaggtgtgcaccaccatgcccagctattttttgtatttttagtagagatggggtttcaccgtgttggccaggatggtctcgatctcctgacctcgtgatctgcccactttggcctcccaaagtgctgggattacagacgtgagctaccgcgcccatgctgcacactgcagtcttgacctcccaggttcaagcgatcctcctgcttcagccttctgagtttctgggactagcaggtgtacacattaccacacctggctaatttttaaattttctttagagatagggtcccactatgttgccaaacttggtctctagctcctgggcttaagcagtcttcccgccttggcctcccaaagtgctggatttacaggcaggagccaccacacctggcccataaagcatttattgttctatttaataaagaagtttaatatttagacatattttgtaaattctactgattcctttgatgattcatgatttattttaaagtgtttgataaattacaaacaaatgagctttttttcattgtatcttgtgacatttctagaattggattgtagtcagaaaatgtgttctgtatgttaccaattctttgaaattaatgttgtcttaaatagacctatattgtagtagaatttggctaaaatcttggtctcaactcagaaacttttaggtacctagccacttaaactccagctatgcctaagttataccttagttatgaaaaaaagattagactaacattattaggctttttaaaaagttaatagagtttctattttctgcctctggaaacacttgtgttgttttctggctgaagttgaggtgttaatgtacattatcagcttttggattctgttctacccaaactgaagcttaaagacaagtgactgcctcaactgccagtttgttttagcttagctgacaggcaaggagttcatgctgtgactgcagctgctttcctttcagtggcatttgttaattaagctgtttaattttgtgttgctttcccaaggactgattcttaaggaaaagagaaaatttttagcttgtggttattctgggaccttttagcctagtgtttattttgggtgtccatttcatttttttctccccagaaagtagcattaacttgaaaattatcagttaaatagtggctcagaaattaaattttatctgtctcctgaatctcaggcattagtaattgaagtgtctaggtattgtgatttttgtagagaggtattgtgtaagtgtctagatattgtagttgtgtagtctgtttaagagaaaatgcattttatctaagaaacaagacccaacttcaaatattggctctgcctttagtcatgtgacttttggcaagttagtttctgtgcttctcaagtccttatttataaagtgtagtttttatggtcttagcctttgaggttatatgtgcagttactgtgtagagtggtatacaaatgtaaggtgctaatgttgttaatagtatctttaacagacgtaagtagtgttttactactaaaggcacaggtcctttccatttaatgtgatttcaccagttcttgagctggttcattcagttaattcatttgttcgccatttaaaaaatactgttttgtgcctggtacggtattaagccctgaaggtatagacttgagggggagtgagactgttatagttccctggcatgcagcatgatgtgtgcagttgtctcttagcgtgctcaggcaatctggagggcaagtcccttgtgatgcccaacctcaggggtcggcagacttcccctcttaaaggccggagagtagaaacttcagccttcgggggtcgcatatacacatacagcctatcgcatttcctctaattttttcttcctttcttccccctcccccctctcctcaacgctttaataatgtaaaaatcattcttagtccaggaaccatgtaaaaactggctgtggactagatgtggtgacctctttgtaaagtatttttcagcggaagatgggaagtggattccactcatgtgcaaaggcatggaggtgtgagaggctggggttttgtggaactgaatatttttatcacatgtggagaaataggttgggtcgggtagagaaggatatgcagtcgatactgggcaggatcaaagcagtttgcacttgattctgatataaattttttacatcctagggcagcaagaacagatttagatggtaggaggatgactggactagaggcacaagatcagtaaggaaggtagtaatccacattagaaggggaaaagtcacccaacctttgtcattaaggaaatggctcacctgctgttatttagtaaagtgagagggataaagttcagaggtcgaatttagtaacatacagtctatttaataatagactatatgttcttttaattatgttgtacatataaatgaaggacttaagggcacaactgaggaaatggagagtagggattgatgtgaagcctgtttctgagttcatctacaggcgtgactaagtaagtgaaatggcaaggctgagagagaaggaatccagcgtaattccaggatggcttccagattttttctttggtgatgagttcatgaagatctttttgctcttaattttttttttcctggaatatcttagtgattgctttgatgagggaacattgtctcttaggtccatgaacccctgaaattctaagcagaattgtgtatgtatgtgagctgtttttccctggggagagaattctagagctttcatcacattatcagaaaggagtccaaccaaaaggaggaatcactttttgttagattgtacacatctggtgtactctaaaggtttgtgttggcaagggaaacatcatcccaatcacaggatttttactttaaatgtaatgcatctcaaactgccaagtaaaatgcaaacacatgcaactgttttctaagttgaactgtatcaaccagcaattggaatgtttttccctagtttctcctcctttccgaaagacagaataagacacatttttggtacataaaaagcgagctggagactgacgggcatggaatgcttcaacatgctatgaacattagagaaagctaaagtttgtagagtattaacgtatcttagtattcatgtggctatgagagatggtgtcacttttaggtaggatacaccagtaccataaatgagtgtagtttcctcagttggattagaaatgtgtaaatagtgagttgtaagacaatccctaaatcgtgctgtcatgatgagcccttagttgagcaaagcaggagaagcagggtggccgccgagcagttgttgagatatgagcatcaggcagattcgtattgtgttctggagtctgcactggattggttcatacttgatgtcagcattattacatgtaatttagggattacagactacagataatagcagtccctgcagagatttgatgaacttggtaagctgctccatatggagcagagagaacttaagagagtgaaaatggggcaatctgtaagaaagtttcttctttcctgttgagaaaaattgtgacttctattaaaggcaaagtgtgatggggcaaagatataagaaatgatggaatctagcagtggcatagaagtcaaaagtgaaaacctagactggttaagatatcactctcagaatttcacgctggggctaattgtaattccaaggtaggaaaaaagctttgaatctactttgcctaggtcatggcaaagtttaggtggcaagttttgttttctgtttggaaaaaatagtattggatcctaaggaattgccttgagaaatcagatagcagaaataacttagtttaagtgcatgttgtcaacatgtgggttaattttaaacagtacatggttgattatgtggttggcaaagagctgatgtctttgatttacatctatcctatgagtttgcctttttgaccattttattggaaagcaaacttttctgctgctttttttttttacgtgtgtgtgtatgtgtgccccttttactctttgctttacgtaatctagaattttaggggtatatctaaatttaggatccaaagcttttactttagagatgagtaagtaaataacccagaaaagtcaaatgaccatttgatggagaatcataggtgagcttactctccagccccatccaaaggtcaagcctggtgtttgctgtgggtcagggtccccaggtaaacaaagacagctttatcggacgagcttccaagagcttaaagattacctcccaggatctgggcaaagggccaaacttttctttgagcaaggcggttaatcctttactgcataagccctagcaaagcaaattattatttctgtcattactagggagttcaagaaattattattgctcctagatataagatatgttgtaaccacatacagtaacatttaccacgaaactgaaaaattagaatttctacacacaggtgaggatgtctccagaagtgtgtcatacttgacatctgttctaacatttctatcagggatttgaataaagaacaggagtcacactgggagacagttcatttttagaattttagatttttaaaatattttgacaggtggtaatgaagtggtaaaatccatagggtgaaatttgtcagcaataaatgtaaaatggcagacttagtttaaaaggaaaagcaactgagaaagctaaagctggacaaaacgtgtcttaactctaccagtgtgcggaagacctgggaatctagttgactaaaacaaggatcggtgaacttttttgtaaaggggcagatagtgaatattttaggttttgcagatgaataggcaaaacaagaatattatgtaggtatttaaataatgagagaaaacaaatttccacaaattttcatcgactgaattcaaaatataaaaacagtaattgaggctgggcacggtggctcgtgcctgtaatcccagcactttgggaggcggagggaggcagatcacttgaggtcaggagttaaagaccagcctggccaacatggtgaaaccccgtttctgctaaaaatacagaaacttgccaggcgtggtggcgtgcgcctgtagttgcagctactcgggaggctgaggcaggtgaatcacttgaacctgggaggtggaggttgcagtgagccgagatcatgccactgtactccagcctgggtgacagaatgagactccatctaaaaaaaattaacaattatttattaattaaaataataaaaacaattgagcataattaaaaaaatacaggtctaatgagaggaatggattttttttttaggggaggaggtggataacatttggctaaattagagtttgaacttagtgtttgctattatcaacatcaattacaagtgttcatctcttaatgctaatctgcaaggagattttacatattttatctttgaaaaatgtcttaatcctgacaggatacatcgaaatactgatagcagttcaggagcatattcattgcttagaaggcatttatagaattctattagattctccttgataattgccttctagcatgttattgcattgcagattaatcacttcctattggtggttagatggaagcacctcaattgcacagttaaatggattttgaaatatgtaaattttctttgtacttgcattggagtttgaaaaatgctactggaatgtagtttgaacccagaaaatatatccactgcaaatttgcacagaattgaaatcttgctttttgttttaactttcacatacgagaagtatataaagaagcttaatgcaacttgtgattcaaatgttagctgtcattgaaatgactttactgcagtataaattcctcatataagtactgttttcctttgtaaacttaaattgaatccattaagaaacatcaagtctgtagaaaaaattgattgcagagctattcagtgtttggtaacagtgttaactgaaggaggctcttttagaaaaatttgagtcttgactctaaggtcataaagttagaataaaacctaccactgtccatttaactgctgtgtggtaggccaagtcaagatactcagtttctatttctgacaaattcaaggaactgacaatggttaagtctacaagagctaatgaagttcactgtggatgctactggtccaataacacctgacagatttaaatactttctacatagtacttgctgatgaataaccataatactttcataatttttgtaaatttgtgcagcaaatcatttgtctgctccccatatatttttactatcaccagttattatcatgcatcttagtagattccacttcagattgtactaaattagtgttttctcagctttgaaaatattatttgtagttccacacagactattcttagagcctaattttttagttacttcaaggttggcattgactccttgaataaacagttgagcaacgtcaacaaccaaggaaaatcattcaaaaatatttgcctttttttgactgacattgatgttgttatcagtatcctcaactctttgagcaactgttcttattgaaaagcttatagtcttaagcaagttttttgttttttggttttttttttttgacatatttctttgtctgttgtagtcagacaacttaacatggttaagttatccacataagatggagagccatttagggttttgagcagagaagtgatgacatctgattgagatttgacttcatctgcaatcagattgagatttgacttcatctgcaatgttgaggataggcaccagagcagcaaggttagaagcaggggacctgtcaggtggctgttgagttcatttgagtgaatggtgatgatggcacaagtcgtggtgatggtggaggatgtggagcaaagtggacagtttcttggcagatttgccaggaagagctgacattatttgctgacaaggttgaacatggagtgtgaggaataaaagagacaaggatgacatccattgttttttggcctggacaactggaaggagagagttgccaagaactgacatagagaagagtgtgtaaagaaggtttggaggagaaagatcaatatctgagctttgaaatgtctcttggacatttttattcgcttaactgatgtttcacttctctgaggatctagaagctggtccccagcatagtgtatccatgaggaattgttcaggaaaagagaagctgctctagacacttttttaaatacacaggattatagtccttcactactgttggaagggttggagaattgaaggtccaggaagcagctgttcacagtgtgtacttcccaggagctcatctgagatgggcagaggtctcagaattgaagcctctgctgctgtggttgaagtggatggttcttggagtttctccgaagctgctgggaattcctagtaggagctgctctatctaggtcttagtttcagaagtaggtcagttatttttttctcccagcacatcagcctacagctgcctccagagggtagtgtgctcttttatcttaccagtcttgcacgagttgcccttattagttgactctaaccctgagttgtagcaggaaggggtttgtaggaaatgtagttctggcttccctatgtcacacaggtgaatatagaaggtggtaatgatgcagaattgacaacagtctagcacaacaaccaggcaactggattttcaagttgggattttggaagaaatctgagctacagttagcataaaggtagcttttaaagtgagcttgcctaggaggtgagcataaataagagaaaggacagagtcttggggaactctagaattgacaagtttgcaagaagaggaagaacagctgtagagactggaaagaaaccacctgtgaggtaagaagaaaaccaggagaagatggtgtcctggaaagcaagagaagggaagcaggaataattacctgtcagttgcagctgacagaggaagtaatatctaagtattgaccattggatttagcagtattgaggtcattggtaatcttggatagagaagttctggtggagaggtgagataaagggaagataattagtgatagcaagtatattgtgtgtgtgcttgtttataggattatttgtataatagctgttttaaagtctttgtgagataattctgacctttgtgtcatctcagtattggcttgtcttgattttctttttctatgggaattgaggttttcctggttcctcctgtgcagagtaagtttggattgtatccccgactttttggatgttatgttaggaggagactctgggtcttgtttaaatatgctgatttggtggtggtttgaattctattcctccctcatccacctgctactgtttacttttcagagtcctcaaatagcttctgcagttactctgttcaggctttctagttgctttcaagaggagtgacagggtgcaatgtgcttatttttccttatctaaacctgaagctgttcacttcgcaaactgcttctgttactcaggtaatggtcaccagtttcagctgggccatgatgctcaaatgattttgcgtccctgatcagttacctcttccagcccccataggagttgctgctcgaattatttcttgaatttggcttatagatagatcctttttttggtgtctgttcccatagtttcttttggtgtttttctcaggtagacaacatggcccttaccatatatcatgatagccattagttttctcaagtatgatagaaaagttgtcttgtgttgaatgtattgactatgcctattgattagtttaagtagaataatgtctctttgacattttaagcctttcacacaatataattttgtggggatattttttacaatgcagaatagaacagcggtgaagagcacaagctgtagacagatttttgctttgcattcatatctgatccttgctccctgtatgatgttgaccaagctccttaaactctctaatctgttttttctcttctgtttagtagagattattgtgaattgtaactcttttgtaaatgtgatatatagttcttagtgcttggctagtcatataaataattaaaaacgattttttttttgggcaggatcaactcgatgttcgtaagtacagttcctaacagtgtagttatttctactgtgggaatttaagggctaatcttcatcattccctgatttatattgatctaaaaactggaaaacagtttatattcgtcatttgctatgcatacaaaatgggcaagttattactgttaatattggtttttaaaattcaataattttacagcctcttttagggtattggtttagtcagtagcttagtaccagttagatggcaaaccgtgtactaagcatcagtgcagagatagtgaatgagacacagtattcccacctttgagcagtgccagtctagtattagaatatttttggctaaaaaattattttgaagcataaagaagcttttgtttgctctggtgattttcataacatattcacattcttaatgtatttttggtttttcagaaagttacttctggcctgtgttctttcagaatataggttgcagcttgtgttaagtgcaggaactattgatagactgagtttagaagaagggaaaattggtataaagtggttgtgtattttaaacattggggagcttcatagatgagttaaattgttaggatatggattaagaaatgttgggttaggccaggcgcggtggctcacgtctgtaatcccagcactttgggaggccgaggcgggcagatcacgaggtcaggagttggagaccagcctggccaacatggtgaaaccctgtctctactaaaaatacaaaattagctgggcgtggtggcaggcctctgtaatcctagccactcgggaggctgaggcaggagaattgcttgaacctgggaggtggaggttgcagtgagccgagattgcaccgctgcactccagcctgcatgacagagagagactccgtctcaaaaaaaaaaaaaaaagaaagaaagaaagaaagaaatactgggtttgagccttatttagcacttagcatcaaacagacattttcttttccaggggctcatcctacttgtttaattccagccagataacttataatttgtcaatatgtcatattgaacattactcagctgtggtaagaactttctgtcatgcttgctttggaaagcccagatcatgtttattgttttaacaatattacgtggttaatttgggaagcaagaatagcagcatgattttgagtgctgataaaccagtatttgaattcctggtctctcccttctttgctgtgtgaccctggaaaacttagtaacttctttaagtctgtttccttgtatgtaaagtggaaacaattatagtaaccagttagggctgtgaggagtaatgagctaatatagacactccacacacatgaagctgctattgttatgatcaggattgttatttggaggtagtgagaaaagaatgatagaaggctggccaagttggattgtgcattgaaatgagaacattgaaagcaaggtggtgaaaggaaatattctacgtgataatgaagcacagatttagtgtggtatggaaaattttagtttgtaggttaaaagggaaaagggttcagagcagcccaagcatctatttatacctatcttaaaatacactcattcatgcacaaagggtagggaatatccatcttaaaatatcttcagagttgagaatgtggagataaacatgtatatcattgtataataagccaactttaatttttctttatccatctggagaaaaagaatttaagacttttaattttataatttgagaaatagctactttatactctgagctagttcagatttttatacttatattttatcagtttcatagttacaaatagatttctgttcttagtaaagatggattaaatcatggaataagaagagttaggattcaacatgcattaagttgcctgttgctaaaacaggattcaacatgcattaagttgcctgttgctaaaacagtaagtgggcagtaagcctagtcttgatagaatggaggcttgtaacttgcttaaattctcctttaactacatagaataaaacataaagcaaaaagcggttatcagaatgtggctgaggtactcaatgccagtgtatccattcatttattcattaagtcattcatgcatcatataaatgtttatcgataatcatgcgctctagatgctgttttagataatggtgcatactgttgggtatacaatggtgaacaaaaagtagatgtggggagtaactgggatggtttgtcttcacatttaatgaagagaagaaagccagttccaagagtgtcagaataattcaacaagtgatgtttttaggtttacactcctaatagaaaggaggcaggaaaggcagagtgcatggaaagaagaaatgcttccaactgcaaccaactggagcttttttgacctttactttggttttaattaatagtgcttaagttgtttacctggtgtttaggtcctgaggctgcagagctgaaagaggttgtcactgtccctagaatctttctctttttgagatggagtcttgctctgtcacccaggctggagtgcagtggcgcgttcttggctcactgcaaccccttcctcctggattcgagtgattctcctgtctcagcctcccaagtagctgggattccaggtgtgtgccaccatgcctggctaatttttgtatttttagtagagacggggttttgccatgttggccaggctggtctcgaactcctgatctcaggtgatccacctgccctagcctcccaaagtgctggaattacaggcgtgagccaccacgcctggcctagaatattgttgtttacttggaggaggaagagactgacagaaaaggcaaaattttaatggcctctctagtaagcttcaccacaagattcctttggggtagggtcatgtctctggtaccgtgcatgtccaataccttgtgcagtgcatggcttgtgtctgtcactgaataacctatattgagtgaagaaatgctgtggagtgcaggagaggggcatctaacctggggtgagacagagcagcccctaccacatgtacatcaagttaagcaatgggaagaagatctaggtagaaggagcagcagatggcatagagatgtgagagaaagtacaagttgctctgtaaactgacaatagtttagttttgccagagtgtaggattcataagagacagtgctgagagactttagactagagagttagacttggcttgacaagtaagggtcataataaagagtttggattttgttttctttaaaagtaatagtgtttttttctaaacaatagaaatcaggtttcctaatgcccaggccgacactcttcatattacatgatgcatgcaatgtcaaaaaaggattattaggtcttagtttccatatccgttcatgatagcaggaccatcaaaattctgtaaagccattggtgaatgttctgtcttttggagagaaagaggatataggataaataccttttttcttgggagcaaagaatatgtagttgaaactcattaagggcaagcaaggtctgagtgtctttgaatttttgttcctggaatgatgccaggaatgtatagcagatctctgtacatgaataaatgaaaaaacctttctttgcatttgcatatactgttgctagcattatacttggttctgaaaagtaatagttaaatgagaaatggtctcagtggcacatgcctgtgatcctagcactttgggaggcggagagaggccaagacgggtggatctcttgagtccaggagtttgagaccagcctgggtaatatagtgagactcccctctctaccaaaaaaaaaaaaaaaaaaaaaaaaaaattacctggggctgggggtggtgcccacctgtggtcccaactacttgggagaccgatgtaggagaatcgcatgagcctgggaggttgagactgcagtgagcttgatcgcattgccacaatccagcctggatgacagagtgagaccctatctccagaaaaaaaaaaagaaattagctggcgcgtgatggtgtggctgagggaggctcaggtgggaggattgcttgagctcaggtgtctgagactacagtgagctaggctctcctcactgcactccagcctggaagatagagcaagaccctgtctcttaaaaaacaggcaaattattgattatagttcagtgggctaaatcctgtggtagaaacattcatgcatagggtggtgcatccacatcagtcttaggtgggaggagggtcatggaaggcagatttttggttgcacttgaactgaactttgaaggatgattaggagtaagctgggtgggggaagggaagaacctaccaggcagaaggactggcataagtaaaggcttgtttgtaagaagtagcatggcacattaagggaagttgaggttgttcagtatgaccctaccgtagaaaaggaatgagcaagtgatggaaaatgagataggaagctagtggtttggttctgttctttctctccttctccctcttaaccccctaacccccctcaagttctcctcttccctgttccccctggaatattctatttggaatgggatgatgagaaatattttgaggaggaagaggtaaaggcttagaaggtatgctttgatgccccagataaatgtcagcagaatagggaacacagttggaaaattgcttttcaaagcaaagaatttctaatatccctcaaagtaatgagagctgttgaagacttttgagcggttgacataatttgttttaggaaaggtcactcaggtaggtactggtgaagaagttgaattgaagggggcactgtaataaagaaagtagatcagttaggaggttttgttttgtttttgtttttgcaacactgtaacttgaattaaatggatggccatagaattggagagcagggatcttaggggtgagagataagtgaggtgaaagagttagattgggcaactggtcatggttaagggcaggatttttggggtcagacacctgaatttgattcttagcttggctttttattattatgtgactttggaaaattagataaccttctaaatctgaacttccggaaatgtgtaacaggaataattccttgagaggttattttgaggactgagtactcctaagactcttagcacagagtatagctcgtggaaagaattagttaagaggagatgctattataagctgttcattgttatagggtatatatttataggaggaagaacatatataggctgtattagagggagaggcaaggccttaaggttcgtgcgtgttggtatcagtggtctgttacagggctgaggaaactatagcacatgggccaaatctgcttttgtaaatatgtatttattgggatgcattcaaattgtttatatattgtctatggctgcttttgcactgcaaagggaatgtacttaacacaaagaatagggtccccaggagagcacttaaagggcaagcagaggaagcctaggtaggttgggttggggggggggacctacaagggccaggaagtttgtaggattgccatgagtgaggagtgtcactaatgctgggaaaggagggtggacattctgtggtttttttttttgagggagtctcgctctgtcacccaggctggggtgcagtggcgtgatctcagctcactgcaagctccgcctccccgattcacgccattctctgcctcagcctcccgagtagctgggattagccaccacgcccggctaattttttgtatttttagtaggtttcactgtgttagccaggatggtctcgatctcctcacctcatgatctacacgcctcggcctcccacagtgctgggattacaggtgtgatgactgtagagtatgctcgagctgtgtgtcctatacaggaggcccctcaggcccctcacagagtatgtgtgtttgtagtaggcatagtagactgatagagcttttggcattgctggatgcttgtacacagttttctttagctctttactatgggactgctgtcttcattgccacacaaaacagcaagaatttgttgaaatgagtaaaaataaccacataatttttttccctccctccctcccttcctccctcccttcctccctcccttcttcccttcctcccttcctttcttccttcctttttttttttttttaaattttgagacagagtcttgctctgttgcccaggcagtggtgtgatctcagctcactacaacctccacctcccggcttcaagcgattcccctgtctcagcctcctgagtagctcctggctaatttttatattttttttagtagagacggggttttgccatgttggccaggctggtcttgaactcctggcctcatgtgatccacctgtctctgcctgggattacaggcatgagccaccacaccaggcccagatatttttgagtttaaagatactaactcaataaattgcaaaagaggaggcagttttcctaaaacaccaccactccagttgggttgtatggttgaagggataaacctctaaatgaaatctttaaaagaattaaacctataaaagaaacctttgctttcttttatctaaaatttccttaccaggcttaaatcattgccttttaaaaaatgtgtactataagtactttttgttaggtgagctctctagtattaacttggtgagactgatttgtagtaccaaatctttttttttttttcttttttctttttgagatggagtctcgctgtgttgctcaggctggagaccagtggcgcgaccttggctcactgcaacctccacctcccaggttcacgccattctcctgcctcagcctcccaagtagctgggactacaggtgcccgccaccacgcccggctaatttttttgtatttttagtagagacagggtttcactgtgttagccaggacggtctcgatctcctgaccttgtgatccactctccttggcctccaaaagtgctgggattacaggtgtgagccaccacgctcggcctgtagtaccaaatcttaaaggaaactttgcatttggaatttgaagtttatctggagatttggtatggttgctgagttatttttaggattagatacatttcttggaaatagcaaatgtaataacaaattgtgtggctatatagttggctgtttgataccatccataagcttagcaaagtgtggtgtagttatttgcctgtcttcgagggaaataaatgtaaaaggcatgtataacttgctcacagtgcccaaacttgctctagtgatagaactaggactggaattcaggtttcttgaatttgatttcagatgtcttttctatatatctgctgcttttctgactttaaagtacatttccaaggaaaagtgctctttatctataaagtacttttttatttttgagacagagtttcgctcttgttgcctaggctggattgcagtggtgtgatcttggctcactgcaacctccgcctcccaggttcaagtgattctcctgcctcagcctcccgagtggctgggattacaggcatgcgccaccacgcctggctaattttgtgtttttagtagtgacagagttttaccatgttggtcgggttggtcttaactcctgacctcaggtgatctgcccgccttggcctccgaaagtgctgggattacaagagtgagccaccgcgcccagcctatatgatacgttaaatacaagatttgtgaagtgttgattctgtatgtggcaatgaacaattttggtagttcacctgataagtcattcagtatgagatcatgctttctttacagcctggtgtaaaaccattgatggattcatcctagtttatcttgccttgattacttattctttttttaagggttaaaatgggccagccgcggtggctcatacctgtaatcccaacactgggaggccgaggtgggcgtatcatttgaggtcaggaatttgagaccagcctggccaacatggtgaaaccccgtctctactaaaaatacaaaaattagctggatgtggtggtgcatgcctgtaatcatgtagcgcatgccagctacttgggaggctgaggcaggagaattgcttgaacctgggaggtggaggttgcagtgagccgagatcgtgccattgcgctccagcctgggtgaccagagtgagactccgtctcaaaaaaaaaaaaaaaaaaaaaaaaaaaagtttaaaattgcatttacaatgtgtttttttccttctaatacaatatatgttcattgtagaacatttaaaaaaatactgtatacaaaaaataattgctggtgaattgtatctctcagggataaccacaggtaggttttttttgttgttgttggatttttttttttttctttttgagacagagtctcactgtttgcccagtgtggagtgcagtggtgtgaccaggctcattgcagccttgacctcacaggctcaagcagatcctcccacctcagcctttcaagtagcgaggaccaaaggcatgtgccaccatgcccagctaatttattttttgttggaaaaggagggtggtggggggcaggcaagggggagtctctctgtgttgcccaggctggtcttgaactcctgggctcaggctgtcctccaaccttggcctcccaaagtgctagaattacaggcatgagccgctatacgtgggccacaggtaagattgtaaaagatccatttaggccttctttatcccttggtgatactcatatatctttttgaaaatcaaaaacgtagatataagtatatagattatatataaaagtccaccatttctgaggggaacggatcactcttacactactttttttttttttttttttgagacagagtcttgctgtgtcgcccaggctggagtgcagtgtcgtgatctccgctcactgcaagctccgcctcctgggttcacgccattctcttgcctcagcctcccaagtggctgggactacaggcacccgccaccacgcgtggctaatttttttttttttttgtatttttagtagagacggggtttcactgtgttagccaggatggtctcaatctcctgacctcatgatccgccctccttggcctcccaaagtgctgggattacaggcgtgagccactgcgcccggcctagttttgtttaaaaaatatatgtgtgtgtaaccacattcaggtaaaaaattattgccagccttttacttgccatcatcttgacttctgtgacagtcatttccattaaaaaaaaaattttactccctattatgtgtctttaaacattaggattagcttttgtatagttttaaactttataggaatagaattatactgtatatattcttttgtgacaattgatctgtgacaaattgacattgtagagcaacggggaagagacactttttcaataaatggtgctgggtcatttgagtatccatatagggaaaaataataatttgcttcacacaataaaaaataatttcaagtggatttatagatatgaaaagattaaataaaactggtataacggtgtttaatagaaatatattgtgagccacatgtgattttaaatttttctagaagctaaatttaggaaaaacagataaattaatattttgtatttaacccagtaatgctcaaatacattttaatgtgcaagtaatttaaacattattagtatattttattttggggggcaaggatactatagttttagcaattcagtgtgtattttacacttacgtctcagtttggcctagttacatttcaagtgctccttagcacgtgactagtgggtactgtgttggagagcatagttttggaggattatgatggataacatcttattatctctggacacaaaaagcaaccataaaagaaaaatcgatgagttatgctacattaaagttaggacatcatattcctcaaaagacattattaggcttggcatggtggcttctgtaatcccagcactttgggaggccacagcaggaggattgcttgagtctaggagttcaagaccagcctgggtaacatagtgggaccctgtctctacaaaaaattaaaaaaaagaaattagctgggtatggtggcacagacctgttagtcccagctactcaggaggctgagacaggaggattgcttgagcccagtaggttggtgctgcagtgaggcatgatcacaccactgtactctggcctgggtgacagagtgagacactatctcaaaaacaaaaaattagtaggagagtgaaaggcaaattacagagtgggagaagatattggtaaatcatagttctaacagtttgcataaaaaatatgtaacatgtcaagaaaaaggtagttaactcattagcaggatggacaagagactttgctatttcatgagagataaatgaaataaaatctatcactgtggatttgtctttttctttttgtaattctgtttttgatttttatatatgagttgcttaacgacaggaaatgcattaggtgatttcattgtacaaatgtcatagagtgtactcagcaaatttagatggtagcctactgcatgcctgggctatatagtatagcctattgctcctagactgcaaaattgtacagcatgttactgtacagaatattgtaggcagttgtaacacagtggtaagtgtgtgtgtatctaaacatagaaaaggtacaataagaatatgatataaaagattaaaaaatatacctgtatagggcacttacatgcatgaatggaatggagcttgcaggactgaacgctgctctgggtgagtcagtgagtgtgtggtgagtgaatgtgaaggcctaaattatcactgtacgctactgtagattttataaatactgtacacttaggctgtacactaagtttataaaaaatatttttcttcagtaataaccgtagcttactataactttataaacttttaaatgtttttaaacttatgactattttgtaataacacttagcttacaacagaggcacattgtacagcagtacaatgtgagccccttcccgggctcaagtgatcctcccacctcagcttcccaagtagctgagactacatgcgtgtgccaccatgcccagctaattttttctgtagagatagggtttcactatgttgcccaggctggtctcaaacttctagactcaagcaatccatctgcctcggcctcccaaagtgccaagatgatagaagcgaggcactgcacctagccaatattttctttatatccatattctatgagcttttctgtatttttttaaaattttaatttatcatttcatttgtttgtttgtttgtttttgtgatggagttttgctcttgttgcccaggctggagtgcaatggcatcatctcggctcactgcaacctctgcctcctgggttcaagtgattctcctgcctcagcctctcaagtagctgggactacaggcatgtgtcaccatgcccggctaattttatatttttagtagagacagggtttctccatgttggtcaggctggccttgaacttctgacctcaggtgatccacccacagcctcccaaagtgctgggattacaggtgtgagccacggtgcccagcctaatttaaggtttttaaacttttttgttaaaatgaagacacaaatacacacattagggtagacccacacaaggtcaggatcatcaatatcaatatcttccacctttgtatcttgtcccactggaaagtctttaggggcaataacacacatggagctgttatcgcctaggttaacagtgccttctggaatacctcccaaaggacctgcctgagctgttttacagttgtcctttttaaataagtagaaggcgtgtactctacaatgataattaaaagtgcacaataaataagccagtaacataattgtttatcaagtgttaggtactgtacataatcgtatgtgctagacttttatacgactggcagcacagtaggtctgttttccccagcttcactaaaacgcgtgagtaatgtattatttcccccaagtggcttttttattccttccccgcttccccaccctcccgtgttgttctctgtcttttgtgttacagaattttctcacatgtctggtattaatttccttgtggtgaataaaaaattctttggaagctttagcaagtgggttcagccttttgactctgacttttgcatcaggatattctggatggcccatttgttgggaaatccccagcattggtatctttagatctttcttcttagacgtatcaggttcctgcagggtaaagacctgactatctgaagtttgagaggaaagtgcatagggcgtagtggaggagctgaaatgtgtgttcagtgactagatcgacctctgttttgtacagttgggcagggtgacttctgtctaaggatgctctccttttccagagagcccccagtcttctgtcatggttggggagtcccacgaaggcatggtgttgaggctttagctgcatcgtagatagtcttcacctaacctccatcatcctttatgcctccaccttctttaccccttgttctgtctgcatttagtgctgccagttctgaaccttctcccgacatggctgtggaaatggaattggttcttagtgtttttggctgctggcttggtctggctgcattgggcctgctgagtcatttgctatgcttccgatcttttatagttcatttcccccaagtttttctgttttcctgtttgttcggtttctatcttcagtgttagaggcttttcttatagcttcaaaaattcagttactttttctttcatttctccctgtcctgtgggtttggtttttaaatttatctttttaatatgtctgtattagtttgttctcacactgctaataaagacatacttgggactgggtaatttataaaggaaagaggttcaattgacttcacagtcccacatggctggggagaccttacaatcatggcagaaagcgaaggggaagcaagacatatcttacacacggcagcaggcaagagagagtgtgtgcaggggaactcccctatataaaaccctcagatcttgtgagacttattcgctatcatgagaagaacacgggaaagacctgcccccatgattcagttacctcccagcaggtccctcccacaacacatgggaattatgggagctacaattcaagatttgagtggggacacagccaaaccatatctgtgtcttttgtataattttagtggaagtgaaatagatgtgtatattctgtttgccatcttcctctgaatttgttagctaactttgtgtcagattaattatgcctgttggtgttttaatggttcttagttatttcatgtatatttccttcaactaaaatacgggtttgaagacaggccttttccaaatttgttattcttcattcaaggtccagtacagtaagtatggtaagcagtgaagaagctaactgtaaggtggacagtacaataaagccttgaaaaaaactagtgaaataatggtggttatatatatatatagtctttcaggttctctctgactgcaatggaaagaggaaagagaaattagaagtatttttttaaattgtcatttgatttcttcagagttattgtgggcttctgaactgtgagtataattctcttgctatacttgtgtcttgagatttttggttttgttttttctttcacctgtcttagtgtctctttgatgtacaatagaaataaacaaaaggtagttgattttgcagagtgggtgagggaagaaatataaattgtttagtgcctattatgtgtagatactttatatatttttttctgagacaggtagtataataatggttaataacgtgcttagaatactgtctggtacattataaacactctgagttacaattactaattgaatcctcacaataactttataagcaaggtttactgttcttccctatttcacatttgcataaaccaaaatacagagaggttaaaggatactaagttacggccggacacagtggctcatgcttgtaatcccagcactttgggaggccgagacaggaggattgcttgagttcaggagtttgagaccaagtggctgggtgcggtggctcatgcctgtaatcacagcactttgtggggttgaggcaggcagatcacttgaggtcaggagttcgagaccagcctggccaacatggcaaaaccccatctctgctaaacagacaaaaattagccagacgtgatgttgcatccagctgttgtaatcccagctactcgggaggctgaggcagaagaattccttgaacctccacaggaggaggtggaggttacagtgagccgagatcgtgccactgcactccagcctgggtgacagagcaagaccctgtttcaaaaaaaaaaaaaattcagaccagcctgggtaacaacaagaccttgtctctgaaaataaaacaaaaaacaaaaattgtcaggtgtggtaatgcatgcctggatcacgggaatttgaggctgcagtgagccaggatcgttccactgtactccagcctgagtgacagagcaagagtccgtctcaaaaaaaagattactaaattagtagatggcaaagctgggattcagattcattctggcttcacagtgttgtgctcttgactggtagagcagctccctccccccagtctgtggttttgctttttgtaggttcagttacccaatgttagctgcagtccagaaatactaaatagaagattccagaagtaaacaatttataagttttaaattgtgcgccattctgagtagcctgatgaaatctcatgcaccctgatctgtcccgccctatcccacctgggatgtgaattgtccctttgtccagcatatccaccacactgtgtatgctgcccgcctgttagtcacttagtagccatctgagttaggtcagctgtcaaggaatgacagtgcttgtgttcaagtaacccttagtttatttcatcatggcccccaaacggaggggtagtagtgatgctggcatattgttataattgttctattttattatgttattcttgttaatgtcttacagtccctaatttataaattaaaccttattgtaggtatgtatgtataggaaaaacatagtatatatagcgccaagtactgtccctagtttcaggcatctactgggggggactaggagcatatcccctgcagataagtgggaatagctgtatcttattctcatgggttctagattcagatattggtttagctaggtattatatttcctaactccttaattttaatcaaattatttaacctattgaaagtcaattttttttaatctgacaaaggggattattatagaatctcccttatggggttattgcgaagatgctgtgagatatgcgtaaggtgttcactcaaaattgttagcaatgattatttggtgccatttttctcattttaattagcagaaaacggagccctagagagattatattacttgtaatttgtcagtttgtaacttgtagatcttggtgcatgtttcacagtttagaaatcgtacaattgagggtaatcctactttgtcttgtttccaaagattgctctttcttctaagtctggtggtaaatggaggacagataggttcatagagtatttataaatctcttttgtgggcattttgtttatgttgttacagtacatatctcataaacttggacttcatggagtcagaattcatgataatttatagctgtattgaatttgactttcgcaagtgtttttggagtatgggcctaggattattttttaatttccacatgagtgtcagttcacgtctttctttgttctcttttctcccccaaatctatttctaggtgttagtgaagggaaattatgtcatacagtttccatttctttgcaaggcctagaagtctgggtcctgtgtccccctgtccttcataggctaagggagaggagcctattctgtcccttgtgctgtgccagatgtgattgttacagtgtgagaaggtcacagcccctctatttgtgttcccctatttccttcccccgtccatattgtacctttcttcctataacagtgcattctgtttatttgggtgtgagtctgtgtgtgagggcagttttgttatttcatctctgcttaacccgcagttaacttgcactaaatgctgaattaggactgtttaacgcctgtcacaaaataagttctcttttcttagtagatctgagcaaaagaaagaataccaactgtaacttttcagcaacattagctgtaaaaatatttcctcttggtatagcacaagacagttccatagcagaaatacaaaacttacattcttagtgtaatgtgctgggaaacgaaagtctaaagagaggtgagatgacaaaccagctatttgtgacccaagagccatctcattggctcattggaacttaaaaaaaaaaattttttttttttttaatttttctttgcagatagagtcttgctccatcacccaggctggagtgcagtggtatgatcatagctcactgtagcttctgaactcctgggctcaaatgatgcgcccatttcagtctcccaagtagctggaactataggcacatgctaccatgcgtggctaattaaaaaaatttttttgtagagatgaatcttcctttgtttcccaagctggtctcaaactcctggcttcaaatgattctcccacctcagccttccagaatgctgggattataggcataagccactgctcctggcctcattggaactttttagctataggacaaaatctacccatcttggtttgtccttttaaaatcatttgaaaatatataaacccaggaaaataacctcataaccagtgttcctgtaattcccccccaccgcaaattctggacagatggtcagtccatatgtgtaagtctggcttccaatccattgaatttcatgatgtaatgctgagatataggtcccttatttcacagagttccccttcgtaagtccgttgggccatttgagctcctgcagtatggatctggttgcgaagcagctagctttggcggagttggttcttggtccttgccttgtttttaagtgacacattggaagacagaaatttgggaaggaagtattttagaaccagaactctaggcaagcaaaggaaagtttgggaggaattgagttgctgggatatatatggagataattttcagggttaatgtggcatgggaaggtggtggacagaaaggaaggcctccctgagacccttctgcaaaatcccatatttgtgaatacaagcatcttttatagcatatgggcagatgagcacagctgagatagattggactctgaggttctgggagtgttgacttaaaaaaatatatatattatttatattattaggtacctcctaatatgtagtgatccctccatatctgtgggggattggttccaggattcccccaagataccaaaatctatggagcctgtctcttatataaaatagtgcaatatttgcatataacctatgtatgtcctctcatatacagttaacccctgaacagtgcgggggtgaggggtgcccatcccctttgcagttgaaaatttgtgtataacttttgactccccaaaacctaactactaatagtgtcacaggatctttggggtgccgcttcaccagccagaaatcacggtggctggtggcaccttctgcctgagtattgcccatgcccactgggcttgttcgcctactcggcttggcatgctgtgcttggctcacactacaagcctggatcccacacctgccaagggcgagccaggcgcagagctgtgaggggtgtgtgggtgtgtgagcatgtggtccagccaccttgcacagccggctgctgtagcggggtgggcagctccaggcactggcacaggtgccagttctgtgcaaggctgcagctggaccagatgtactgcatgcagcctctgctgtggaaacccgcatctggatgaggggaacgaggtggcgcccagaagagtggagatgccaggaactgcaaagccccaaagagggtgtcatagccctggctcggggattctcctctgctcgttgctcacaacatggcaagcaggaggccgtgttttagtcctgtttgtgttatagctctttcagtccctgcatttggcaggtctcgagttcttatccagtgtccaggaagaatgaggtacatggacaactggaggatgagcaaggtggagaggggcttcattgagcagcagaacagctctcaggagacccaaagtgggtagctcctttccacaggcaggtcatcccaatgagtgtccaggtctcagcagagaggagacctgcagtgggtagctcctttccacaggcaggttgtcctggtgagttgaagagacccaaagtgggtagctccttcctgcagctggtagtgctaacatctctctgagtctggggtttttatgggctcagaagggaggaagtgcgtactgattgggccatgggcaggcccggaaaaagcaccataagttctcactccaggctgtagactccacccgtaactggtggcctggctcccgggcttcaaggctgtccctggcttgaaggtggaatttcatgggggacctgcccctttctatccaggagcctttctgccttctcccaccatcaacaagccatccatggcacctaggctgttcatgacgaggtgtgcctgcaggcccacactgagccaccctcagctcccccttggcctccctcccgtgcttgtcagtgcccaaagtctggagtgggccagggcggcagggggctggtgtgtcagcgctgcctcgagcatgtgcatactcggccaggttgtgacagactcaggctcagccacaactttgctctgccctggagtgggctggggagaggccaggagcctgtgagggcgggggggcttcccggacccctaagaacgcagggatgcccagctccggagccgaggctaggaggctgcagctgtacctgggaatgtggggctcctgccccgccaactcagtagggggttgggatttccacctgttcccacctcctgccagccccactgcagcctgtgtcttggcagcagcccctccagactggcttccactgctatcagtactgtagactggaagccttattgagaatataaacagttgattaacacgttttgtatatgtattatatactgtatttttacaacagagtaaactagagaaaaaatattaagaagatcataagaaatattaagaaatatagaaatattaagaaatattaagaaaatatacttattaaatggaagtggatcttcataaacatcttcattctcattgtcttcatgttgagtaggctgaggaggaggaggaggaagaagaggggttggtcttgctgtctcgggtggcaaaagtggaaggggaggcaggagaggcaggcacactcagtgtaactattattgaaaaaaaatccccctatacgtggacctgtaccattcaaatccatgttgttcaagggtcaactgtactttaaatcatctctagattgcttatattgccgaatacaatgtaaatcctttgcaaatagttgttatactgtattatttgggggataatgacaagaaaagcatcagtacatgctcggtatagatgcagtcattcatttttttcctcaaatattttagatccatggttggttgaatctggatgtggaacccgctgacgtggatggctgactgtattgtatgttaaactttatcatttgtgacttctctgttttaaatgacctgttgattttctgatttgggatataaaggtttagcttatttatgttattccccatatctcttcctgcattacttattgttaaatagttgatatgtgtatttttcttttagaagtcttctgttgtaattttaccaatatctttcctttgcttgggttattgattcatgtcaatatcttgattccttttaagataaagatagtattgccctaaatattgacccttccccccagttccagcatgtctccctgttctgcctcatattttgtttttgttatttcttttatgttgggatttttacatttgtattttatctgcaactacaagtgttctggggactgctcatgggttgaactctaaaactagtttattatttttaattttaagttttcttgagctttcccagcttagctttctttcaaggccagtttttctctttgttttctccggtatttgtttctttttcatgaaggtggtattccctgtatgtctgatgatcctttattgtctgtaagtgtatagggaagcaggactagctacttttcggagttagatttagcccctggtaggaattcagaactgaagtactttgcttcagcatgcttttagtctgtgggcccctaaataacaaaataaaggagagttttactgtaaggttgttaacacctataccagaaacctttgctttattttctagagaaatagccccttgggatttttaaaaaattattattattattattttttgtccgagggtaaatgctgagttagcctgggcacaactagtcagttaaaccctgttttcacccctggctattaacatcagccctccccaatacctcatggccaggcccaaagcctcatcaagattcacttgagttttgtctctgttttacacatcactgtgcgtgtagctcctctttaatagctagatatttgttgaattctcatcttttggtggctcttcccttcctcttatttacctttaaaaaaaaaaacttgcatacttcagtttcattgaagtcttcacaggaataaaactcattactctaccaccttgaagttgaaaccactgaggattttaggaggtggggtggcatgttgatctgtagggtgaggattttaagtggtggagtgatatgttggtttgctgtgtggctagttttagagttagatgagctcgagttcagactttggtgctgccacttttagctgtggaactttggtcaaaacattttatttttcttatcctcagtttcctcatttattgaacaaatatttattgagacattgtttgtagcatgatgatgtggggatagttgaggtagttcttttataatgccttctgtatttctctaaagtaggatttgaagtcatctcctaagaaggagtggaaaaagcaatgctggggttggagatttgatgatagtggaggaggtttgaaatagggatagtgaggacagagccaagcaggggtggagaaggcttgcctaggagtgttgtggttcaactgagattggtgacagttaaattagaatgtacgaatttttttagttaatgatgttttgtctggtgctggctctcagcagtccaggtgtagtctggtataagttgtcctaatatttgtattgaatcatgaaatggacttttttccaggcttgtttattggaaggacagtgggagttagtaatattggtcaaagattggtttgaactatgactttacaattcaggaaatgtttgttgaacttttactaagtgcttggcatggttctaattgctttagatagatgtatcagtagaccaaacagagtctgtatagtgtagggaagcagataataaaaaaataataagcaaatgagtacattatgtaatgtactggaaggtgggacgtgggatgagaaaaaagtaatgccatagtatgagtgaatttgaggtctaaatagggtagtcataataagcctcactgcaaaagtgagatttgagctaaatacaaaggagatgggtgtattcatgcgggaaaccacaggctcctgtccggtcttccatctgcttcccagaagcaacggaaataatctgttttaggtgttgattttagcttttacattcttgtttcctaatagtatttgtttactagtcattgctccatcaattttagaaaaagttatatactgaactcctatcatggtaggtagggattttctctctcttacgtggtctttcctctcccccatcttcctcgtgtagttctagaacagtttttgtttagatccgtattttcgtttttaattattttgacttttaaacataactcagtattgagccaattgaagtagtatggttgcatttcttgttcagctttgtttttcttgttttcttggactgaaaattgcagttgtccctcttgtttgcttaatattcttaggtctggctaaggtttcctactctgacagctctgtaagtagggcctctcaattagtttccatgcagtcaagtgtattcattttgtcttcaccccctagacacacccctcctggagctttccttctccttttccctgcttcagtctagagaggttgctctctagacctgctgtaaatggtaccagggtggagaaacctgtggtaccagcaaaaataaggcgagaacaggtaagacaggtgagtagaaaatactgattgaaaaaactgatgggaaggacagaggaggaatggagatgatgtcttcttggggaattgtgttaaggagaaactagagttgaggaagagcattctaggtagtgaaaatggtgccagaaaaagcatggagatggaagtgatcttttattttttggtgacttgaaaagcctgtgttgtgttaccttcttagattatatgtatattaacttattgactttgccctgaagagcttttaaaaaagtttaaatgggaattgtgacaatcaggccctgaggagctttaaaaaagtttaaatgggaattgtgacaatcagaatgttaaacattgatatattttttgttttgtttttttttgagaaataaaggtctcgttttgtcacccaggctgtagtacagtgagtggcatgttcatagcttactgtaaccttaaactcctgggttcaaatgatcctcctgcctcaacctcccaagtagctgagaccacaggtgcacaccactgtgcctggctaatttttaaaattttttgtggaggaaggctctcactatgctgcccaggctaatctcaaactcctgggctcaagtgatcctcctgccttggcatcccagagtgctgggattacaggcatgagccatagtgtccagccttgatggtaaattattaatgtcctaaaacctgaacataggatatatcaggaacacttgaattcaagtgataaccttaaactgttgattttatatattgatttacggaaaaatctttacgcattggttacaaaaacttaataatcttggcatctaactatccaagccaattcatcagtgcaggaatgagtgctgtagtaccacttcagttttcaggcaagaacaagatgaacgacaacaggaaatttaagaagctgctccgtgtttggccaaattggagagagggcaagcagggaagttggaaaaatgtcattgaggcatgtaagcacaactttcgtctatatggcgtagctatatagagaaaattaagccaacaataatgagatactgaaaaaccaagagatgagtacctttctaaaagaagcattgctcagtttgaaatgctgaagcaaaatgctaagaaataaggttcacaagtggtcttcatgattgcaaactctagagtactttttgtgtaaatgcatgggacttctcatggatggtcaggccgttatgttcagtgggtgcgctgtacacaaatattacttgccggctgaagctttgactttttactcagttttgtgaagagcacatccttctggtctttatttgcactgtgattcaggagtcgcggctgaaggaaatagtcataaatcgtaatcgctgtcatgtgtcagtcattgtgttaattcaaatcttaattctttacagcagctcagtaaggttttgattactattctcattttacagatgagaaactgggcttagagaagttaagaagacagtccaagattcctcgtggcagtatcaagttctccatttccttacagtaaagcttaggccttaaggttaaccacagtgcacaattgggagtcatacatttaacagagagaagaatagtgccacctactgaattgccagtgaccctttcccctctagtattgtacttccttttaaaatgtatcagtcgtgttaaaatgcagtatttctgcaaagccttgcaaatttcttaatcatctgtgttgctggcttatactgagggaagagtgtagtttcataaaatactcgtcaaaacagggaaaattttgatttcctgattctgaaagtgggcaggcaactttgcataggatcttaccttcagagaaaggaagagatggggatgagtgttttttctttcaatccgtctttgcatatcatagtgttgtgagttggggtggcaagtaggcagtttagatttttacccagtactcatgaattccaaatggtttaacaaaatatacaaacacttcagcattttttctttgataaactgtctgattaaaaaagataggtgtctcaataaaaatttcaatgaaaaagtggccaaaagatttggacagacatttcatccatttcatatgaatgagagtaagcacacaaaaagatgttccacattagtagtcgttaggaaatgtaaattacaaccacacgagatatcattgcaaccctattagaatggctgatgttaaaaaccaaaaagaaggtgacagtgccacatgacaagaatgtgagacagttagtactctcctgctttgctggtggaagtgcaaaatgttatgattgctaaagaaatcagtttggcactttcttatgaagttgaacatagacttgtcacccaacccagcagtcctacttctaaatatttactcaagagaaatgaaaacattttcttacaatgacctctatgtgaacatttatagcagctttattcgtaatcactggagacagctcaaatatccatcagttggtaaatggataaacagattttggtacacctatacaatggaatcctatacagcaataaaaaggaactaactgctgacgcacctaacaaaatgggcagatcttcaaagcagtctactaagtgaaaacactaaactccatataactgtgatttcatttatataacattttggtaagtcaaatctgtaagaacagaaataaaatcagtggttgcctggggcggaagagagaattgagtataaaagagcatgggggcacttcttggggtgatggaaatagtctgtgtcttcagcgtggtggtggttacacagacccacttgtattaggctgttcttgcgttggtataaagaaatacccaagactgggtaatttgtaaagaaaagaggtttaatcggctcactgttctgcgggctgtacaggaaacatggcaccggcttccaggggaggcgtcggagagcttttactcatgatggaaggtgaagtgggagcagatgcgtcacatggcaagagagaacaagagagagagtgggaggtgccatacacttttaaacaaccagatctcacatgaactcgcttgtcaccaagggaatggcactaagccattcatgaggaatacgcccccgtgatccaaacacctcctaccaggctgcacttccaacactggggactacatttcaacatgagatttggctgggaaacagatccagtccttatcaccatccacctgatgtttttattgtgcacgttatgcctcaagaaataaaactttaaagagaagaaaaagtgacttatatgcaaacagatattatccatatactcttgcacacatatatgcgcacacacacacacacacacacgcactcattagagctcaaattttctttccagctggatcaacatttatttgtctggattaggtaccaccaaagttgaagtgaagtagatttcagtgtagacactgcttttgaaaacagtcttgaagtccttgattcatttatgtaatctgatttatttgtggcctaaaggctttatatttgtctttgtataatgagattgtatattataaaggtcatataattagcagaaataaaagatgtttaaaagttattttagtatttgttgctcaagttcttgtagctctggagaaaaatagttttatcagcgttataaataaaaatgctatttcttatattgatgaaactatgcagtcttcagctccatcttttagttaatagttaatgagctataatggtagggtacatttatgttttaaactgctagaattaagaatgtacatagtaagtctaggtgcagaggttcatgcctgtaatcccaaccctttgggaggctgaggtgggaggatcgcttgagcccaggagtttgaacaacatggcaacacctcatctctacaaaaaattttaaaattagccaggtgtggtggcacatgcctgtggtcccagctactcgggaggctgaggcgggagaattgcttgaacctgggggtggtcaagctgcagtgagctatgttcaccccactgcactgcagcctggacgacagagcaagtccctctctcaataaaacaaacaaacaaacaaacaaaaagttagctgggcgtggtggtgcgtgcctgtagtcccaggtacttgggagactgaggtgggaggatcgcctgagcctgaggggtcgaggctgcattgagctgagatcatgccactgcatcccagcgtaggtgacaaaagtgagaccctgtctccaaaaaaaaaatagagttgctcattactactttgtggtacttgttgatgtcctgtggagcagccatttagcattttttttcccaataaactcttggttaaaaagccacaacagtgagtaggagtggaatcaaagtagaaagttgtatgttctaattttcgtttaaaaatcagtttattttaaatgatgagctcatcattttacgatcttcaggatatactataatgtgtggcactaatagaatcagtgatagaataaggtgcattacagtagggcttcctaagttgctttttgtttatttaatgcatatgctcttctgtgtcttgagacactgtctccagcagatgagacctgtttattacagcctctgcagagaactatttgtgtgttgatcacacagtaaatatctaatggtagcctctttgacatttggtgtttgggaacaggagggagattgctgattgttctgctttttatattttattgtctcactccatccctgtatttttctctgggaatgtcttcattaacttaaccctggttttgaaggcttaaaagtgtgctggtacgctttttagaattggtgacagttccggttggtgtagcccaggtggcagtcattcatggttcacttgtcattgcatgaacttgggatagctgttcatattgtgttcatttcagttgaatttatgtgtgtgattgttgtattacacatgttgaatttatttttttttaattaaaaaaattttttttgagatggagtttcgctcttgtcacccaggctggaatgcaatggtgtggtctcagctcactgcaaccactgcctcctgggttcaagcaattctcctgcctcagcctcccaagtagcgcaggtactcaccaccatgcccggctaatttttgtatttttagtagagacagggttttaccatgttgtccaggctggtcttgaactcctgatctcaggtgatctgcctgcctcggcctcccaaagtgctgggattacaggcgtgagccactgtgcccggccatgttcatattaaaaaaacaattttattttaagcctacagcacccagtattttcaggcagcctcccaatcccaatactactaaccaggccccacgctgcttagcttttgagattggatggcatggctgtagaccatggtcatattttggcaagtgatgtcccttatagcagttcttacccttgatacaggatcctgtctggaatcacttgtaatatatagtcatgactctttagtcttttttttttgagacagagtctcactttgtcacccagactggagtgcagtggcactatctcatctcactgcaagctccgtttcccgggttcaggcctgcctgagtctctcaagtggcgccatccacacctggccaatttttttgtttcactattttggccaggctggtctcgaactcctggcctcaggtgatccacccgcctcggcctcccaaatgcaaagtagtgtttctttcctgatgtacaggatgttgtgtttttcatcatgaacataactgttaatcccaagttcttcaagcaaaagtctgtatttattacttgcccatcctatcagggatatgttaggatatgtcaatacgaacagtaagtgtagctggagctagtgatgagtgaatgtgaatcaagaaaagtaaatggatttattctttcattcgacacagttgagtgccttccgtgggccaggccccgtgctctactctgttcttctgttcatttttccccactcatctttcagatgattccttggtgatttggagttgtttttggcacttcgcctagattttgatgtaaattttagtaactcagtctctcccttttaaaaggtatctttctttcttaatttgtgacatcgagattatcactaataaatagttaatgccagagcaggacaaatatcaaaataatttttcattgtataagccttttacgaaatgatttaccataaagtgaataaatgtgtacatactacctagtttttatctcctagtgacaacagctttgaaataaaaaaaatcctggtagaataatggtgtttgggtatatgtatgacataggtgacctagaatgagggactagatgtgacttctaggccacatggccagaatggtatgtaatatttgactgtggaagatttgtgcaaccccaaatgataattttattctgggcctgtagggttgatgaaggctacctgttggatttgtgtggaaactggatcctaaatctatcatcttttgatggactaggggcagatgagacttgatcattgttagagctgaacttgcagtatatagagctgaacttgtatagtacacatatcaatagcagtgatagatgtgggaaaactttgatcacttatgtatgcttgtcattaatttttttgcaatttcttgaatgaaaaattttgaactagtaaacatttaaaaataaaatgtatagttttttcgaatctggctttaaatgtttagaataagtctctggatttaaaggttaggatatacttttattcattagatgataaagtttattgtgtatgcatctggaagattgttcagactgttgaagaagatgtatcctttgtttgcccccagccctttccttttcttccccaaccctacttttattcacgtaagaagatggaagaggggaggaaagcagggtgtgactttttatgcaaaaatattcttttttcaaaaaaaaaaaatactgagaatggggtcttactgtattgcccagtctggatttgaactcttgggctcaagcgatcctcctgccttagcctcctgagtagttgacattacaggcatgcaccaccacacctaggtaaaatattttgattatgaaaacgagtcagtttataagtggattttattgagaagaagaggataacaaagcttggtcaaatgtttgcatggcatttgtacagtaatcatgatggctgtttttattttaggacatactgtggctgctgccagacatttacccaaggggtggtgcggagttgtttcctcagctgaagctctttgttttgtaccactgagctgaggctggagttgcccccaaagcagtggcagggcagttcccacaagggagtgctccagattatcctgagatggggctggttgggattctaaagaaagaagtactaaacaccagggtgatcagtctagagcatttattggggaaacttacagaggattgcgacaatccttgtgacagacagcaaaaaggagtggggcggtgttctctctaggtatgtctgcagcaaggggattaaggtgtggagtttttatgagagtttgaggaatttgtctcaggtctagggctagtttctttcagtgttttgtgcagcaacttagatacctttatcaatgcctgggaatgtttaaggctccatactgagttcaagcttgctagggaaaacctgcacgtggctgggtcacagagcggtcaaagcactctggtatttggtcaggacatagaatgaaagcacagggaacaggacagccctacactagtggacttagtgatggacgccttctatttgcatcgtctctctttgcatgaggggagacaaagatactctcgattttgtactgtgaattgtgttagatgtgaagaggaggttgtgttgtcttcttagataactgttagaataatgtagagatcaactaagtttgaggatacaaaaagtgagattgtactgagtatatttttcaacagaagaaataattttggtcatgttctttttgttttatttgtaagagatggggtgttgctatgttgcctgggctggactcaaactcctggactctggtgatcctcctgcctcagcctcccaagtagctgggactacagacgtgcagccactgccactatgtccaactgaatcatattctatatggaaagattacattgtagtaaatatgtgttgtacttttgtggtcacattaaaaatatgtaaatgtatttgatgtattttgggactaggaatatgcagttacattaaaccctgtatgtagtaatgccattatttttgttttctttccaatttttgttagattaaatcagatttgtttttttgtgtttttttttttttttattgtttacttaaagatggcatttgatttccttaaacttgggagatacatactagcaaatgcctgtagtcaaaggtggttcctgggtaattcaagggtgccaattagagtatactttaagccacgtgtaattatgtccaggctttatatatacttagagcataaaaataaactttcattctctcatatttaagtccattttatatagacaaattcatggcataactttattttcagaaaaatcaggtgtggaaatacttaaaaccacagctgaagtaaattataatttcctcaggaagtaagtataaaagtatgcaataacgattataaaaagaaaatttaaattctttaacatattttttgcagtttcttgccctccatcacttattttaaaaaatgggtgttcttaaaaatgtgcaaattaggtgtatattttaatgacacctgtactacaggagatccatgtttctgtattacattaatataaatcttatttgtctaggatcagaaatcaaatgcttttagttgttgctgttaattatctttacatctgtttttgatgtttagctttcctgtttgtgagtaaactactttattagctattaagatgcatggaaaggccgtatcccaaaagagcagtagtcattataatagctttatgtaattaactgaaagcagtatttttctctaaaaggttatcatcttagaaagttaaaaaaaaaaagatgttctctagaatatcctttgtcctattggactgatgagctgcagataatggtaatttttatatttaaaactattgtgggacttaagtttaaaattttatgtagtatttcaagttgtaactttgccatgcttaaaaatcatagcaaccaaagtgtctgatgtgatgtgtgctgtgacacattcggagatggctctttaatttgctggtggaggtgtgaaggttaaggaggtccagtttttgaattggttacagattgtttctgaggtagatcaagatctgatcttttttttttttagggcaactaaagatgcccctgaaacataacaacagcattggtcgggtgcagtgagtcaggaaggcccccatatttgcatcccaggtagaaaatgggcctaacaagttgttctttttgcttttagttgaagtgtcttttattatagtggcccctcctcctgtgttttaccttataccttgttgtagacttcgtgagcgctcagtacattgctgagaatttaggatgacgttgatttatctatacagtacatgtttgtcttctcttgacctctttaggtgatgtagatgtgtaaaatttacagtgttcattgatcctgcttcttgttttcccacaattgattttattagttaaaaagattgaattcacaaaactagaaggttctgacctacttaatttttttaattttagagacagagttttactccagctcaggctggagggcaatagcactatcatagctcacttgtagccaagcaatcctcctgtctcagcctcctgagtagccgggactacagatgcatgccaccatgcctggcttatttttaaaaattttccttttggagagatggggtttcactttgttgcctaggctctgatctactcttaaaagatgaggacaggccgggtgtggtggcttacacctgtaatcccagcactttgggaggttgaggcgggtggatcacaaggtcaacacggtgaaaccctgtgtctcctaaaaatacaaaaaattagccaggtgtggtggcggatgcctgtagtcccagctactcaggagcctgaggcaggagagtggcatgaacccaggaggagcttgcagtgagccgaggcaaagagcgagactctgtctcaaaaaaaaaaaaaaaagatgaggacatactgagcattgagattacatgaacagcgcattaggaaaaaaactttcattttattggtttcaaataacagagtgaatctcagatagaggtctttgcaagccagtttggcattggactcagctttgaacccctccccgtcttcccttgtctctagtataggataaccccgtttatattcaggcgaggtactaataactttcttctgggaggacctgtctacagttgatgggtcctgaggccagagaaccatggatacatcgcagcctaggtgttatttatgctctctaagaatctgtcaggataagtcactctgaggcataggtgcttacctctggacctggggtgcttgccttcagtgaattgtaatcctgattcttgattccttcttgagttgttgatatgaatcattttttcttttccacagtagctcctgctataatatgctctggggccctgggacatttcatgggtgtaaagtagcttttttccttctgtttggttctatcgtttatggacagtttgtctaatagatataaaataaacatttatatgttgttgaaaagttgttcctatctccccctttctttaatgctctcatagttctaattagctatacacatttaacaattgtgataatacttttaacctctgattgacaacttacttaagatcatgtgtcacttgttaatgttgtaattgcagtgctgattcaaacttcaaaatggagttttttatgtcctccttttctgcataaacacagtaacagtctaatctctctaactccattttgatatctctttcttttccctacagaaaagaaaacatcttgctagagagagatcaatagagagttgttttcagaagtgaactttatatgcagaaaataggaataagtctataacaacagatggtcagaaaatttcatcactgtcatagcagaggcttagcagaatataacttgataaacactacttgtttaaaacttttgaggccgtttagcaggaacattggggaggtgttatttctcatgggtggtttagatctcttagagcgttctgggccattgtgaggtcttgtgcatttgttctgagtcagatgggaagccactggaggatcttgagcagaggcgtgacgtaaattttaagaaacttgttgggatggttgtgttctaaagttaaggaatcaaggatgatgtcaaggtattttcattagcagctaggagaatggagttgctaatttcaaaaaaaaaatttatttttttattttttagagacaaagtctccttatgttgctcaggatgctagagtgcagtggctattcacaggtgtgatcatggtatgctgacagcctcagactcctgtccttaagctgtcctcctgcctcagcctcctgagtagctgggactacaggcgcatgacactgaccccagtgctatttactgatttggggaaatctgtttcaggattaggttttgaggggaaagccaagggtttatcttcaatttcttataattgtaaacaagattttagaccaatgatttattagatatatgatttcttttctgtaatgtttatagttcatttaggaattttagttatttatttgtgtttctttttctttcttggttgatcttctagaacttgttgtttctgaataccaactggtggcttttatttgttaaaggtattttttttttgtcctttagctctgtgtcatttattttatatttatcggctccttttccttatcttcctcgtgtgtggaactttaatctttgtcttgtaagacttgaaaatctctactcactgcctttagaggctttgtgtctttttttttaaattgacgtataattctcatactatacaatgagtacaatcaccaccatcaattttagaaatttccctcaccccaaaagaaaaccccatacccaccaggagtcactctttattccttatcttcagcccaaggaaaccactaacctactttcttatagatttgcctattctggacattttatataaaaggaatcaggctgtatgtggtctcttgtggcttctaacacttggcataatgttttcaaggttcatccatgttgtagcatgtatcagtacttcattccttttcattgcagaataatatttgacaataaatacacctttatacagtaagaatactaatgctctaggatttagcgttccaaaaccttgcctgatttttctgtcttctggcagcagttttctgtgaatgcacagcctagattctccacctgcttcttcttctcagaattggtaaatacataccaaaggtaaaagtaaatgcaaaagatcagctgaacttctgtggttttgaagttttttagcccctcctgttcttgctgtcttcaaacagatgatttttatattttatgcagttcttctgtttttttctaaaggaaatgctcttctattgccagctgttgcatctgtcttggatttagaaatctcaagtctttttttttttttcattactgttgttagagatcctggttttaaaaagtcagggggccatgtgcggtggctcacacctataatcccagcactttggaaggctgaggtggttagatcatcggaggtcaggagttcaagaccagcctggccaacatggtgaaaccccatctctactgaaaatacaaaattagccgggtgtggtggcacacacctgtaatcccagctacttggcaggctgaggcaggagaatcacttgaacccaggaagcagaggttccagtgagccgagattgccccactgcactctagcctgggcgacagagcaagacttcatctcaaaaaaaaaaggggaaggaagactcttagtaagctagctgtatacaaacccccgtcttgtttgtcttctgttgtaccctgatgaggcagttgattttagtctctgctgctgttagtcaggatccttggacagaaaaagagtgaatgaatacattatttctgctgtatcatagaagatgcaaatatccataatttattgattttgctaacaagtttttatatggcatgcttcctttgaaattcagacattttatgaattcaagagtttgctggtccagtgtaaaaattacattgtaattatttcaattaaactagatatggctttgacagttttgcttactgtagttctggtccctgaaaaaagaaatggtggctcacatctgtaatcccagcactttgggaggctgatgcgggtggatcactggaggtcaggagttcgagactggcctggccaagatggtgaaaccccctctctactaaaaaatacaaaaataaactgggtgtggtggtgggcgcctgtgatcccagctacttgggaggctgagacatgagaattgcttgaacctgggaggtggtggttgcagtgagccaagattgcactactgcactccagcctgggcaacagactttatctcaaaaaaagaaaaaaaagaaatgttaaatatctttattcttagagtgaaactttaaaaattgcgtgattatgtttaacatgcattgagcagaaacatttctagtttcacaaacccctgagagtcatgtggttgaggagaatggggtcagtgggggaaagagtagaatgtggaaatggatctttggacagtgccagcaggactaggctgaggcatttgtcttgacataatatctaaagagtcaccaaaaccctcagtaattaagataaacaataatttaatgcagcttttttttttttttttttttttttttgagactgggtctctgtcgcccaggctggagtgcagtggcccaatcatggctcattatagcctccaccttctgggctcaaacagccctcccacctcagcctcccaggctgggactataggtgtgtgccaccacaaccagctattttaaaatttttttgtagagatgggggtctcactatgttgcctaggctggtctcgaactcctgggctcaagtgatcctcctgccttggcctcccaaagtgctgggtttacaggcatgagtcatcacgcctggcctacagtatttttaagaatcaaaaatttatgcaagaaaatctatagtgaacaatatacttttatttttatttaaaaattttttttaaaaccacaaggtcttgttctgtcacctaggctgatgtgcattggcacaatcatggctcattgcagcctcagcctcctccgtctcaagcaatcctcccacctcagcctcctgagcagctgggactacaggcaggcgccaccatgcccagctaattgttttatatttttttatagagttggggtttcatcttgttgcctaggctgaagatatattttaaagtaagttttaagaaggtatagaagagtatgtagaacacattatattggtgtaatgcaaaagaaactgtatttgcatatgtgcattcttgtatatgcatggaacacctccagaaggttacacaaacaattaggaacagtgattctatctagagagaatgtgatggaaagaaaatagggtgaagggggggtgatgtttatggttcattgcatatccatgtgaattttgtaccatgtatttaataattttctctttttctttttctttttttttttttttttgagacagagtctcgctctgccgcgcaggctggagtgcagtggtgtgatctcggcttactgcaacctttgccttctgggttcaagcaattgtgcctcagcctcctgagtagctggagttacaggtgtatgccaccacaccctgctaatttttgtatttttggtagaagtggggtttcaccatgttactcaggctggtcttgaacttctggcctcaagtgatctgcccacctcagcctctcaaagtgctgggattacagatgtgagtcactgctcctggcctgtattttctttttttccaattaatcttacagcaaatataccatgcaggtgtgttttctgatcaaaagaataaatgtaaaaagcaaatattttaaagaaacaatatccagtaaagtcctcagtacttagaaatgaaatacctttctaaataatacatgagtctaaaatcaaaagagaaattagaaaatgtttcaaaattagaaagttatttgaaacagaatagtaaaaatataacatcagtctttattatgcagcttgaaagagtacataagagggaactttataactttaagtgcttatataactgaaaggaaaaaagcatcaattgtctatgtttttaccttaagaagctacaaaaaccaaaaataatgagaagtaaagagagatcaggagagtgtggcacattggaacataggacagaagataaaggagttttaaagtatctatttatcttgaaatccttgcaatttaggactgggagctgccttatttttttgatatgtttctgtttttgttgttaatgagtattttccaatgtcagtgaaaaattttcagacacaacatttaaaaatagtcattcattttggtgttccgaggtttatttattcattccccttctatcaaacatgtaggctgttaacagtgtttcagtattacaaataaacatattataagcctcaaactgccttaaaactgagaggagatttattggaggtttagtagaccagtctaccagaagttagacttctgggtactcagatttgtttgcttgtcttctgatggtctgtcaactccttatgggatgggactctgtccaattattttgggatccctactgcttaatttattgcctatgcacagaagaggcagacagtaatgatgcacttacagtgacatggagcctttgttatgggcgctctcaaagccctttatgcttgtaatgtttaattatcataactgaaaaatacataccattttaaactttatttaaccgacgagaaactaagttatggagagaaagttaaaaaaaaaaaagtgccagggtcacatatctaataccatgtggcagagtttaagttttaggatacttgaaataaactgaatggacctttaaatttagggtgatggaaaagatgatttgggctttggagttgcatgcggctttgacattttacttttacagtctaattgtatcacaagtccttacttgtgtatgtgagcctcagttttctttttcttgaaaatgatgatattagtaattacctccaagtttattagggggacacattttaaaacacacacacataaagccaccttgtacagggctggaacaatataagcccttagtcagtgattggttattgtctctttttcctgtctctttcgctttagacttgttcttaaactctcaaagcttttctcttcatttataaaagtaaacataattatatttgcagatttgttgtaaaatataaatgagatttactctttaaaaatggttttaacattttttaagttaaaaaattgtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaattgtgataaaaataaattttaaaaaatgtgaaatttgacatttaccagtttttaagtgtacttactgttccagtagtattaagtatattacatttttgtgaaacagatctctagaatttttttcatcttgaaactatgaagctctatgcccataaagcagcttctctccttccagcctcatcctctggaaaccaccattctactacctacttccataaatttgactacattcgatatgttatataagtgtaatcatgttatttattcttttgtgactggcttatttcacttagcataatgtcctcaaggttcagcatgtgttagaatttctttccttttcaaggctgaataatatttcattgaatttatataccacatgttgtttatttgtggatgaacacctgggttacttctaccttttggctattgtgaataatgctgctatgaatatgggtgtttgaatatctcttgcagaacctgatttcagttccttggtttatacccagaagtgggattattgaatctttatggtggtcctagttttaatatttttaggaccacccatgttgttttccatagcagttgtaccattttacattcccaccaacaatacacaagggtttcgatttcttcatatccttgccaaaccttattttctattttttaaaaaagtagcagctattataatgggtgttaggttggttttaacattttttaatgatacaaatttttagatagaattagcaaagtgactcctgaaatttcttggtaagctggaataacaaccattcatgccagcatgacaaaaccaaaagcatacgggagggaaattgacaaaaaaggccaactactatgtagctccgtttggaaagaagaaaagctgtcttatttatgtctgttgcttggaatatagatataatgagggatagatccacactagctgctactgatattatatatatacatatatatatatatatattatctctaacagagtgtgtgtatctcctcttcttacatatagagacggagcacagatctatatgacaacgctggtcatctctcggcacagagacacagaggttcaagcgttttctctccctccaccgcgcaagtatgtgggtatacaagcaggagaaccgcgcgcgccacttacgagaatttagagcagctggtgttcactctgttggatggtgtggctctgaaacgtgatctcagcgcacccacctggcttgggtctctcatatttttgggattacaggcaagagcgactgcgcgtggcctgaataacactattggagtctgtgcgtatcgtcagctcttccaagcccccccggggggcaaacttttaaagggnnnnnnnnnnnnnnnnnnnnctttttgagatggagttttgctcttgttgcccaggctggacaatctcggctcattgcaaccaggttcaagcgattctcctgcctcagcctcccaagtagctgggattacaagcatgtgccaccacgcgcggccaattttttgtatttagtacagatggggttttaccatgttggtcggggtggtcttgaactcctgatctcaggtcatccacctgccttggcctcccaaagtgttgggattacaggcatgagccacctcgcctggcctgatacagagtatggagtctgtagtaatggttagctttttcaggccatcatgagggataaatttaaaatgtatattgttgatttttcacttttagctgagaaatgcaggttgtagaagggatttacattcaccacaaggggtcctcctgacaccatcagacccccaggccagtattaatatgtctgtgactgcaaagcccaatttctgacaagtaacccagagcctttacaacctgatcagtggttttctctgtttcagttagcttggaaagttaacctaacttggaaagacacaatagcttgacactgttgctatttgttaaataaggtgagcagtcaaactgtggataaattgcatttatagggtaaaaaaaattgatggtgatgaaataagttgcatgtgtgtatatacattttccataaaataaaagttctatgtttgttttgggcaatgttagcgttaagtaactactggattgccttttgatgtttgcattattatggtcagtataagcaataaaaaaaactctgttttataacatatatggatagattgaacactttgaacttcttcttctgtcctgtgttgtcatgcttctaccactgcatctgaaaaactaatgcagcatcttacagatttcaggagcctttaagaaaaaagcaattacagcagttaacctctcagcagtttctaaatctggaatttagctttgatctctgtatatatgtcaaaacagaaataagaaattatcattaattagagtccgtaaaaatactacttagattaataaggtcagggttttgttgtctttgcctttttagataatgaaatagtttttatgccattaattttagaggtacttgagaatacacattttattgtcttatccaattggcagaaatattaaataagattttcatggtaagagttgcattttcccatctattttttgtatttcactgttgcttaatttagtggttatagttattttctggtgactttgatacatctgtcaagtaccagccacgtgtctagcaggtagtgtgatgacttttatctgaattcatattggggcaggattactgacactagaggactatcacatgagcctcatgatttggtgaattagggtgttgcatggggataagagcagcttatttgtcccatattctttgctgtgtttcttctcttcctttctttgtcccattggtcctcactgtgattcatttaccctttgtaggcctgtttccagactcttctctggaaacctttgtagcatctggaggtaggtgatactataggtggtggtttaactgtgtcatctggctggtgtccaagtgcctgatgcatatcccagctctgcacctgaccagttagttttaatattagatatgttacttaatttctctgttcctcagtttgttcatgtgtcatacatggattgtaatatcatctatgttattggttatttaaagtattaattgagaaaatagatgtaaagcactgcagcaaattggtgaagtacatggactctgtagccagactgcatgagtttgatttccagctttgcaattcagaagttctgcgatattgtgaatttaagttacctggcctctctgtgcttcgatttcttcattggtaaaatggggataacagtatctaccccatgggtagtttgttgtgataggtagatgagtcatcatttttaaagtacttggaagaaggcttggcacagagttagcatctacctggtatcatcatgtcaaaattatattttcattattattagcattgctattacgctatttcatgactggcaagtagtactcagtaagtgataggtattgttattgttactgtcctcattttgctgatgaagaaactgaagttcaggattttgaaatgattttctttgtctcacaggcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaaggtgattagatttattatgactaatatttctttgattttaaccaagtcataatttttgtggatagactaaaatttttgaaaaattgttttcgtggtggaaacagcaagacaaaatgacaggaatggtaattagtaatcttactggaaatgagcgcagtatgagatacctgacattctaaagttaggatatattgtaattatcaagtgctaattggaggaaccatattgtaaaactgtcgaagttatttaaatctgtaactccctgattaatgcaaacataaaagagttgaaagatgatatatttagaagtatgcatgtataatatgaataataatttttttttacattcctcctgttgactggcataaaagcatttattagtgctttactttgccaagtagtgctgccttggtgtttggtattccttaagagagacaaaattatgacaattatatgagaaatgtgaaagttaggctggtattttgtgaactgcttttggtgacatttacaagtagtacatttcctaatagttcattcccagggaccttctcatatatggccagggttttgtagctaagtcagattggacaaaattgtacatcatatgaaggggtttagagttctctcttatgcttactgatcttgcttataacattttttgcaaccctaatgattttatctaatctcacacactattttcatttgtgctctattaaaatttgcagtgaaagttttaatagtatcagtactaaaattatgtgatttatttttttatgtggggtgggaagaagcagtttacatgattttcctagactttatgtccatttttctcttctcatattcttgagaaagcaaagttttcataatgtttagttcacttattcattcaataagtatgtactaagccttcatactgtactgagatctggaagtgaagcagtgcccagacagccatactgtcactgacgtccagcatatacatataccttctctgtgaccatagccttgaaaagaaaacaaattctctttgccgtcttctcattacttagaggtgataggagggtggtggaatatggcctacacttcagtaaggccctggagacaatatgtacagaacagacagaatttccttctgtcacggagcttgcattgtagtgggggtagccaaacaataaactgaatgttgaagtaaatcatgaggtgttttagaaggtataagtgctgtgggaataaaatgaagcagggagagcagatgggccatgcagtttcagacagggtggtctggataggccttgttgagtaggcgacatttgagcatagatgtggcaggggaaagggagcaagccatgtggataacgcgggggcaagagtgtcccacatagagggacaggcagtgcagagtccctgacgtgggcagggagtggcaaggaggtcagtgtggttgtgccaaggaaactaggggatccttggcgatagaggggagccatatcacgcacggccttacagactgtgctaagtatgtaggtgctgaatctgggaaagttggagaactgttgatgagttttaagcagaggagtaaaattgtgtgattgatgttttggaaggatcagtgcacaactcagaagggttgtgaatagagtgtagggcggtgagagctggagcagagagaccaggtaggaggcctatggctgtaatccaggcagcctgggccggggtgaggccaggagatgtggtgagaaatacatgtattctggttatatctggaaggtaaagataagagtttacttttcaagtaggatttaccagaattgctttaaaatatgccagtactaaaagaggttggtgtaaaggtcacagaacttttaaataagtggttggcttttatattagtatgtagaattcataaataagggaatatagaggactgcttacgctttttcacttatgttgccattaactgtagtctgtttctgttcttttcaagatgtcactggattaggaatttaaaagcatagtttgtctttaatatttagcaggaagaaaataataaaactctgtatcaccaaactagccagtacttgcctcattttgcagctctttgaccttgggcaagttgcttggcctctctgaacttcattttcatcttctgtgaaaatagggaagtagctgcttcactgagattgtgttatgggttaaatgcagttattttatatacagctatagttgcttgataaaaggtataggttattattagcagtatcacctgtatcctcttcagctcttctctgtggcatgagttggttcctaacatttccatagctgctgtttcaatctggtctctacttagtcaccttggtctctggcctggagaatttatgctctttcatatcttaacatcttcctatactctcaagatcttgcacattaggagatgatatttggatattgaaataaattatgaagtagttgcaggggtaggagagaaagcccccatctactggtcactttaaagtcacagaaaccaggttcatccctctccctcattctctccatcacttttcttgtttgtcctctcatcctctctgtcactgcgactgcattagctccagtcaccaccaccctgtgcttacaccactctctctcctgctcacctggtcctgtggcaggtgttcagtctgactaaaaaatccttcctgtggtagggtggtgtgctgtggtgtgaagaccctggcatcgtagatgaccgagtgggcttggtaactcctgtgcctcttcctagtctatgaccctgtctttagtcttagtgctctcatttttaaaagaattgtaataccaagtttgtttaaaagatgtgaaaattagttgtaatcagtacttagtgtgtagaatataattgtaggttactaatgaaggtagcttttattttgtaacttttgagagccgtaagttccaagatggactcagtgtgcttggattatttgtacagtccattagtcgatggctcagattaaactccagtccgttctcacaggagtgtgtcagatatgcttgctggtggatgtgctcttatccttcccatcatgacagtggtcctttacagtcttggtctcttagtataatggtggaggctggggatattttttcatgtattctagttgatctagttgcttgtttcctctgttcttttcctagcttgctcgtgtttttctggagcccctttcttcccagtgttccctggggtcagagttcatgctggtgaatgatatgttttcagtggagcatagaagaggtcacttgaactctggctactattaggagcctgaaagtaaacctagagacaaagccatcatcaagagtagcatgttagaaatgaaacaactgtcctggggcatcactggacacaaataagcctcttgttctcctcagcctttgttaagctattgttttcagaagttagtgacttcataaacaaagcctcggtcattttcactgttaagtaaaatacttgatttttgattggtttatacaaatgtactactaacaaaattacccacatttaggaaagctagaactgtagagtctcagtgtgtcttatgtacattcggagaacaaaggcaccaggagcctagttactaattatcttactgctaaagtggaatgtgttcagacagctaaatttttgagatgaccttgactgtctcacagtttgaatggaaaaactaagtagctctgcattttaaaaagttgctagtacagattgtaagggtgttttctgtctgtcttctttagtatgagtttattactcacttatgttttgaaacgaagaaaggaaatcatgcctcttggatacctcaatattccctaagctaatgttaaagaatgtggctacctcaaattcttgattttatgttttcgagagagtttttaaaatttatacacttactatgacagtaccaaccaggaaaaatattttacagcaaaaatatttgggtacctatagacatagagacatagatagatcaggaatttttttccagaaaggatttttatttcatcaaagtaattattttaactctaaggtcataaagaattaggttagtaaaatgacaaaggcatgactttgaaaacaaaaaaggtttgagaagccatctacagacatgatctgggtcagacttgatttgcagcttactcaattttagaatcggttgtcagttttgtaaacagaagactgctggatgaattgaacagaagggtgagattagcatattaataagttactggctactggccttctttttctcctccctcttttccctccctctttctccttccctgaatgaatctaggaacacagagccatggggtcacattactaagctggtttcattctgttcagtagcttgatctagccaggatggtctgtgtttcagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaaggtataaataacttaaaaatatgttccgttttatttgaattcatgcttttgcaccgaaaaggtagataaatgtttttcagaatttatttcaatatatttacagttaaatttaaggaaaaatggaaatagatttggtatgggtttacagctattacataaaaccaattagatagcttttcaaatagcaaatgaaaatattttttatggaaatgaattttaagtgcattaagctatcttttaatgctctgtcctatgtctcaatagttttatttttttcttttaagacatctgtattctgtaatatggaagtttttaaggaataaagaggaattttaacttaaacagggttgtaggaaataagagtaacatgtattttcttattttaaaaattagttttctttactcactgtaaagattgtatattcaatttgaaactcggtattattgtaaggtgggcttaggaataccatacataaacaattttcttctttaatgttgttagggtttttgttcacataaaaatgtaaatataaaataatagcattttcattgtaacattcaagacagtatttgggaaacatatttagaagttaaaaatgctatgtaattggtgcttgactaaaagcaaatcagctgttttgcttagagtagtagaaatatttaagttaggaaataaagttcttaatgaagaatataataaatattttttgttattatttctaatatatttaaatgtcatgttactcccttaggaaagatttttaaaacgaggaagctgcactgttgtaaaaggctgcagttttatgagtagaggtatagactgattgattttagttttcagggtaaaaattttagtaccactgggtactaaaccaagttagcaccaaactacagtttcaccattaaaatcgcttttatttagttgttgctgacatctattgattctttcctaggcttttaaacatttacaaaacgtgatattagaactattttagtattcattttgttcacttgattatgtaattagatactcagagtaaatattttgctgagttaaatttacactcttggattttaaagggctttgggaatgggaactttttaaaattttagtttctgagcatcagaaatgtatagtataagtgagtgtgactaatagtgttcagagccaaagaattctatacttcttgaaaattttggtcttttcctggatttgctggggttcgtttgcatattgccacctccattgtatgataacattgtgttagcactgatgattaacactaaggctctgatttccttcacaaagcctaagctgtattcaagatctacacatccagtaccaacagaatattaaattatcagctactggatttctttttattcagtgtgactttaaaaccgtgaactttggaagaaaagagattatagtgtttttgctcaccccaaagtgattgatggaaacaacttatttttcaattaagtttgctggctgtcagagcaaatgagtacaactatttttaactgaaatatgcattatgatagaggttagggttgggtgagagggaacagagctcacacgtataaaagatgggaaaaggtagggatagtgttaagggtcagaatcagtttcatatgtagggctgcagcaagccatctcctcatatacatggttttgctttccagttgttcagaggaggttctgacaaaacctgggagctgtcatcctgttccttcctggtgctgcacacactgcttccattgtgattgcccagtgtgtaactatcttagtaaacttcctctctctcccctcatgttactcttgtaccaggacagggaggcaggaaaccttgttgttatgctggttaatttttatctgtgtgataaggacaaagatgttggtgtataggaattggctgaattggttatattcaagtataaaagttacaacttgtagataaagacacagtgaaaagctcaaatccaaagaatatacaaatctctatctgcagttagacattctaaaccacacatttgattttatcagtcacattaacctcaaaaagcacagcagtgtcccaatttaagaagacacataaaataccaggacaagctaaaaataatagagcagactatatttatataccttgaactgaaacctttaaggtacccttaaagccttctggggtgtttgaaccaagctcactgtgcggttgaatttggtgtaaagaatccaccttaggtcccatccaaggaagattatattttaaagtattaaaaaggactttgttttaacatgggttcaactacatcatgattttctaggtttaaagacagttttgattcagaatattgaattaaatgtaaatgttcacagtggtattttaggttgcaagactatcaaatgcagaaagccctgtttgggaagttatttgattataccagtttttacattatttatttcatgtttttgaaaggctaggaaggactaaagagtgtcagatatttggttgttaaatcctgatctgatctcttgatttctccagctttgggccgttgtcctgttgctcattaatagcacaattattttggcttttcagtgcctcaaacaccccgaactcttcctctcaggcgtttataccttctgttgcaccttcctagaaccatcatctctgcattctctgactagccaactcctacttaaccttttcggtctcagcttaaatgagctccatgaggaagcaggtgtcttcatcttttgctcactgccatatgcttggcacatactaggtgtttgttaaatatttgttgaatgaatcaatgactagtgtgcacagaaaaatacctaagagtagaatgcatggtactgacattaaaatgcaaaaattactgtgggaatctcactccagtgctctcattcctgtcagtctaaaccaagttttctctagtgtcccctcctatatccttttcttctggtcttgtatagcacttactgtgatttgtcattatatattttacttttttggatttctgtcttctattagactgtaaacttcacagacataatgtcagttttttttcttcttgacaaatagttgacataaatgattattactttaatgaatgaataaattctttgtagggttagatttgattttaaaaggctctttcagagctaaaatcttgtgattaatacagtgttttgtaggtaaatctagttttaggatcattcagctgtcagaaataaatcttccatgtcaaacttttggccattctaatttcattgagtttgtgttttcttttttctcttagagtaaaagtatttatccagggtttaacatagcactctgcccatagtgggtggctaataaatgaatgaatgctttcctttttcctttcctttttcctctcctctcctctcatctgccctcccctgccctcccctcccctctcctgtcctttcctgtcctttcctggcagagtcttgctctgtcgcccaggctggttcaagcagttctgcctcagcctcccaagtagctgggattacaaacgtgcaccaccaagcctggctaattgttgtattttcggtagagacagggtttcaccatgttggccaggctggtctcgaactcctgacctcaagtaatccacccacctcggcctcccaaagtgctaggattacaggtgtgagccaccacacctggtcaattttacagtttctttctgctttacctcaaatcatggcattttaaaagagagctgtgcttcttatagtaatagctaaaatttattcagaaatactacatgccatgctgtgttctgtgcattaaacatgcacaaaaaacatacatgttattccattctcacaaatgtttgtaagctctctgagataggaaatatcattatccccattttccagatgcgataattgaggtactgagagattaaataacttggcaattgttgctcagctaatataaaaggcagagcaagattctgaacagtgggaatctaactgcagtgcctgtattcttaatcaatatgccgtacacacccaaatagaaaaatggtaggatcataacggaattttcttttttgtgtaatttttgcattttgatatatgtaccatgtcttctactctcagatgtttgcgtactattcattcattcattccacagatatttaatgagaaccaagtaagtaagtaaattggttagtgtgatagaaggtgttaagtgttacagtgaaggtgaggtcagatgacagtcttatatagaatgtctatgtgtagactgcattgaaaaggtgcattttattgaagacctgaaggaaatatgggagttagccaagtggatacttgggaaaagaaagttccaagttgattgtataggtagagcaaaggctcttgctgggaaaatggcattgtggctggaacagagtgaatacggggttatggctatctttccagttcttcgtgcctacgaggtggtggtttaaccagagacacaggcatgggttaaaagtgaggcccactagaaacaagccacagtttgccgatctatcctaatccacattccttaaaaatagctccatgagaggagtgaatcggcctttaaatatcctcctgtgggaaacacatgcctcattctggttctctcaacagatgtcttaacagaaagactggtgaactctcccttttcatttctatttttgaatattagtaacatcaactcatccacaaacataaggcagtgggtattaaactttttctcatattctttttctggtcctcattattagtatttggggaagagactgctagttttgcccaattttttcctctttgtatgtaattttagagctgtcagtggataggtttcttgtttgtttgtttgtttgttttttgagaccgagttttgctcttgtcaccagactggagtgcagtggcgtgatcttggctccctgcaacctccacctcccaggttcaagtgattctcctgcctcagcctcccaagtagctgggattacaggaacccaccaccacagcctgcaaattttttaatttttttttttagtagagacgggttttatcatgttggccaggctggtcttgacctcctgacctcaggtgatctgcctgccttggcctcccaaagtgctgggattacaggcgtgagccaccgtgcccggcctggatatggggtttttgcccaaatatgaccttctaagtgaaggagaataacagcatgccccatattatgcttattgactgggtcttccatgtgtttagcattcccactcccagcctcctaagtgtcctggtttgggcaataaattatatgggaaccctaaaatgtgtcctcctttgatcaccctatgtatgtatgtatgtgtgtacctatgtatgtatgtggcttggtcttgctgtgtcatctggtctggtctcaaactcctaggctcaagcaatcctcccaccttggcctcacaaagtctaggattacaggtgtgtgccaccacacccagcccgatcaaacaatttaaaatggactcatcctcctgccatcactgtacccccatccctgttctgtcttttctgtttgctcttaaccactatctaacatacctgacggtttatttatttacttctttggtttagctgctgtccctcagtgaaatgtacaccccatgagacaagggaatcctatctgtcctgctcattgctgcattcccagtgcctaagacgtagtagacttttttttttttttttttttttgagttggagtttcgttcttgttgcccaggctggagtgcaatggcgtgatctcggctcaccgcaacctctgcctcccgggttcaagcgattctcctgcctcagcctcccgagtagctgggattacaggcatgcaccactatgcccggctaattttgtgtttttagtagagataagacctccatattggtcaggctggtctcaaacttccaacctcatgtgatccactcgcctcggcctctcagagtgctggaattatagatgtgagccaccactcctggctggtagactcttactttaaacggataaatgaattaaatcttgtcttctgggagcaacagaggtttcagtcgttagaagcaaatgagagagtgatggagatttttgtggaaattaaaaaaacacttgttctacgaagaagggaacaacagacactgggatttacttgagggtggagggaggaaggagagaagcaaaaaaaaaaactcttgggtgctaggcttaatacctggatggtgaaataatctgtacaacaaaccctcgtgatacaagtttacctttataacaaaccttcatgtgtacccctgaacctaaaataaaagattaaaaaaaaaaacccaaaacttggttctttaagggttagtgatgctgatttttgtaaagtgttcacaaatctttgatttcagattcatctataattgtttaaactgcaaggaatttattgtaaattcaatggttttctgtattttttttaacagttttcagttagagaaaaatctaactttaaaacagttatccctgaatattttaattttgcatttgaacattatttgcatacatttttataatgtcattgattcgtagctcacataattttagagttggatttaggtgtatattaacttctttacctagaaaagtaaactaaaatacatttgtatttttattttatattatacctttcttaaaaattgtataaaatgagtcattttaagtgttttatagaagtttgacgttgaacccaatgattagtaaattttttctttgactaaaacagtaatgaaatctttggttcatttggtgatacctttggttgattttccacgttcttattctcatagattttggttatttctttgttattgattacagtgttcaactgaatttgttggcttgtggataggaagtctcagcagtttataagttgaattaatatattttccttttttaaatattggggcagtgttgaatctatggattgatttgggagaattgacttatgaacaatattgaacaatacagtaatgaacattgtatatccagttatttaagtcttgtttaatttttctaagcaatgtgtgatagatcttaatgtggtggtctgggtgttttttgatgatattgtaaataataatttttggcttttaagtttaattttctggctggactcagtggctcacacctgtaatcccagcactttgggaggctgagctgggcagattgcgtaaggccaggagttcgagaccagcctggccaacatggtgaaaccctgtctttactaaaaatacaaaaattagctgggtgtagtggcgtgtacttgtagacccagctactcaggaggctgaggcacaagaatcacttgaacctgggaggttgaggttgcaatgagcaaagattgcaccattgcactccagcctgggcaacagagtgagactctgtcaaaaaaaaaaaaaaaagtttaattttacaattcttggcctagtatatagaaatagattgtcctattagtttatcttttggccttattataaattcgcttattagttctggtgatctgagtatagaaaatcaaaataaatctgttaatgtgttactggcaaataaaaatagttttcttttctgacctttatatcttcatctatgtctttgccttgaccaggacctctattatagtgttgagaaatggtgagaggagacagatttccccttttttcccccttagggagaacatgttcagtgttaagtttgttaactctagttttgtctgttttgtttttgtggatatcctttttcttttttcttttttttgagacagagtcttgctctgtcgcccaggctggagtgcagtggcacgatctcggctcactgcaacctccgcctcccaggttcaagctattctcctgcctcagcctcccgagtaactgggactaccaagctcgtctaatttttgtatttttggtatagacaaagtttcaccatactggccaggctggtctcgaactcctgatgttgtgatccgcccgcctcggcctcccaaagtgttggggttacaggcatgagccactgtgcccagctgatatcctttttcaaattgaaaaaggttcctttcaattcttaggtttctgagaggttttttttcttttttttattattatgagagggtgttgatttttgtcgaatgctttttctgcatctattcagttgctcatatgagtttttctgttttaatttttataatgtgatgaattatagtgtttaaaatttgtatttatctttattttttgagaaatgaggtcttgctgttaatacgttgcccaggctgatctcaagctcctgggctcaagaagtcctgctgcctcagcctcctgagtacctgacaggcacgagccactgtactcaagtatgaatttttttttaatgttaaaacaacctgcattgctgagataaaccccactttatcatgacatattatcctgatttttttgtttttttgttttttttttcttttatagagacagagtgttactctgttgtccaggctagaatgcagtgtcataatcatagctcactgtatccttgaagtcctgggctcaagcagtcctcctgcctcagcctcctgagtagctgggactacaggtgcgtgccaccatacctggctaattttaaaattttggttatttctttgtagagccaaggtctcgttttgttgcctaggctgttcttgaacttcttgcctcagaagatcctcctgcctcaggctcccaaagtgcttgtattataggcatgagtcaccgcgcctggcctattctattttgatatagctaaatttgataatactttgtgcagattatttgtatctatgtttatgagggatatctgtttgtaatttttttccttgtaatcgttttatcaggttttcttatcaaggtactggtgttctaataaaataagttggaaaatgttccctttttacgtttatgtatatgattaattatgtaaagtttaagaaaaacattaatctatagtgatagcaatagtagccctttcggtggggtagtattaattagaaagggacatgaagataaaacattgatggaaatgttctgtgtcttggtctagggtggtagtcataaggatggagataaatgtacacacatatgtatgtatgtgtattttaaaagtcattgagctgttcactttaggatttgtgtattttataaattatactattaaaatcagactataaatgtgtctcccacttaacattgcatttctgaaaatcaagcatttttctattttgcaaagggaaaattatatacatcagcagaaaacattaaaccagtttcttaaaaaaacagtgaaaagactagatgtgaacaaaatctaaaatgtaagattgaaaagatttaaaacatggtttcctgattaccagacaatatggttaacagttgtatgtggaaaatgtgccggctcttcactaaatattacaatgtatgataaaacaatataccatgaaataaaattgccagaaaaaaaaggcagacaaaaacctacaataaaaaagaaagtgctgggtgctgtggctcacgcctgtaatcccagtgctttgggaggctgaggtgggtggattgcttgagctcaggagtttgagaccagcctgagcaatatggcaagactccggctttacaaaaaatacaaaaaaaaaaaaaaatttagctgggcatagtggtgcgacacttgtagttccagctacttggaagcctgaggtgggagaattgcttgagtcaaggaggttgaggctgcggtgagccgtgattaccccactgcactccagcctgggcgacagagcaagaccctgtgtcaaacaaacctataattatgaagtgggatttgaggcctttagaaagttggggaaggaggtaaagagcttgaagcagtctgtgtaattggtcagggaatggggcagatggttttggagagaatggggcaattcaggccaagaagttactgagatgtccagtcacttcatgtgactatagagctgggaagatttcatgatgttctttcagtgattgatgatttagagtaggaaaatgggaaattagagctttgtttacatccccattcgctgtattcttaatttctttgtttggggttataggaagcattagggtatctgtagaagaaagacttctatagcagtcactttcaagggttggagtcccttaatattctgatttttggcctccttttcaaactgtgattatgagaccctacagattaagtcctacaaattttacttggattgtaacttgagacttttccatacatacttttgtttaaaattatgtacgaagttttgaagatacaaatttatattggccaaaaactgttatattgagagatgtgtgtagtctttcatattaaaaaaaaaggcaagggaaaaatccagaaccttgttaaccagggagggagatgttctgtgggtgatgctagagtgttgtatttccttcaaggtctgttttgttacctcccccactcttttatttttctaagaaacaaaatactgttagaatatcatatatgttaatactgctttttgactgtgaaaatcttactgttttgtaaaattggcagaatcaatgagatggtaacagcccctgactattgtatattcttattttaacttttatgtaacttcataatggagttgtatactcatgatagattttcagtttagaaaaaaacccatattttttttaataggacaagctttaggagaaatttttaaaggaagatttgtgtctaatttggttattggattatgaatacatttcaaatataccagatgttaccatagtaaggttagttatcttttgtttccttttttgacaagcattcataaagatatgaggggtaacaggaaagatgttgattaggactaagtaatgatccatgggaaggtctcagtggatttctgtttaaagaatattcctactttgaactccccttttcttggccttagaaaattcagttcatccttctttaacaactgttattgtctgttgaatgctaactttgtttcatgtatcttggtaaacactttatatttattatttcaactcccactttacaggtatggaacctgtggtgacttaagagttgtataattgtgagagctaagcacagtccttgttattaaatgacaggtactgctcctcttgaagatcttgttcagatgtcaccatctataaagcttttcatgatatgtgctagttctgtaaaatttctaaccttctccagttgtaggctcaaatattagattgggcttgctttaaaattttattttggggatttaggtgaagttttagctgtcctgtaatctatagggtcttactcatggaaagtacgtaatggctcaaggtagagataatttagtcttgaaattctgagggatatacttaaccacttaaagtcttcaaagccataagagttgaaatgctgttgtaataaattattatccttactgtgggttgtctgcgtatagtttcacccctccccttcccttccccttccccttcccttccaacagagtctcgctgtgttgcccaggctggagtgcagtggcccaatctcgactcactgcaacctctgcctcctgcctcagcctcccaagtagctgggattacaggcacatgccaccaaacccagataatttttgtatttttagtagagacagggtttcaccatgttggccaggctggtctcaaactcctgacatcccagagtgctgggattacaggcgtgagccactgtgcccggcccagtttcatgtattttattatggaaaaattctggtaaaacatggtatattgaatgcattcttatactcaaaattgagaattaagtgaaatttggcatgttttctctctccttggcttctggaatcctggcaagagactgaagtgttcttttctgtggaaactggtcttagcaaagggctcgatttggacatcaggagaattggccccttctgaggggctgtcatatggtttggctgtgtccccccccaaatcttatcttgaattcccacaggcacagtggatttagcatcattcttaagggccttaggattttcagaatgggaaatgagtgttggcttcaacttaaaatcaccagctgcattagcccctaatgagagacagcctgtcctctgaagctttgaagctaagcattgacttcacctctagctgtcaaagtcctagatggcatcttctaataaaagactctttcttcttcattgtgtcatttagtgtagccacattaatcagtgatgttagctagatcttttggacaacttggtgcagcttctccaccagcacttgctgcttcatcttgtacttttatgctgtggagatggcttttttccttcaaccttatgaaccaacctctgctagcttcaggctttccttctgtagctaccttacctcaatttatagaactgaagatgagcttgctctggattagtctttggcttaagggaatgttgtgactggtttgatctatccagaccaccaaaaccttctcagtttcagcaataaggctgttctgctttcttatcatttgtgtgttcagtggagtagcatttgtatttccttcagtgacttttcctttggattcacaacttggctttttggcacaagaagcctagcttttggcttgtttcagcttttgacatgctttcttcactaggcttaatcatttctagcgtttgatttaaagtgagaggaatgggactgttcgtttcacttgaacgcttagaggcattgtagggttattaattggcctaatttcagtattattgtgtctctgaatagggaggccttaggagaggtgggagagatgaggcagcagcgggttggtggagcagttaggacacacacgtatcaactaagctcgctctcttaacgtgggtgccatttgtggcaccccaagacagttacaatagaaatatcaaatatcatgaatcagcatcacagaaataataataatgaaaaagttggaaataattgtgagcattaccaaaatgtagcacatttggtaaagtgggcatatgctgttgggaaaatgatgcccatagactcgctcgatgcagggttgccacaaaccctttgttttttgttgttgttgtttttgtttaaaaaaaaaggcagttggatgaattatcaatttctatgattgctggggaaggcaaattatacagggctagggaagaaggtacaagttgagtatccctgatctgaaaatctgaaattcgatatgctcccaaatactcagcttttttgagcgccgatatgatgttcaacggaaacttgttggagcattgcagatgttgtattttcttatttgggatgttcaaccagtgagtataatgcaaatattccaaaatctgaaaaagtatgaaatctgaaactcttctggtcctaaacatttaggttagggatactcactcatagtagagaagaaggcagaaaggactagagtggttattcaacagtttagtaggttgaaccagcacaagataaagcaagcatgtgttggaatgtctaatataaattttttcgctaggaccagttggaatatccgattgcgtcctcttcatttggtaaatcagattgagcatctgtcttcacagtactgaaaatagtggaaacagtgagatctgcttgttgtgtcttcactggtattcttagtataggcttcaatcttaataactgtgagtttcttaagacattgtgtcaggtaactcatttcattgatttacttgttattggtatgtaaatattgtacttatttttgaggtatacgtgatacctgtatacaatatgtgatgatcaaatcagggtaattaggatatcatctcaaacacttttctttcctttgtgttgggaacattacaattctcattttaaaatatgcaataaattattaactgtgattttcttgctgtactatcaaatactagaacttattccttctaactatatttttgtaccccttaacctacttctatttatgccctgtaccctttcccttcccagcctctggtaaccaccactctactctatacttccatgggattcactttttttagctcctaactgtgaatgagaacatgagatatgcgtgtttcagcgcctggcttatttcacttaaggtaatgacctctggttccattcatgttgctgcagctgacaagatttcattcttctgttgctgaataatattccattgtgtatatataccacattgtccatgtggattccatatcttggctgttgtgaatagggctgtaataagaatggggatgcagatatcacttcaatatactgatttcctttcttttgaatatgtattcagtattgggattgctggatcatatattctatttttgtttttttataatggctatactactttacattcctaccaacagagtgtggaagcattcctctttctctgcatccttgccagcacttgttattttttgtcttttttataataggtattacaactgaggtgagatggtatctcattgtggttttaatttgtattttcctgatgatagtagtgttgagcattttttccatatacctattggcctttttgtatgtcttctattgagaaatgtctttcagatcttgtgcccatttttaaaacaggattatttatccttttgaggtttttttttttagagacaggatctggcatgttgtgtcttcattctcattggtttcaaataacttacttatttctgccttcatttcttatttacccagtagtcattcaggaggagcaagttgttcagtttccatgtagttgtgcagttttgagttttcttaatcctgagttccaatttgattgcactgtggtctgagagactgttatgatttccattcttttgcatttgctgaggagtattttactttcaattatgttgtcaactttagaataagtgtgatgtgctgagaagaatgtatattctgttgatctggggtggagagttctgtagatgtctattaggtccgcttggtccagagctgagttcaagtcctgaatatccgtgtttatcttctgtcttgttgatctgtctaatattgacagtggggtgttaaagtctcccgctattattatgtggaagtctaagtctctttgtaggtctctaagaactttatgaatctgggtgctcctgtattgggtgcatatatatatttaagatagttagctcttcttgttgcattgatctctttaccattatataatgcccttctttgtcttttttgatctttgttggtttaaagtctgttttatcagagactaggattgcaacctctgctttttttttgctttccatgtgcttggtaaatattcctccatccctttattttgagcctgtgtgtgtctttgcacatgacatgggtctcccaaatacagcactccgatgagtcttgactctttatccagtttgccagtctgtgtcttttaattgggatatttagcacacttacatttaaagttaatctgggacacagctaaagcagtgtttagagggaaatttatagcactaaatgtccataagagaaagcaggaaagatctaaaatcgacaccctagcatgacaattaaaagaactagagaaggaagagcaaacacattcaaatgctagcagaagacaagaaataactaagattagagcagaactgaaggagatagagatacaaaaaaactttcaaaaatcaatgaatccaggagctggttttttgaaaagattaacaaaatagaccgctagccagacgaataaagaagaaaagagagaagaatcaaagagacacaataaaaaatgataaaggggatatcaccactgatcccacagaaatacaaactaccattagaaaatactagaaacacctctatgcaaataaactagaaaatctagaagaaatggatacattcctggacacatacaccctcccaagactaaatcaggaagaagtcaaatccctgaatagaccaataacaagttctgaaattgaggcagtaattaatagcctaccaaccaaaaaaaagcccaggaccagacagattcacagctgaattctaccagaggtacaaagaagagctggtacaattccttttgaaactattccaagcaatagaaaaagagggactcttccctaactcattttatgaggtcagcatcatcttgataccaaaatttggcagacacacaagaaaaaaagaaaatttcaggccgatatgcctgatgaacatcgatgcgaaaatcctcaataaaatgctggcaaacccaatccagcagcacatgaaaaagcatatccaccactatcaagtcggcttcatccctcggatgcaaggcttgttcaacaaacgcaaatcaataaacataatccatcacataaacagaaccaatgacaaaaaccatgattatcaatagatgcagaaaaggccttcaataaaattcaacaccccttcatgttaaaaactctcaataaagtacgtattgatggaacgtatctcaaaataataagagctatttatgacaaacccacagctaataccatactgaatgggcaaaagctggatgcattccctttgaaaactggcacaagacaaggatgccgtctctcaccactcctattcaacatagtattggaagttctggccagggcagtcaggctagagaaagaaagaaagaaaggatattcaaataggaagagaggaagtcaaaattgtctctgtttgtggatgacatgattgtatatttagaaaaccccatcatcttagcccaaaatctccttaagctgataagcaacttcagcaaaatctcagggttcaaaatcaatgtgcaaaaattacaagcattcctatacaccaataatagagagccaaatcatgagtgaactcccattcacaattgctataaagagaataaaatacctaggaatacatcttacaagggatgtgaaggacctcttcaaggagaactacaaaccactgctcatggaaataagagaggacacaaacaaatggaaaaacattccatgctcatgggtaggaagaatcaatattgtgaaaatggccatactgcccaaagtaatttatagattcgatgctgtccccatgaagctcccattgactttcttcacagaattagaaaaaactactttaaatttcatacggaaccaaaaaagagcccgcatagccaactcaatcctaagcaaaaagaacaaagctagaggcatcatgctacctgacttcaacctatcctacaaggctacagtatcccaaacagcatggcagtggtaccaaaacagatattatggtactggtaccaaaacagatagaccagtggaacagaacagaggcctcagaaataacgccatacatctacaaccatctgatctttgacaaacctgacaaaaacaagcaatgggggaaaggattccctatttaataaatggtgctgggaaaactggctagccatatgtagaaaactgaaactggaccccttccttacaccttatacaaaaattaactcaagatggattaaagacttaaacgtaagacctaaaaccataaaaaccctggaagaaaacctaggcaataccattcaggacataggcatgggcaaagacttcatgactaaaacaacagaagcaatggcaacaaaagccaaattgacaaatggcatctaattaaactaaagagcttctgcatggcaaaaaaaaaaaaaaaaaaaaaaaaaaaaaaaaaaacaactctcatcagagtgaacaggcaacctacagaatgggagaaaatttttgtaatctgtctatctgactaagggctaatatccagaatcttcaaagaacttaaatttacaagaaaaaaacaaccccaccaaaaagtgggcgaaggatatgaacagacacttctcaagaagacatttatgtggccaataaacatatgaaaaaaagctcatcatcactggtcattagagacatgcaaagcaaaaccacagtgaaataccatctcacaccagttagaatggcaatcattaaaaattcaggaaacaacagaagctggagaggatgtggagaaataggaacgcttttacactgttggtgggagtgtaaattagttcaaccattgtggaagacagtgtggcaattcctcaaggatctagaaccagaaataccatttgacccagcaatcccattattgggtatatacccaaaggattataaatcattctataaagacacatgcacatgtatgtttattgcaacactgttcacagtagcaaagacttggaaccaacccagatgtccatcagtgatagactggataaagaaaatatggtggctgggcacggtggctcacgcctgtaatcccagtacttttggaggccgaggcgtgtggatcgcctgatgtcaggagtttgagaccagccctggccaacatggcaaaaccccatctttactaaaaatacaaaaattagctgggcgtggtggcgtgcgcctgtaatcccagctacccaggaggctgaggcaggagaatcactggaacccgggggtcagaggctgcagtgagccaagattgtgccgctgcactccagactgggtgacagagcaagactccatctccaaaaaaaaaaaaaatgtggcacatatacaccatggaatactctgtagccataaaaaaggatgagttgatgtcctttgcagggacgtggatgaagctggaaaccatcattcttggcaaactaacacaggaacagaaaaccaaacactgcatgttctcactcataagtgggagttgaacaatgacaacacatggacacagggaggggaacatcacacaccggggcctgtcgcaggattgttgggggtaggggagggatagcgttatgagaaatattcctaatgtagatgacgggttgatgggtgcagcaaaccaccatggcatgtgtatacctacataacaaacctgcacgttctgcacatatatcccagaacttaaaagtatttaaaaaaaaaaaaaaaaagacaggatcttgctttcttgcccaagctggagttcattgagcatgattttagctcattgtacctccaactccttctattgagttttctaagctctttatagattctggttattaatccgttgtcagatgggtaggtgcaaatactttctcccattctttgtgttgtctttttactttgttaattgtgtcttttgctctgcagaggctttttatcttgatgtaatcccatttgtcttatttttgctttagttgcctgtatttttgaggtcttaagttgaaaaatccttgtcgagatcagtgtccagaagtgtttccccagtattttcttacagtaattccatagtttcaggtcttagagttgagtctttaattccatgtggatttgctattttgtgtatggtgagagagagagagagagatgtaatttcattctcctgcatacagttatccagttttctcggcaccaggtattaaaggaactatcatttccccactgcatgatcttggaggttggaggctttgtcaaaaatgaattggttgtaaatgtatggatttatatttgagatctccattctgtttcattgccctgtgtgtttttatgcctgtaccatgctgatttggttactatagcttattgtaatttttgaagtcaggtagtgtaatgtctccagctttgttctttttgctcaggattgctttggctattcagggtcttttgtggttccatataaattttaggattttttttttcctatttctgcgaagaatgtcattggtattttgatagggattccattgaatctgtaaattgctttgggtattgttgtcattttaacaatattaatttttccaatcctttaacatgaaatatttttcaacttgtgtatgtgtgtcctcttcaatttcttccttttttttttctctttttgagacagtctcactttgtcacccaggctggaatgcagtggcacgatctcggctcactgcatcccccacctcccgggttcaagctgttctgatggctcagcttctcgagtagctgggattacaggcatgtgataccatgcctggcaaatttttgtaattttagtagagatggggtttcgccatgttggtgaggctggtcatgaactcctggcctctagtgatacgcctgccttgacctcccaaagtgctgggattacaggcatgagccaccacacccagcccctcttcaatttctttcaccaatgttttatagttttccttatgttgatcatttacttctttggttaaattgactcctaggtatttgatattttttgtagctgttgtaaatgtgattgctttcttgatttattttatacattgttcgttgttggtgtatataaatgctacttcttttcatatgttggtttttgcatcctgctactttactgaatttatcagttcttaaagctttttggtgaagtctttgggttataagatcatgtcatctgtcaacgaaactaatttgacatcttccttgtcgattcgggtgccttttatttctcttgtctaattgctctggccaggactttcagtactatgttgaataaaagtggtgagagtgggcatccttgtattgtttcagatcgcagaggaaaggccttcacattttccctcagctcgatgttagtttgtggatttgtcatatatggccttttattattttgagatatattccttctgtaccctattttttgggaatttttatcatgaagagatgttgaattttatcaaatgctttttcttcatctattgagatgagaccatatggttttttcttctttgttctgttaatgtgatatatcacatttattgatttgcatatgttgaactctccttgcatctctgggatgaatcctacttaatcatggtaattgatcttttgaatgtgttgtttaattcagtttgctagtattttgttgaggatatttgtgtttacgttcctcagtgatattggcctgtagttttctttttttgttgcattgttgtctggttttgttgtaaaggtaatactgcccttgtaaaatgattttggaaatattctcccctcttcaatatttttgagtagaagagtttgcagtagaattggtattacttcttaaaatgttttttgtaaaattcatcaattggcttattgaggttttcttgtttcttcatgattcaatcttgataggttgtatgtgtnnnnnnnnnnnnnnnnnnnntagtaatcagtatagtggctgagttcccaagaaaaccgagggaatcttggtcaactctttttggtttatttttcttttggtaattgccttttatttcctagcctagaaagtcccttagccagagtcagaagcccacccagattcaaggagagggaatacagattccacttattaacagaaagtgtatcaaagttacattggaaaaagggcatattaaacattaagtaatttcatgttagctgctttgtctagtaaaatcaggaaatttaggttagactttttatgggaaaataaactcaagcgttatagaaaataccaaaatgatggagaagataacttttataccagtttagtttaaggagtcactttaactagaaatattacccagattcttaaagctcttcaagttaggtcataatttcttttgatttagctgtctcaatttgcattcctttgcttattctctcatgttctaacagtgagctactcttctttcaacaccctccctcaccactctccctcccctttacagcttcagcaaatgtctcaagttttattaaagggtcagtgtactttaagcataatgaggtagttatcttggtgggatcttaacatgtacagtaattataaatgagggaattctggagtaaagagtagggtgtttattatgttcgttgcatttttttcccttttttgtatgtgctgcattatgtagcatttacatcaggttgtgggttgaaccttggagcttaactccagaggttagtaacacttttttcttcacatctggacttggaactgccctatttcttcaagaggagaagaaacagttaggcactgagaacccttgatatgtttcctatgttaattaaagggagacctaaagttgtagacagctgagcagcaattattgacattccatcttctctcccattccagtccacatttgctctcttgcctacagtgatttaaactgggcagcctggctgagccaggactcagtaaagtgtagtcagcagactaatgttggtgcagatgaatgttggtgctggaactgtttaacagcctaggacaagataaggaaatttggtgtaagcatctagacaccttacagcaatttgatagtaattttatgtcgattgattctaatgatggaaattttgtgcttggcttaggtatgtctttttttaaaaaaacttcttttttctagaaattccttttcattgtattttacaaaagtattggtctgtgataggttggaaatttaaactggttcttcatcacagatgatttgaaaagtactggcctaagccacgtaaaaacagtttttggttttaaaatcttttcatttctgccttgataatttattgaaaaagatattatgtagtgcgcaaaagtggcagatctctgtgaataattaatcttgaaaagtttttaaaaatgtaattggccgcagaaacagaagggctacaataacaaagccctgttaaaagattacctttccatggtgagggggtaaaagacttttttcatttagagacacacaaagaattggcagccccagctgttcaactttagccatggatcagaaacaaatacagaaccacacaaacaacacagggaagtctgttaattggtagaaacagaatagtcattgtagcagaaagcaactcttgggacttgtcattctatagttgaggccattctttgaactgaccaaaccgtgatgagtgcccaaagaggtgacccagatgccaggatctcagaaccctcaagaccaacaaaaacatgaagacacgtgaatgccaccaacagggtacttgggaggttaacagcatcagacacagaccttcccggagagagctgaagaaggcctgatggcaaatatattgcatatttgagaatttatagcacagatcagattttgacaagcagataaaacattaaagtgtaaaacaaaataacattccttttttttttcttttggtaagttctgaaaggataggagcaaaatcacattctataatggaaaactgcttcattctggtaacattgtaacaaaagtttatcttttaaaaaatgttttggcctattttttgaagacctatttatgaaggcctgtttatggagaatctcaccattgatttttgggccacataggtatatttggattgtgtggtatttttggtttagcttctcccccgacatactccgtatttattccaagtagtgctttttcattgctagcatatcttttcttctgatgacttgtgaggtgtaatcttttcttccaggaagcagttgatactatgaatttagttgtctttatcttctaatttgggcttcaaaagagttagctaaaatgatcagaagtatagttgttgttttactatccagcagtcttgttacatttatttatttattccagcagtttatttgtagattcttttagattttcttcataatctatgcataattatagttttacttacatagtttatgaataatgatagttttgtttgttctttcccaatgtttatgttttaccccccccccccgtttttttggggggaagggggggcgtctatggtacttggcagtgacttccagaacaatgctgtacgcaagtggtaatggtgggcatccatgtcttatttccagtttggggaggggaagtttttttcccactagtatttacatttcatgtagatactctttgtcagatatatgaaatctcatcctatttctagtttgctgcgagtttttatcatgaatggttggtaaattttatcatatgtgttttctgcatgtatcgaggtagctggctcttctttctgaaaatgtggtgaattacactgattgctttttgaatgaatacctttcttctattcctagaataaacttttggtcatgatacattattcctttaaaatattgctggattatacttgttaagatttttgcatctgtgtttataagaaaggtagacttttatcgtttctcatcctgttctgtcaggttttgatatcactgttctgcaggtgtcataaaacaagttgggaaatgatctgtatctgttttctggaagaatttgtgtaagattaatatttcttaatttgttgaaagaaataaaatgttcctttgtggggagaattttagatggactattttaaatagaacagtctagtttcattttacattgtttcattttgctgtgttgtgttttgcaaggaattgtgcttatctaaattttcaaattcattggcatagttattaataatcccttattgtattactcattatctcttacctcttattatattctcttcttcatttttgatgttgctagtttttcttgactcattttatctttgattagtcttagagaggtgtatcaattttgttttttaaaagagtaacttttaattttgttctgcttttaagttgtccttttaaatatgcattcttttttaattaaatttttattggtacatagtaggtatatatatatttatggggtacatgagacgttttgatataggcatacagtgcataataatcacatcaggctaaatggggtatccatcacctcaaacatttatctttttttggtgttacaaacattctaattatactcttagttctttttaaatgtacatttttattgaccataatgcctagttgtgctaccaaatactagctcttacgcattctatttttctgtgcattaaccatccccccttcacagatgtgtattcttagagatactcaaccttcgcttctaatacatgaatttaaatacgtaattttttttttttttttaaaggagacaggtttgtgctctgttgctcaggctggagtgcagtggtgcagtcataacttgctgcagccttgagctctggggcttaagcagtcctcctgcctcagcctcccaaggagctgggactacaggcacacaccaccatgcccagctgatttttttaaattattttgtaggggtctcacaagcccaggcaggtcttgaactcctggcctcaagctgtcctcccatctcagcctccaaaagtgctgggattacaggcgtgattcactgtgccctgccaaatgtatagattttactctaagtatagctctgtctacattcacagttttgatatttcttttcactgtaccatttaattcaaaatactttgagtttctttttgacttaaagggttagttgaaatacattgcttaatttcctgacaatggaacattttctagttattttgtaattgttgtctagcctaatgctagacacagaatatactctgaataattttagtcccttgatatttattgaatctttctctttcactcagtgtatgggcaacttcagaaaatatttcttgtgtgcttgcaaagattatgtattatcctattaggtatagtgtcagtttctatgtcaattagatcagatttgttaatcgtgctcttcagatcttctatagcgtaccaaaagttataagggtgtattcatgtatactcagaagtgccaccccacaccacatcctccattcctgtactttccatcttggtcacacctctcccatgtgtaaccagtctcaatggactcccatttctactttgtggggttattttgcacatatgagcagatacatttatattttcctattttcccccttttattcaaaaggtatactgtggccgtgatttgcactttgggtttttaacttaataaatcctggaattcatacttagtcaattatagggctcttcttctttccttttgtttttcccccagcagattcatagtactccattataggaatgtaccatagtttactctattagtctcccatgaatgggcatttaggtgtttcctaatactttgtaaggctgcagtgaataaccttatgcatatgtattttcatgttgttgttaagtatatctcttcacttgggacgattgtaacaaaatacataaactgggtggcttataaacaacagaaacttatttctcactggtctagaggctggaagtcctagatcagagtgacagcatggtggagttctggtgagggccctttttttccagttttcagactgtggacttagatcctcaggcatatctctggagagcagagagaggaagcatgctcttggactttcacaagggcactaatcccattcatgagggcctcaccattatgaccttatctagttcagattccctccaaaagaccctaccttgtaatagcatcacattggggggagtatggtatcaacttatgaattttgggagcacacagacatttagttggtaacagtatatctttggcataaattcctagaagtggaattgctggatcagaagacacatgtagttttgttattgtcaaattcccctttatacatactatagaaaattcacattcccatcagcagtgtatgagagttctgtttccccacatccttaccaaaagacagggtactgctatgacctttttaaaaaaattatttgacagttgtttatatatttatattttcacagaggtaaaattcccataacataaaattcaccattttaacaacttcaaagtgtgcaattgagtgttttttagtatattcaaccatcaccatgatctaaattcagaccatttctctcatccccaaaagaaactccttatctattagcagtccttcccaactctgccctacccccagccactggcagccagtaatctactttcttctgtatagatttgcatattccttcatataagtggaatcacaatttgtggtctttcacgtctggtttccttgtagtataatgttctcaaggttcctccatgttgcggcatgtatcagtgcttcgtttctttttatgctgaacaatatttcattgttgggcataccacattttgttaatctgtttatccattgatggatgtggatatttgggttattatcacttttcggtattgtggataatgctgctgtgaccattcacatgtgagggtgtttcattttgttttatgtcagggtctctttctgtcgcccaagctggagtacaatggcatgatcacagctactgcagcctcgacctcctggactcaagcaatcctcggcctcccaagtagctgggagtacaggcacatgccaccatgcccagttaatttttatagagatggggtttcgccatgttgcccaggctggtcttgaactcctgacctcaagcagtcctcctgcctcagtctcccaaagtgctgggattacaggcatgagccactatgcccagccatgagtttttatttggacatacattttcagttcttttgggcatatgtctacctagaaatggaatggttggttcatgtggtaactccatgtttaaccttttgaggaactgccaaactattttcatagtagttgcaccattttatactcttccagcaatgtaggaaggtttcagtttcttcacatccttgcctacacttggtatatctttttaattaattgtctggattgtctcttgcattcttttctatcatttcccccctcattttaaaagaatttctgtatatatatagggtattagctttttactgtgatacatggtacatatgtttttcttttgtgtttttggcatcttttgacttggtttataatttttttccttttactgtgctgttataccatttttttttttaactaattggagaatgatttggatgaaaaaggtattatttatgctttgtttgataccaacagagggttggctcttttctttgctggacagatagtggggagttgacagggtctggctctgtcgccctggctggaaagcagtggcacgatctcggctcactgtagccttcccctcttgggctcaagtgatcctcccccctcagcctcccaagtagctgggaccacaagcatgcgccacgactcctggctctttattgtaatttttttgtagagatgggttttgccaagttggctaggctggtcttgaacctttgggctcaagcaatctgcctgcctcagcctcccaaagtgttgggattataggcatgagcatctatgcctggctggatctgtggttttgtgtgtgtgtgtgtttgttcgtttgtttgttttgagacagtctcactctgtggtccaggctgaagtgcagcaatgcagtcacagctcactatagcctcaacctcctgggctcaagctatcctcccaccttagcctcctgagtagctgggactacaggaacacgctaccacgcccaagctaatttttgtattttttagtagagacaaggtcttgtcatgttgcccagactggtctcaaactcctggactcaagcagtcttcccgcctcagccttccaaagtgctgggattacaggcatgagcagccatacctggcctgccacgatggatctgagcaggaattgtactccaggtttacaaagctccctttgcttctgcacccagctgttctcactgcaagcctggggatgtcctaacactattctggtttattcctgaagtcttattcctgtttcctaaaccctttcactgttttgagaggctccttctcagcttgggttcaggattccgtaactgtcttcaggagacaacctgcagagtgtttgacacagtctccacccttccttctcaccagaatccaagatttgatcccttgctgccgaaagctctgctggtttctctcccattcgtagccttttcttgtctcttcaggctctgaagggctcagaattggcaaatgccctgtgggaaaaagcagccagctgttaagtatcatttcctgtcttcatctgtgtcactcattgtcttggttgcctcagaatatctttgtctctgagcccttcaaacattgtttgagttaaaaagatttttaatctggattttcatgtttctcgatgggtgtttaggcttgtgcaggctatttcttcaaactcaaatagaagtcctttatcgcacttaaaaattttaattgtgcatgcttttttcgttttgttttcagttgctgtctgtctgattctcctgttaacaatgaattggttaagccagggaccttattttaattatagtgtttttaatcaccaatgcctagtatatataatgaatactcattgaatttgtattatatgaagaaagaacttttctcttaggtaaaagttttcaaaagcagggagcaaattaacaaatttggctttgctatgagattttccaacaaatttaaaggctatgattaaaaaaggggtgggggtgggggtattacattgtttgtagatactttttgacacagctgaaattggagtcctggccttttaataatttttttttaacaaatatttattctgtaaatcaggtcctactctgggtatggggagagacagctattattttagtggattaggtctctattctcctcagactccttccgcatataacatatcaagagagagtataggacatttgatataaacaacatatcacattgtaattggtagatttcaagtattatacacaaaaaattattttgttcttttaacagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagggtaagtacgtttttccatgagacatctttaatgtttatttaggttaaaatgtaatggcatgtatgaaaaaagatagtgtaataatttttatttaacttatcggggacttttcatattacagaaatgctatttttaattataagatttattagttaatatgtgactgaccagcgttctaattgttgtaaagtttcttagaaaaataatgactgaatcatattttagtcataaaataccattgacttatttttcccttctaggttttttttttttttaactcttggatgagtactaggcaacaatgcaactaaaatagcctctaacagtcatgaaataaactacttttctagaaagtgtaatttggaaggtatttgcatgacttcagataggataatttcctttaaaactcttgaacatatgctgtgtgtcaggcactgtgctaggttctgaagatgtaaaaggtccctgtgaagtccttgatcttacagcttagagcctgtagagggagagacatcatgaatgtgattatagtacagtgtagaagtgcttcacgggaggttgttgtggaagcttggaggaataataccttttaaacgtagaagttagtactggaaaggatttcctttgggtctgggaaggtgaggaaagatagtgatacagaattgtgggagaagagcatgctaggcaaaggtaactacatctttctgaaggtggggaatgaaaaggtagcactgtgatttcagaaagctgagttcagtatttaaatgttcagtatttgctttgatgaagtgttaaatacctcctctttcttaccctctccacctagtctatattcatctttaaggagaagtttccagtgacaaggaagtttagatacgtcttttttcttttcttttctttcttttttttttttacaataagtaaattaattaatttgctactctctaacttacatgcccttattatttttaaccaaagcaaagggattggtagaatttagatttaaggccaacaggtcgggcatggtggtccatgcctgtaatcccagcactttgggaggccaaggtgggcaggtcacttgaggtcaggagtttgagagcagcctggccaacatggcgaaaccccatctctacaaaaaatacaaaattagccaggtgtggtgtcacatgcctatagtcccagctactcaggaggctgagacaggagaaacacttgaacccaggaggcagaggttgcagtgagctgagatcgtgccactgcactctagcctgggcaacaaagtgagactgtctcaaaagaaaaaaaagaaaaaaaagatttaaggctaaagtcttgtatataaattttacataattttttgttacctctaaattttaatattagcaaactattcaaatggattaattattaaaaatatgatagcctctttttttttacaaactctttatgaagctggttagcttttttgcgttttctgttttttttctacttctgtgttttacttttaactttataaaacactgtcatttggtagaaaggcctgcaatgagcatcctgccataaggtttatcagataattcatactggaaaaaaaccttgtagatgtaacttcatgtaaggcttttagtgtatgttctagtctttgtagatttcagatacagtgaatgaggaaactctccaataaaaccattgtatcagccctaatgaactctagggcattcatacaggagggaaacctttcaaagattatgaatttgacaagacatttagcaaaaatgttcaagacttacatcagaagactcacctaggaaagattttaacagatgtgccatggttttagtatcaaactttctgcatgtaaggggattactaccatagagtcagtgtcactgcaggcatgttagcctttagccaatgttaaaaacttcctagtcatacattcatattgtgaagaaaaatttacatcagatacaaatgtataagttatcagaactcatttagcaaacttgtgaagatcaatctgatcaaatctatgtggccacaaacaacgtgttttatttcacagtaattggcaaattatcagtcagtgattttcagattgaggcagaaaaatcacagttggcgttgaattcaccatagccctttcctgggatagcatgaggttctcatgatactgagtcactgtaatggaagattggatattattcataaccaacttccattgaatgctttaatgctataacatttgaaaatgcaatatcataattgtaaattaatgagtggatttgtacatctgaacaaagggactgaacaacataagaggtatcagacaaaggaacattatggatacagagtattgtcaggaaagagaaaaatggaagaaacatgacagcatttgaaggcctgatgaccttagaacaggaagtggggattgtaggatttagatttaaggattagattagtaaagaatccaagtataattacttgtcagaaagaaactgaccattgaatagcatcaaaggggatgccacacaactattttctgaaatgatacggcttattgttattcaggtactgaataactcgattcagtcttaaactcattatagctacgttgcccattatcgtagccatgtgcagttgttgagcacttgaatgtggctagtctgaattgacatgtgctatagtataaaaatatataccacatttcaaagagtaagaaaacagaataaaatatatcaatgtgttatgattacatgttaaatgataatacttttgatatagtaggttaactgaactatattactgaaattgaatttacctgtttgtttttattttatttttttactgtgactactagaaattttaaaattacttatgtggcttgcattatatttctgctggacagtggtgttctgtagaaagcaaattctcagaaagactgcttggttcagaaaaaacaaaactttttgaggagtttaaagatttgttttcaccaagaatatctggatttttgtaacatttcattatagagcctttatcatgcttcagttaataagtattagtgcttttacaattatgtgtgctaattgtatgttaattaatgtttgattgttgaaaagatttgcaagatttcacagtttataggcaaaatccattacagcaacagtagtaaaatgatactcattgaagtgatctggagatcttgggtacaggcttcttggccttggacatgatttttctgtagatgtgaaaccattactggcttatgtgtgaagcacctcagtatgaggaagtggtggggatctgtgagagggtcacacaagcactctccatctacgtagccagcctcaacctgtggacctccccaggtactgccaaaatcaggtacaccttgtcagtccagttattattacaaaatcgcactgacaagctggtatattctgccccccaaacagctcagggtcccatgatcacaaacatcacttatcttggccatagctttggccaagtgtcagtaccgtgcttcaggcagctctagagataagtgtggggtcaatctagaacagccaagagaaacccaggctgtacaatgttgaataagaccagtcatctagaaacatggcagtgataattcagaaaaataatgacataaaattccaaattctaccagagaaattccctacttaggagaaagaatgacgtttacaccagacttttcatcagcaatgctggatgcaagaagacattggaacagtatcttcaaagggctcagggaaaataacatgtactttagaagtctatatcagataaattattaatcaagataatgtgaaatgaaggtatctgcagagaagtagtgacatagaaagctaatagcatgggctctctttgaaaaaacaattagatgatataatgcagcgtggaaaaaagttgagcccataagaaaatactgtagcaggatgcaagagacagtggtccattgtcatacttgctgccttgtatgctgtcttgtacctctcttaatgtccccgtagtctcttgaatctaccaccatgatttaatccaaccttctgcctattctccacctgtcgccatcctgtgattggttacattctagatttgcaaccttagtgctacccagctgtcatgctctatccccccatcttgttctctcctagacaaccatttcatacctcgtccactttcttcaacctgcagtacttggaaaagtccacacatttctatatcttccctttccccagcatttgtacctcacttctctgtctttacacttcttgctacaaaataaccatccagtgctccagtcaaagggttacctcatcttttagttactcagatccatttgcaatcgtcttttattccttttttgctctcaagccatatcgaatacattagctaatcctgtccacattatcttcaaaaatatatccagaacctacccatttcatattgcctccactgctacccctttctttgagctcttcttcagtagctgccttaaaatgtctcttccatacattatggcatggtatcctaactgacatcttgtttccctacttgctctccttagtctgttgacaacccagcagccagaatgatcctggagagatgaaagccagagcacttcactcctccactcagaacccggtttcatttagtcaacatgcacgtcctttgagagtctcacccatctcccccatcctgtcccatcatgccctgtcacctctgtcctagtcactcactttttctttctgcttcctgtttctctaacatactaatcaccgaatcagtgatttgcttaaatccccccaagagctccccatttctcccagactaaaagccagattccttttgtggcctacaaggacctacgggatgtggctccttgcttgttctcaccctgcccttactaactctgcctcccagggcatgccagtctaagaatgctcccttatgcctcaccattgctgtttttctgtcactattttattttcttcagatcattattattgacatcgtcttgtacttgatttgtttgctcatttattagctgttttcttccccaacttcttaagttctgtgacatcagggatctttgtacttcatggtattattgccaacgtctttaacagtgtctagcaggcaaacagccaagtgctcagtaggtataggtacttttgttgaatgactatatggcatccaaggtgaaatggaatatttctgagagaaatatgttaggaacattgaccacagaagtagaaagccttaattgacaaataaccacaaagatattgatttgatagccaaagattatacctattcaaagccataccccactttactgatatctctgtacctagcttattttttaaaaagacattacaaggactagaacaaataatttcatgcccatacaccaggcaagtactgggcaaatactgtatgatgctgcttaagattacaccaccattgagtacttggacagtattcttatcccattcaaaaccccttaaaatttttctgactggtacattgaacttttctaaataaatagcatatcctcaggtttcagtactagtcatgagtcagtagggaatggttggtaaatctgaatctgtaatagtaaatggaaaaaaatcagttcatgtagtttgttaaaatataggtgtgttgggttggattaatactaattactgttaccaagctggtagtgggaagactggtaatgggaagtaacgttgtgttcaatttaaaatcatccttctgataggaatgggaaaatgtacagtgatttgggattctgcaagaacaaactatgctataaacaactggtatctgtaggggaagggaattcttcagggagttttccctgagttcggccataggtaggtgcctggaggacttttcagagcagtccaacggtcttcagtgtttattgttaggtgtcatcactggacactttgtgtgtgttagaagtgtaagctgttctctctgacagaggagcaggtgaatgtatgtttaaaaacatttaaaaacaattgattattaataacaatcaattgaacattgattgttacggattcaaatagttttgattctagaaaggactatggaggtcttagaaaattaaactcttcctttacaggatggaaagtatcatctaggaagaaagctagaaaggaaagctttaagaaaaagcataaaagccatgttaaagaggagaacctaagctaacagagcacgaggaagaaaaaattttgaattcaaaatcctgagagatagtgattgaggtagtgatttcccataggtagaatgttggctcctaaagatgcctacatcctaatccccagaacctgtgcagatgtccccttacgtggccagagggacttgtaggcgtgatgaaggctacagaccttaaggtggggagatcatgagtccttcactgcagcaggccttttcttaaccgtggtcagtgggaggtgaatatgaaagaaggatcagatgcaacgttgagggaagaagacgaccatgagccaaggagtgcagtgccctgtagaagctggaaaagacaagctaagagcctccagaaaacagcacatccctgctgacgtctttattttaggccagtgagacccatttcatacttgtgatctacaaaactaaaagataatgcacttgttgtgttttaagctcccaagtttgtggtgatttattacagaggtaatagggaactaatacagtgactgtggaccaccaagataaaaaagtacattctttgtcttggaagacttttagaaggactcctagtttatgactggaccaagaggaggaaacgtactaggtgttggagaacaggatttgaatttctggatctttctttttgataacccaatgatgaaagcctccaagaagaatggtaggaatcccttggttttctaaagctgaagagtatctgaaagagaaacacaatgagaaaaagaaacactatactatagaagaatcagtaatgatgattatatttggtaattcttaggaagcagtaaggagataaacagtgtcaacaatgtgtgttgcttcagatatctcttctagtaataaatctgaaaattaagtgtgagactatagctaaaaatataaaatatccctttttgtcccctcctccccacaaaccacttaatactcatttgcacatgttcattgtcatgtctttctcctgtgagactctttaagacttctgagggtcagaattgcatcttaaccgttattgtgtcactagcatcatgcatgtagtaggcacttcagatgttcatgaataaatgaatgaacagtttatgaaagaatgaacatggaggaaagagtcacatgacctatttcgaacagtggtgaaggtcatttgtttgaaagtactgtctaaaaggtaagtggctaaatggaaccaagcaaaataataaaaactttcagaaatgaacaaaagtatagcctcatctcactagtgagtaatcagggaaattaaaccatcataacaacagtaaaatacctgtggaagtttttttggtcattaaattgatcatcataagattaattttattcattaatgtgagataaatgatactctgtaacattatgcatcaagtataattggtatagttttgttgatggccaggaagtttggttgtgcttatcaaaatgtttcagttaaaggaaattttgtctgtttctatgcagtggtcataaatacctttgatgacagctagaaggatgttcatagcagtatttttatttacaccttcctttctccctcagaacaaggaaatctttattcatcagtagtaaaatgaccttgcacatttaatgttatgttcctgataagatacaggcatgatgtgaacactggcttttattttaaccttgaaaagaattcttttaccatgaatgtctactatgagaatttaatcagaaaagttgtgtatttctgacacttgggttatgagagacaggtttcagagtagccaattattgttttgtatttcataggaccagatagatgtgtcttcaaagtcacgatgagaaatttaaatttaattctggtacctttagtggcatattaaaaacccatgtcctattatccttttagagacagtcatttttattctaaatgtatgtgtgtgtgatatgaaaatggggcacttccatatggcagcactgtagggttggttgagtttacattcctcactaaatacgtagttctcagaattatttgttgagttatccagaccagatatttagttctcaaaattacttaagttactgagtatatgcatttagcaccacatatttaagcactttgtatatttataatgtttgccactatccagagaaatttataagggtgctagagaatgagcagtaggacagagtacgatatggatgcgtaatgagaaagcaaaaaatgaaacagaaggtaatatctgtgtgtttattgcttttcactgtttcatggagagtgaaagttgaaagctggtttgctcatgaggtactactgtatgcaaaggctgtgtcactcagatccacactttgaagtcactctgagtctcttcaggcagcatgatcaagtgaatggaataagattctctctcttacgtgaaactccaagacagaaacctgcctttccctaacagataccacagttctgggctaagcctctttgagactggtttgctgcaggtctcctatatgtgtgctgtgagttcagcagagatgaagtgactttttcatggggtcactacagaaggcaaccggagaagctgggctttttcttaggatgtgaatggtgacaattatgagaaatgatttgtgttccttactgccttatattcaacatcaggttatggaaggttagtagaccaagtgacctgaggcagatggctagagaccactgtagacactgatcgcagctctaacaagagagagccgcctcttgaattggtagtagcagtgagctgtggagcaaggagacttactgacctgtggtttaccaaggataactggtgttggtgcgtactgggtgttgatctggcagagctggacagggaaccaggagcttttgtgggaatttcacagaggtgctagcttccatcctttatagttcatggatttgtgtgttggcaagaagctgcagaagtcacttctgagagaattgttaaaaggtgctccttcctttaggcaagttccccaccccagagcacaaggtttaaagactagaacgtggactcttttcaccctcagctggatatccttgtgtaggtagggtactgtcatttacagtggccctgtcaggaattctgggcttggatcaaaaagccaggaaggacattttatgcctctgtcagttccacataggagtctgtaggctgcaaacatccttcctgtcctgatgagaattcatcatctttatgaacctgtctttgactcttccagcctggtcctctgttgatgctttctctcttgataccatgtttactcctttcctttgtccctctctctgccacttcctgtgcttggtaaacaactttgtacctgggattgagttgtctgaaagagagattgactctaccacttcattcactcagtgccctgggaggtctgccacatgccaggtaccagtatggggagcacagcacagcagcacacatcctcagtgtgcatatactgggttttggacagtttttgtatatggtacatgttacgatttatctttgcttatggagaaggctggggataatatcctttatcatgatcagcagcattgtgctgtaataaagcaatacttgatgagtgcaggaacttttttgtatgtcttaacaagttgtattatagcttcaattaattgctaattttaaaaagcagtgattattttctttcatagacatttttcattttaatatcagcatcatttaaaaaaaaacttgtcttatcacctaaaagattgagaaggtcacagttggttgtaatttgcataccctcgtgtaaaggacagcaaatggttctgtcatgttcccaaatgagtcttccatacatgctgcccacttaacaacatattctctcctggccctcatacctaggtaggtacagggcaagagtcagttctaacacttaacctgtccattgctccaggagaaatttcaccatctctagggaacattccctgatgacctcattcaaaggtgaccttctctgaactcaagggaacacatgttagaggcattagatttgggagtatttaagattgcttcataataatttttaaagagcaagtaataataaactgattaggcccgaattcaaagaacttttcatgtatttccagtgtcaccagaaacgtagccttaactgtgtgttcctgaatgtatgtttttttaaaaaaatgattatgaatgttgcagcctggtcttgaacagtatgatctccctgtttttgaaagtataacccctccttgggtctggaccttagaaagtagtaactgaaagatagctggtgtgctttgacaggttggggggtgatgacagtggaattgcagaaatgtgtttttaagtttacatgccttgttaataaagaaaggagagaatctctttatgttttcttttctaaaacttctccttgttcttgaaaatactatttcagaaacaaagattcctaagtaatttatttaacttgatattctcataccaaagatttctgataattgactaaaagaaatgaacattgcattactttttagcatatagttttttttttgttttgtttttgttttgttttggttttttttttttttttttttttttttcagtttataacagtcattcttgtggggggtatgttttagggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaacatgcacaagataacaaatgtatatgtttaattttcacactgcttgtcattacaactctggtataaataaaattcgttagtaattattaacgaatgatctcttctagacctctagtctagcttttgggtattattaattatactttgagccatctgatttccgttttctgtgatggtcttttgctagctaatttctcatcagtgctactttgtttcaacctttgctcccaataaaactcaaatcatatatatatgtgtgtgtgtatgtatatatatataatgttttcatcccttgtcatccttttatgtagcaggagttgctgtcactcctaaataccttattaatgggctacatagcttgttttattatgccctgtaatctagagcgcacctacaaagagtgagtgtatatttgatattcacatgcaacgttaaaattaggacgtaatctcttaatgactcctgttgaaatgttaaggaaaataaaattatttcagggcaaattaaaagaattccctataattgttctttttctggtctcccctactaattttttttttttttttttactactaagcaactcaagatgttactaggaaattgtacatctaaaatacatttgtgagaggtataacttgtaaaaatgggcttctttcactagggttctaatttttataggcaatgctacagaaataaagataattgtaggctgaagagtgcattcaaagggtcagtaactttgaaggatctagattgattagggtagacattttaaaagacaaacatgttaaggtgaataattttttttttttcttttttgagacagagtctcgccctgtcacccaggctgcagtacggtggcatgaacatggctcactgcagcctcttgggctcaagcgattctcccacttcagcttcttgagtagctgggactgtaggcacagaccgccacgcccagctaatttttgtattgtttacagagatggggtttcagcatgttgcccagacagatctcaaactcctgggctcaaacagtctgcccaccttggcctcccaaagtgttgggattacaggtgtgagccaccatgcccagcctgaataaatcttatgttgaataaaaccctacgccagttacagagttcatcaaagaaatatagctgtattttcaaatttgtcaggtagctggtaccaagctaacaaaatactccttgagaatatagtttcattggttcacatcaatggctagagaagatttgacttccaactatttagtcaattaagcaagtgagcattccaaaacaaaggatatgtaaaagttagataaaaatacctgcagggtttttgttttgttttgttttttgagatggtcatcttgctgtgttgcttgggctggtcttgaactcccctactcaggtgatcctcctgtgtcaaggtacttttatttaacacaagtctattatcttggtttatatggacatgtcagatgcagactttgttataatgaaatccttagtgctcaataaaatggtcattgaatctaaatctcttagtagattgttgttgttcttttaagccaatttatttactttgtttcaagtaaaattgaataggcactgctttactgactgggtcttgaatcctcaaaaggaagaaaaatttaggtggggttatatagaatttctcacagattgaccctactagatgaaagggtgatcgggatactactgctcataataatactaatgatgatgatgatgatgacattgatgccttgtcgtcataagtggctgagccagggactctgccatctgtatgctgcttacaccagataacttaaatatacatttcatttaactgtccccaaaccctaggagttagagactatcgttcttattttacacatgaaaacaaaattgataaacttgtagttacatagtttgtgacacagctttgattcgaacttagctgtctggcttcatagtacaggttttaaaaattagattgcctatctcaatatgggaataatgttgtcttaaatactctgaaaatgtagctaggcttttaagattagtgaaagttggctaggtgtggtggcccacatctgcaatcccagcactttgagaggctgaggcaggcaaatcacttgagttcaggagttcgagaccaggctggccaacatgagtgaaaccctgtctctactaaaaatacaaaaattagccaggcgtggtggcgggtgcctgtaatcccagctacattggaggctgaggcaggagaattgcttgaacctgggaggcggaggttgcagtgagccgagatcatgccattgcactgcagcctgggtgacagagtaagactctgtctcaaaaaaaaaaaaaaaaaaaaaaaggattagtgaaagttacatgcatagtaggtagagatgatgacagaagaaaatgtgacagataaactgatgaggtattttcaagagttatgagggttaatactgatggttctgtatatttaaaaggggaggaatttaagtgtcagtaaggaaaaggagactatcaaaaataaccaagagaatttggatagtccaaatagaagttgtagaaatcacaggattgataaaatagcagattagacatagctgaaaaattagtaaacaagagaaaaaattttccagaacataccacggagagatgaaaagatggaaaatgtgaatgcaagtctatgtaacatgaagaatgatgtcaacccatttctaacagaaactcaagaagaatagaataaaaaagaatggagaagaggaggagataatcccaagagataatggttgagaatattttataatcaatgaatgacatgagccttcaaatacaggattaacataaaatcccaaatagagtcaataaaactaaactgatgcattggcagattgtattaatagtaaaatattgttgtaccagagaacaagacaggatgacacccagagaaaaattcagacttttcaacaacaataatagatgccaagaaaatagtgggataatatgttcaaagtagtgaggaaagtagctggcaacctgtttttgtttgcccagttaaattgccattcaagaacagggtgagataaagacattttccttagaggatttgccaccaaaggaacctcttacaaaaacaccttaggaaaaacgaaaatcatctctgaaggggagggtctcggatgcaagatggaaaaaattgggtagatctaaatatgcattggccccatgaaacaagatagtaactgatttttaatttgaagaacgcacacataaaacataagcagaaagggaacaaagtatatcagacaaatagtaaccaaggggaaaaggattataccctgttaatatcgtatgaaaaaaattttaaacatcttttaaagcatcattagggatatagaaggcaattacaatacaagctattatcaccaagaatttaataaatattccttacttagctttctggataccaaactgctttggttttccttcattgaccattcatagcctttctgaactgtttggcctttaaatgttagggtgctccagtaacctgttttcttctctttctagtctccctacacctgccttgggcattaaatcatacatttgattggatggaggcagggaaactgagaaacaaattagtggaataacccaggcaaaaatcctaaaagatggtgcagtaggggaataataatagaagttgtgagaaacagttgtacaggattgtatttttaaggagggagctgatgggatttgctgatgtatctcttagaatgtaagccatccaattatatttataaatcatttgggctcagaaacttccagtagcttctcatcacactcagagcaaactctggagtttctgatgacctcacagtccttatctccttctgctcttcctcttcctcctccactctggtgacatcagtccttttgatttcagttttccttccattaaattctttaatatattttagagttctttccataaatactcaagttgggatctgatgtgatggtttcttctctattgccagactttttaattgttgaataatatggcccttcatcttaattaacgctttctttgtctcacctcccttttttcctttatcgtttacaacttttcactttctcaactctagctccctggctttcttattggggcctttgaacttggtgtgactctgctgagtatgttctgccttttctaggcatggcttggacctcctcattccaggaatgtgcttgaatgttactgctttcctgtggtctcctactggctacctaaagagcccactgcctacctgaagctccttgtgatttttcatcagctcatatactctgttaattttttacagacctctgaagactgatattatatatgtgttgtttatctttctcagggactttgttttcttcactcctctattcctggttctagtcatgcctggtatacaataggcacccaataagcaatatttgaatgaaaactgactaaataatatattgataatgcatgtgtaaaagaagcccagaagcaaagtaatttgatggtttagaaacttgttttcagctaggaaccaaacaatattagcttaagttaataacagtattaccatattaacacatgttgtttactgtgtgtcagacatttgatgtagttcatcaaaattaatttctattatgatagtcttatcatgtaggtactctctttttgccattttgcttgtgagaaagccatactttggaaaggcttaataacttttcctggagatcatatggcttaaatgggtggtatactagaaattgaatccaaacactcagctgtttcttctctactcctgtattagatatgtaaatacaagaagctgaacatgacaaatttttttctgtcacctgcagacatctaagttcataggtgggtatgtgagggcagctgcagttctggctttaattctgagaagtaagatctctagtcaaatgaaagtgctaggactcagcaatataattgggtataaattttgatttccatgacgtttttggacatagcttgttcttttgtgctatctgctatagagtctattcatactgttgaataaacctgaaatacagacttgttcacttggtcttcactcttcaaacagcttggtaagctagcttgcagcacacgtatttggtcataactgtctcaggcaggatgaccttagagagctctttgtcatgacatgtcactgggagaaaggaagagctggattgataaatggctatccatgtaggaagaagagcaacaacaacattggatactacctcaatacacaaatctatgagatgtacaagtagtgaaacatcacatgcaaaactgtaaaaaaataagtttagtgggaagtatagttgaatgtatctctggccctgggataggaagattttcttaagagctccaaaacgttcactataaaaagaaaggctggcaaattctactgtactaagattaggacattccgcaaaagatatattttgaaagtacaagaacaagttgcaaagtgggagaagatatttgtaacacatgcagtcaacaaagggtggtggtaagagttctgatcaatataaaaattgctgactgggcactgtggctcatgcctgtaatcccagcacttttggaggccaaggtgggcgaatcacctgaggtcaagagttcgagaccagcctgactaacgtggtgaaacccccgtctctactaaaaatacaaaaattaccaggcgtcatggcggacgtctgtaatcccagctactggggaagctgaagcaggagaatcgcttgaacctgggaggtagaggttgcagtgagccgagatcgtgccactccactccagcctaggcgacagagcgagactccgtctcaaaaacagaaaaaaaagaaaattgcagacacttcagtaatagatacacaagagatatgaagatgttatcataaaagagaaaataagtttggccaattaacatagaaggcactgtcaacttcattattgatcagggaaatgcaaatcgataccttagtgaaactctacctccagttggcaaaaagtcagctgtctgacactctctgtagctggagaggctgtggacctgacagtcttttacctgcactgctagggagaatgttttaataaattggtgaaaccacctgggaaaccagcttggcattctcttgaatgtcaagtgattacatgccctaccatcctgcagttccccttcaagttctctctttcagagactctagctctagtttctatactaggctataactgcaataatgttcatggcataaacagtgacaagtcacttggggattattcacacagtagaatgtcacacaagttgaaatgaatgaactacaggtacaagtaacaatatgaatgaaacttagctgtataacatcatgtgacaaagtaagtcctagcacaactttgtgagtacgctaaatactactgaatttcacaccttaaaatggttaatattttatgttaattttacctcaattaaaaaagtcctggaatatgacatacagcatgacactttttataaagtaaaaagtgaaaaaacctaacgagattgttgggaacacatgttaagaccatatggaacatgtaaataagggaatggtaaattccttcagaagtcactggaaggcccagagccgtggcaggggtagccaccagctcttcccaatccccacaggctccaggggaacttctgttgaccattagggtctgaggctgagtttgaaaatcactcctgaagtgtgcatgtgcaccccagcctgtccccagcgcttccccagtcagtccaggggcaggtgggagcttacctgtttctaggatgctgggagagcccagttaagtaggtagtatttgttaggagcttgagtcaggcaaaaatgtttaatcaattttgtatttattcacttatggtcaacatattgattgtataatgtaggctataaagtatacataaaagtagaaaatttaaaagcatgcagcgggccaggcgtggtggctcacacctgtaatcccagcactttgggaggctgaggcaggtggatcacttgagactgtgagttcaagaccagcctggccaacatggtgaaaccccgtcgctaccaaaagtacaaaaattagccaggcatggtggtgcacacgtgtaatcccagctacttgaggggctgaggctggagaatcgcttgaacctgggaggtggaggttgcagtgagctgagatagtgtcactgagtagctgggactacatccttatgccacaacacctggctaattttttgtattttagtagagacagggtttcaccatgttggccaggatggtcttgatctcctgacctcatgatctgcccaccttggcctcccaaagtgctgggattataggtgtgagccactgtgcctggcctagtatggtttatttttttaaagaaaatcttggttaaatagttgttttgagacaaggtcttgccttgttaaacaggctggagtgcagtggtatgatcatagctcgctgtagccttaaactcctgggttcaagtagtcctcctttcttagcctcccagttacctaggactagaggtgtttgccatcacactcaactaatttttaaaataatttgtttgtacagacaaggtctcattgtgtactgggatcataggcgcatgccatcacggttggctgattttattttattttagtagagacaaggtcttgatatgttacccaggctgatctcaagctcctgggctgaagcagtcctcctgcctttgtctcctaaagtactgagattacaggcatgagccaccatgccccacttctgattcaaaggtcttatttcaggttttattttgttattgcttttaatggttgtcatagctaaaagtattcttgacaaagatatgcataattaaatagaaggggtaccagtatctttgtgtgcttaatcatgatactgatttttcattgccagtcaccaattatgtaaacatttgttgaaatttggtcaataaatttccatattccatgatcattcctttcagtataattgattttgaaatatattttcatattttaacatcagatttttttatttagtggagaaattttgaaatgttagaaaattttgttttcagattttttatgagcagtgcatccactcctttttggtgacaaagttataaattgatggaaatagtttagacttcaaaatggtctgtccataacatgacagcatgcttttctttgttgtttttaattttaatcaggattaacattttggccaaataattacttgttgtagggagctttgtatatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactgctctaaaatataaccaaaagttgttaaaaatctccaaaaattattcttaatttcataaactatcccattagtattcaaattttaacttgtttattaaatatcatgacaaaatttttaaagataaattatttgaattaggatccaaattaggtgtgccctttgtcttttaagtctttgtaatctataacatctttatatccagtttctcccctttgcttgcagtttgttaaggaagctgtgttgcttgtcctacaggtttcccctcatctggattttgtccgtgacatctgtgtccattgtctttgatgccttctgatgtcttctctgcaaagcctttgtgtcatctttactaagttaattcttactctataatatattgctattatgtgggttatattttattatttctgtttaccacttatttctaaattgagcacttagctcacttgttttcattcattcatgtttactgataaatgtattttactataaatggtcattttagttgtgtctatgtctcacaactttgttagatagtgttttattatcaatcagtgttttgatatttgtttcaagatttttggaagaaaccaaggggtgattaagtgtattgtttaggtttctgccatatgtgcttataaaagaaaagattattggttattgattttattttgttgcattataggaagcataacaattttatggtgttgactttttttaactatgttgagatgattctttgtgccttagtacttagttgatgttttcattccttttgaaaagaaggtatgttctgttattataaagagggcgggtgtgtttgtgtacattttttcaagcttatcgtcatgttatttgaagattatattgttcatactttgcttgaaaagtgacatttaatgtatttaattgtatatattatacacatatatatgttttgctacatgctcatctcaaagaaagtattcaactgtaattgtcgatttactttttttttttagtaattctgtcttgtgattctttatgattttaaggctatgttgttaagtacatataagttcatgattataatatcttcatctattctttctgttaccagtacctagtgcccctctttctttgtttatgtgtttcctatcagcaacatatttattgtctttgtgtatgaattgatgaattgtagcccattaaattagaggtgtgcccattcccaatttcattctctattctttgcttccggaggtaactgatatcctgacttttgtcataatcatttttttgcttaaaaaaaaaaggttttactacttatgtattgtccaagtctgacatcgtgatcattcattatctgaatcagaaaaaagtggctttatgatgctgttaagggaaagctgtgctgatcagtcacagtctccctgagcagaacacactactgattctatacaaggtttttggaagtatgaagttgagaagctggccaactttcagaggtggaaatgggttggcatcaattttagatgtatggttacccaagttagactgttcatctttagaagcatgttctttagagttagttcctgtttggctaaattaaagaagaagctgccagtcagttagttgacttgcagatgcgtgttcattgaggcaagatatcaggcgctttaaaattagtttcaagtgggtctgtggctgtacaactcatatttattgaccaagctgatttaaaactggttttgtgtgtgtatgggttgggggggcgggggcgggtgtttgtcaccacagctacaaaagggtcagtcttgtatatgtgggaatttaaaaattctcaatataatatcaaaagttgcaaaatagtacacagaaatcctgtgtacccttcagccagtttccctaaatattaaaatcttaaataatatagctagtaaaaccaggagattaacattgatacagtcctagtaacaaatctatatgacttattcacatttcccaattattccacttaccgttccttttctggttgaggatcaattcagaataccacattacggtcatgtctccttaagtcttctctaatctgagacagttccttaatctgtgtcattatgacctttacatttttgaagaatactcactggttatttgtattgtgttcttcaatttgagtttggtattgtttttatgattaaggttttgcgtttttggcaaaacggctgcagtcaagatgtcatacctttctcattgcattgtatcaggaagtccataatgatggcacaacttaatttacaggtggttctaacttggatcatttggttaaggtaatggaagccaggtttctccactacaaggttactgtttcccctttataattaagaaatatcttctgggaagatacatagatactgcaacattctgtttctcactttcacccactgatcttagcattcattgatgattctgtcttgcagtgattattactgtaatttttgctaaatgataaatttctatttccattcttcccttttttaaaaaaattggaagtctattgtaagaacagactgttcgcaccacattttttttatgagggcatctgtgttgtgtgaagttaatgctttgtttacttcactaaacacggactagctagctaacccttctcagtatcaggactatcatattcttaatctagctcagcttttcaaaaacataccctctccctccttatcctcagttggttacttttgggtgtcttagtgctcatatttggtggtaagactgaggaagctggatgacaatggcatgaataggaatatattgcctaagagtaggaacgaaagaatgattttatttggggcatagtatttagctgctgttgggaatccatggagaggcgtatagcagggaagtggaaatatgtatcaggatgcaactagactcttaaaatggcaaacagacatgtaaagaaactgacgagtttcgtgtaagagcagagtggggatgtcagctctagtggggcacgagaacatggtgtcaggcattgcagtttaaggactgaggaaagtttcagtagagttttgtgtgaaatatgctagactgtagtgtgttgaagcagggaacaaagttctttttaactttcgttttaggttcaagggtacatgggcagatttgttacataggtaaactacgtgtcacaggggtttggtttacagattatttcatcaaccaggtatttttctgatcctctccctcctcccatccaccactcttgttagtccccagtgtcttaattcctgctttatgtggatgtgttctcattgtttagctcccaccaaaattcttaacatgatctaaaggccttgtctaacttcacataagcaggcttgagttaagttcttttctgtttttaagacataggtgccttttcttcgtatcattgtgcctttaaatattcatgcatgttcttgctggagaggaatcccatgcctacctctaaatagctgtgggatctagggaagattatgtaattccctaaaattctcttgccaatctgtgaacataaggtgaatattaacctggctattatttctcacccagaatcttgctgtctcctcctagtctccctccttcttcctttggtccccattgtctcttctgcatggtgtataccctaatcatgaaaaatgaaaaccctgtgatgtcatttctctgtgcacagcatgccattgacttgctttctcattgagaaagaacccgactatcatgacttggtaagggtctgtgtgaagcttcatttctactcactgccctcatgcagcctgccccagctacacttgccttcccaagcatcctccagctgcagggccttttcatagtctgttccacctgactagaacactttttctctgcatataactgtataactcccttcctcatctcctttatttagatctttgctcagatatcatcatatcagagtgtccatcattgactaccctttataaaaataatacttaatcatttgttattcccctttgatttgtttttatgacattgactgccatctcacatatatttgtgtatttgctgtctgacttctgccacaaaaatgcaaactttttgggagttagcactttgcctgttattcactgttgaatttccaaccactccaactgtacctgagacatgatctgtgctggaataaacagttatcgagttatcactaacaataaaccttagaaaccatttattatgatatgccagtgactgttctgggtgttttgtgtttactgactcatttatttcttgtaacatccttataaggaaattgaggcacagagaagtgatagctgacagtgaataagtggcatggcccaaattcaggcataggtgatctttatctagagcccatgttccttatgcttctctaaaaagaaatcatctgtgtaaaatgctcgtcacaattcctgtcatacactaaatggacagaaaatgttagttgatgatcaccagcagcatcagaatgctggatgttaagagaatggatgtggagccaggctgcccattgtttcatgttgaacctttttccttatctttaatatgggagcttcccccaaccaaaaaaataaataaataaaatgggagtcccattaataccaaaagcctccttggacctgtttgaatcgttgactggaactgataactttttgctgagcatttttttttagtctgcagaatgcgaataattatacctttctcctctgattattaaattgattaagagaaatagtgcccaggccagatgtggtggctcacacgcctgtaatctcagcacttcgggaggccaaggcaggcggatttgttgaactgactcaggagttcgagaccagactgggcaacatggcaaaaccccagccctactaaaaatacaaaagttagccagccatggtggcaggtgtctgtagccccagctacttgagaggctgaggtgggaggatcgcttgagcccggggaggcggaggttgcagtgagccgagattgtgccactgcactgcagcctgggcaacaaagccagaccctgtctcaaaaaaagagagagaaatagttcacataaagtagttacgtgcctggtaaatcctaagttgaaaataaatgaaatctgttatacttacataataacccaatgtagaatatctacagtaagttattgaactctgtctgagagtaaaagtgaaatgaaaccgaattgtttggcaattttgtattttaataagatggacatttataagtcttagcagaacttgcgtatgtgtaccaaactttgcttcctcaaaagattgcattgaaattttattgagtggttaaaaaaaaataccattaagccacagaatggaagaggatattcactatgtctaacaaaggcctcaaatctagaatatataaagaacacctacaaatcaataggtggtgaaggagaaaagctagaccatttagtcggaaaacaaggacaaaaacttgaacatggccaggggtggaggctcacgcctataatcccagcactttgggaggccaaggtggaaggatcccttgagaccaggagttcaagaccagcctgggcagcatagtgagaccctctctctacaaaaaataaaaaactcaacaagcacttcacaaaagaggatagtcaaaatgaccaaaaagcatgtgaaagtattcactttcattacttaccaaagaaatgccaattaaaatcaccatgcactatcacagtatgccaatcagagtgagtaaaacaaaaaagttagaaaatgccaagtggaggccaagatatagaggaactggaacacccccatgctgttggtgggagtttgacttgttacaacctctttggcatgctgtttgataatatctactaaagctaatggatgtatttgttatccagtgctcctaggtatatatgcaaccgaaatgtgtacatacgtttaccagaagacatttataaaagtgttcatatgggtagagccacacatacacataaagagagaatgagaaagataaagagcattctggtgatgttggtttgttttatccattcttaaagcttagctttctgaacaagtaagagtacatactgtgcagttccactgataaaaatttagacgtgggaagtcgtggaagatgttagaagtcagggcagttcttcccctgagcagtggtggagaatgacccatgggttggaaggacttctgggcctcttactatgctctgtttccttgaatcactgagctgtagcacatttatgatatgtgctctttttttgtgctaaaatgtttaaaaattacatttaaagattaattgatgatagcttttatttgaaatcatctttcagagtaattaggaatgctatactcacaatattataattgtagactgtaaattgagaaaatgactgatttctaattgttctgttttgtgaattatttttagatatgaattgagaattcgttatttgccaaaaggatttctaaaccagtttactgaagataagccaactttgaatttcttctatcaacaggtattagagactgctttcatatacttttttgtttgtttctttgaatcctatttattgcatatttttattttcaaatttgattaaagctcacgtttggaggaatagaaatttgttgctgaatggcaataagaatcttttaaccaataagaaattattaatttttttgttctttgtgagcttttgtatacttgagcaaatcttaaaagataacttctattatatggagacagtaggtctacaatcatttcttgagctttaatttaaatacaattattatgcctgaatagcaatgaatttgtcataggtagagattgttgcagagccaactatacccatataaaattgatctgctttgctttttaccccgtaaggcattagatagacaataaatacatgtaaggtaaaatgccaaaaatgctaataaacatcagaaagacatttgtacatataattttgtcattaaatgtacttggtaattttttttgctttaataaaaatatttattaactaactattctggaccgggaatgcagaaataaatcgcataatccacacctttaaattcttctgtctagtggaggattcctgtcatcagttgctttgtgtttgagcctttgctgttagtaagcacaaatgacgtgactgtgcatagaagagtctgctgacccagtatagatttggtattgagatggctccactgaaaagcatcatttgaggagtctccaactttgtagaaaaggaagagttgtgttttctagacaagaacacggaggggagagagaaaatgtggtgcagtcttagctaaaatagttcataacattttggtgagagagggaccacaaacattatgtaaacaggggtttaggttttctcctgcagatattgggagccatttaaaaacgttagttagcaaatgccgtaaccagaatttttttttttgagaccactctgattagatggcagtatcagggatagattgaatttttaaaaggttgcaagcatgtttagaggctcttcaatcattctggcaagaaattaaataaaagtgaaagtatattataataagcaaatttagtggatggatttgataggacccagagattgaactaaaacagaatatgaaaataaggaagaaaaaggcttattatgtaagtctaggcacttactgccatgaaagagcaatggtggattagattcaaaagaaggaggtaagaaggtaagttgttctatatttttctatgtgagataatgatagatgttaccatttaaaagattcaagctgagagagtaggaagctaaggaagtttccagctgttggcgggggtgtgtctgttttcatcttgtctgtgaagaagtagtcacataggagataggttggggcctgctgctttacctaacacctttttggcaccagcgactggttttgaggaggacagtttttctacagaccagggccacagggtgtggcagggtggggtgtgggggaatgatttcgggatgaaactgtttgacctcagatcatcaggccttaggttctcataaggaatgcgcaacctagatccctcacacgtgcacctcacaacagggtttgcgctcctatgaaaatcttatgccactgcttatctgacaggaggcagagctcaggcggtaatgctcgcttgcccacagctcacctcctgctgtgtggcctggttcctaataggctactaactggtactgatccatggcccagggtttggggaaccttgaggtaagggattggtgacaagttttgagggtttacgataatacagagttgaatatgaaagggagttaagttggtaaaatggaaagattaagaaggcgtttttagattccagctgagcttattggaagcctactcattgcaaaaataattttcatcttacagactggttctcatgtattattacatctcatcctttaggaatctgttgaacttcatattttggcgaaggagataacaagagagtttaaataactcatgtttatttagcatttttctcttggtatgtgatctgtgtcactactcgtattacttctttgaaaaaaaattctacccaccgaggaaatacatgggtactttagtaacattgatttccagaatgcataatacaggcttaagtgactcctttttataatttctaggctaacctaaaagtctgcaacttttttgttcctagttcacactgttactaggttgtcctactttttctttgttggaagactttcctatatgataaagtgagtactgcacataccaatgtatcccagattttcttttactaataggatatattttatggtagtctatagaattcagttcagcggtctttataaaacccaagagaaagctaaatgtaatgaacctattaaaaattcagtctatccctgatactgccatccagtcagagtggtctaaaaaaaattctgatcaaggcattcactaagtatagttaagtgttaatgaaatttcgcttaaaggaatatgcagtgaatacagtcgtgtgcttgttctgtatataatagctctgtgattttaggtacctctgagtctctttgtgcttaattgtttcatatactaaaatatagatatggaataactattgtataggactgttaagttcattatatgagataaaattgtctgccatataattgcccagtgatattttgaatttcagtctgtagacagtaacagacttagaggattcagcatttgccatttgcatatcaccatacaagtgtgagctgcacattatgggatggtacatagcttgccttttccttcctatgtgcactctgtagagcctttcagctcctccaccccactctttgctgtcattcatttctacagtttctcttcttgtctttttaatttttaaaaatctgttaaattatatggtacattttaatatttttaaaaattttattttatttttatagagacagggtcttgctctgttgcccagtctggagtgtagtggcatgattatacctcactgcagccttgaacttctgggctcaagcaatcgccctgcctcagcctcctgagtagttgggactacaggtgcgtgccatgatgcctcgctaatttttaaaaagtcttttgtagagatgggggtcttgctatgttacccacccaagctggtctcaaattcctgtcctgaagcagtccttccgccctggcctcccaaagtgctgggagtataggcatgagccaccatgcttggcatggcacacttttagaaagttcaaaaaataattctaaaacattacttaaattatctctattctaataatcactttcattttgtgtatccttttgtaatagtttatcaagtacatacattttaaaagaaagtatagtcatggtcacattcctttcccattggtgattggcaatgtcgttgtttttccgtgctagtatttcaggctcaagtaatggtaattggaggaagttaaaggtggtaccaaagtcataaaaagggaagggaggaagaaagaaaatactatgattgtctgggtgcggtggctaacgcctgtgatcccagcactttgggaggccgaggcgggtggatcacctgaggtcaggagttcgagaccagccttggccaacatggcaaaactccgtctctactaaaaataaaaagattagcagagcatggtggtacacacctgtatcccagctactgaggagctggggcaggagaatagcttgaatccaggaggcaaaggttgcagtgagccaagatcatgccactgcactccagcctgggcgacagagcaaggccctgtctcaacaaaaacaaaatactatgatttgtcaaaatgcatgaattggccagtataccaaaagccttgagtatgttcacgtcctccagtttgttgggtgaccctgttgactgccatctttaccgtaagtaaaaaacagttgaaacgttggcagttccctatgattggacctaataattctacttttatgaatttattcaaaagaaataagatttacacatgtatgcatacatgtacaagggtgcttataagcatattacagtaacaagaaagaaattagaggcgttgcagatgtctttcaacaggttagttgtactgagtttcaaatttatgtatccctcattaacagggaggtacaactgttcatggatgtggaaggtattaacagcattaaatgctgttgtttaaaacaggccatgtataaaacctgtataattttcgtttatgtgggaaaaaaatgcatatttttaaattttagcctgatctggcaagaaagttttgaatatactatgagtttttattgctggtttggtaagtaattatatatttgacttctcctggtaaagtctcaatgcagaatctgccctgctacatgcttcgcaattccagaactgttataagtgatccatatattgtcctgcacaggcagcacccaacttgggaaagggtttaattccaaagttgcaaaatcagtttggaatccagaggtttctgctatttaaacacacatgtcgggggtgggcgggagggggggcacagataaatcagtaattgtcctcatcagctttctatagccagcgtatatttatctgagaatgcagctgaaacgttacgtaagtattgtgtgtgagaaccttcactgaagtgtgagataaattagtcactttataatggcctcagaatttgatgatacgcattctctaacctttaaagtctttaatatttgatgcaaacatttaagatggatacatatatacataacatacttccactgaattctaggctaaatcagtgatttttatggggctcagaatttgatgacattgataatttttaattctgtagattctataatatctgatatatatttattcttttataaggtgtgataattgatgataaaatgaatacccatgaccctactgctcagatgaaaagaacatcctgatacttccctgtcccatgttcctgtggcccacctcactgtacacactgccctttcactccactcagtgtaccattatcctgaattttgtatttatcattcccatgcttgcttttgtttgccagttgtcatgctttacaacatgtttttattcttcagttctacccttaaggtaaaagctgaccttaagttctcccatagacttctctattcctgtcattagcttgagtattttctgttttgttttgtttcccagctcacgtaagcattcaagaagattttaaaaaaataatttgttcagcggttttagttgctttcagctaggtggttggtcaggacattcagtataccttgttggtataaatggaaaagtgatcatccgtggatttaataatttatctcttttggctcattttgaaaataattttgcattgtagtcaagagactgtggctcatttgatactaattgtttaagttccgtatggacttgtttcatcaccttgcacatatttagatattgttaaggttccagttttgcttgagtggaatgtgtcttctgtaattgtttggcacaggctcaataaatagccattatttcaagatttttaattgtgttatttagatccatttttctaatgttctttttttctcctgcttgaaaaatagtattgctgggtacacaaatcagggtaggcattttctgtcagtattttgatggttatttcctactgtctttaattgtttatttgctgttgagaactcagctctcattttttctttctgtgtaggtgacctgtcttttctgtctggatggcttgaagatccttttttctctttggtttttacagcttcattacaaacgagtcgtggattttctttttttctttctttctttctttttttttttctgcccttgcttgatctgtgtcatgctacatgtacctctagggggtcatgtcgttttcatcatttctggaaatctcttagttgttgtctattctgatatgaccttttcttagttttttgttatttcttctgggattttgggttagatctatgttagaactcctcagtctctccatatgtgttagcttgtttttcatgtttttaatttcttgtctttctaaaggatacataattcaggtcagtctagtctggcagattaccagctctcctcaaccgtgaccagttttatgtttggtgcatttgttgatttttttgcttatgatttaaaaaaagttttttaaattgccaggccactttgtatggcccttattatttgctaatctatctgccttttattaatatttcttttaccatttcatatgtaatgaatgtctctattctgaatgtgaattatagcatctgaagtccttgggctcttcacgtttgttgttggtggctttcacagtgacttttttccttgtgtgtgagttctgaactcttgttttgttgaacttcacatgtggaaatcttgagggcctacctagtttggggattctttcctctaaaggtttgtatttgtttgcttggaaacaagttactaccaaatggagaccctttgagtagattttgaagacaccgccttactacatgaatctcaagataagctctctcacttggcggaagtaaggagaagtggtcagtcctcagccagctgagagcatacatgtcctctgttcctgtatcttacagcccatggcttctactaggatcttagcttgtatttgttcttatttcgtccctctgccccattttcctttaccttcttgtgaccccagtaatgtaagaataattgttataatgcatccagaatctggtcctggtttatatagcaggtccctttagcaatactgttggaatcctaagtcattgaattgttatgatgcttaattgcctttccacacttggatttgttacaaaggccccttgtagaagggagcttggagattcgaggagctgataaaaagccagtgtgactggagggcagggtgagagatgagacagtaagggatggcttgagatgcccttttcagtcatctgaccttgattgtgaagacactgagaagccagagaaagttaagtgcaaagggatgacagagttcagatccaggttgcaaaaaatgtcattctcactgttctgctaatagtatataagaaggtaaaggccactatgtggagacttaaactggcgtcaacaagcttcatggctgagtgtgatcactctgatcaatggcttaactttaactgtggggaaattatttctctgtgcctcaaaattttattttttctacgacattgtattatgaaacttcagatgtactgcagtgttgaaagaattttataatgaacaccagcatacccaccacttagattctaccattaacgtttgttatgcttcctttatcacataactgtttttatctctccatccctttagccattaatccatcttaaattttcatacatttcaaagtaagtttcaagtgtcagcacacttccaacataagtatcgttaacctagaattcagtattcaattatggtttttgttttgatttatacacagttaaatatataaatattaagtatacatttattgagttttcacagatacatacaccagaataatctgaatgcctctggaatgtagaatatgaccatcaccccaggaagtttcccactgacccttcccagtcaatccttgcccccagtcattgccccaagcaaccattgctcctgtgtttttcccaccgtagtttagttttgcatgttttagaatttcttataaacagattatgtagtgcgtatttttatgtgaagtttcttttctcatgtttttgagatttcagtagttttcttgttgagtagtattctgttatataaatatatcgtagtgtatttatccatttttctgttgatgaacatctggactgttttgttttgttttgttttgttttgttttgttttttactattattgagatgactgggaacattctttggcaagcatttttgtgaacatgggctgggactttcatgttaaatgaaatttgtatctaccctttgatcctttacagttgtgtgattttatatttcctccagtaatgtatgagagttctggttgctctgcattctatccaacatttgatgttgtcattgttttgttttagccttttgactaggtgggtatgtggttgaatcgtggtggtttttatgttcacttctctgggtaccaactaataatcattgtttatgttgttctattcttcccatgtgcatattgaatgttagtaggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgctctgttgtccacgctggagatgtggtggcgtgatcttggctcactgcaacctccgcctcctgggttcaggcgattctcctgcctcagcctcctgagtagctgggactacagtcgcccgccaccatacctggctaattttttgtatttttagtagagatggggtttcaccatgttggccaggatggtctcaatctcctgacctcgtgatccacccgcctcggcctcccaaagtgctgggattactgacgtgagccaccacacgtggcgacccccccctttttttttaagtctagaaaatgggcagaggggattgttgtgagtcttcagtgaaacagcatatcaaagctcttagaaatgtctggcacatagtgaacacactccttagtgttctcttttaatttctatgtaaatgaatcagtatttttaatggggccagatgcagtggctcatgcctggaatctcagccctttgggaagctgaggctgaaggaccacttgtgcttgagtttgggctgcagtgagaaatggttgtgccactgtactccagcctgggtgacagagcaagacccagtttctaaaaatacatatattttatacatacatatatatatttggtttagccagtgcagaaataaaataattatgtttaaattatttctaccaccaccccatcccatgaaaagaagagagggagggaaatagattacaataaactcccctaattttattatttctcattctgaaaattcatccaagtccattttgggtggggtcatgaggaaaacactgatgagtgtttgagcgttatattactagttagacataattattaaggatgcacatagcttcattaaaagatggcctaaatgtaactaccaatgtgaaaatttcaatgacttactaaatattttgacctatttgtgaatattctgaaatatattaattagcacattctaaaaataaattagaatcttgttataacagtattcactgttataacagtatatagagcaggaatttataaaaatgagtttgacaataaagctaatgactcatgaggaagcaggaacagtttgttttaccccggaatcaaatttttttctttaccgtgtaacgtttattttttctctcacaactttcatttgttaaagttataagtatttcattggcaactttttgcaaatgatggtggctgttagtttgaaggccagtgtccatgtttagtcaagaagtcatattaatctgcattgaggatgctgaacttgtatagaaatcttttagcactgttgaaatgttcagctcttcagatgcctgagcctgatacgagtttgtcattgtttactcctacagatgttttaagacttagaatgagtatgtccacccattaacttttaaatgacattaaataatcagtggtttccttgacaaaaggagttgcaataggaagttgaagaaaatactgagtctaaaactgtaacttaactctatggtatagaatctaaacttaactataggaacatgtgaggtgccagggcatacttatttcttattggtcaccttccttttatttttattccagttttcctttgtagttttacaagttttcagataattgtgtcattagaaattgacttccttctctatattttcttggccttaaagctgtcgttaagatacattttgaaattgcaggtctaagaggtaaaacttagtttaagcctggcattctcagtataggaattatcagctgcccttttccagacagaagctaaaatgtaatgtagtctaactctcttattagaaggtttattttctgtggtttgaagatttaattgtgtacatttcttctccctttttcactcttgtatatttttgataattgaaggagaagcactcatggttaataaagggtgtgacactcatgcacacgtgtgtttactgtggcactattcacaacagcagagacttggaaccaacccaaatgtccatcagtgatagactggattaagaaaatgtggcacatatacaccatggaatactatgcagccataaaaaaggatgagttcatgtcctttgtagggacatggatgaagctggaaaccatcattctcagcaaactatcacaaggacagaaaaccaaacaccacatgttctccctcgtaggtgggaattgaacaatgagaacacttggacacagggcagggaacatcacacactggggcctgtcgtggggtggggggaggggggagggatagcattaggatatatacgtaatgtaaatgacaagttaatgggtgcagcacaccaacatggcagatgtatacatatgtaacaaacctgcatattgtgcacatgtaccctaaaacttaaagtattaaaaaaaaagaaagagtgtgacatcatatgcaaaggtttgccaagcagagactctggcctgagcttgagtgtttaaggtgtgtgttggaggtcagtctcataggcatacaacgcctacgtgactgacctcatttattcactttccagaccctagagagaaaacaggtgtttaccatcaaaacagtgtgtgcataaattatctggttcaaattggtggccagttttttcaccagttggtggtcaaattgtggccgtcttcaggtatgcagaagcactcttatcagacagaacatttcaggggtttagtttctaagagactaagggccagccctaaaaatatgcctttcgtgggaatgaacaggatttgagcatcccagacctgccgctgagttaacattttcctgtataacttgccttttctttcctggaattaggttacttctgctcagtcttcagctcttaatttaaatggtgctttccacgtaaagccttccatttacctgtgcatagtacctgtacatttcccatacaacatatacacattttaaaatacaaaatttgttttattgaggtataatttacatacaataaaataatttaagtatgcagtttagtgagttttgacaattgtatacagtccagtaattaccacttcagtcatgatataatacaatataggaataaggaaattgatactggcagaatactgttaactagactgcaaacctaatttagatttcactgatgtttacacacattcaagtgtgtgtgtgtgtgtaattctgtgcagttttatcacaggtgcaaatgtatgtaatcatcataatcaagatacagaactatcctatggacacaaagaaaatccctgttgctttattagtcacatgctgtcccatccctaactctagcaagcactgatctgttgtttatacgttatatttaactgtcgttaatctgttgtacctaccaacagggtgtgcattcagtgagagcaaataagaagtctgtcttcttcaccgttgtatccaccacacagtagggcatgggttttaggtgctcagtttattatcttcgggaatttaatattgagaattgacttttaatcctaatgccctgatattcaaaacttttagatgagatttattagaagatgtcatgaaaaaaatccaagaaataaagcaaatttttgaagtttgagaaatcagattgtgtgtgtgcacacacatgtatgtgtgcatgtgctcccacccaagtacacacacgggcacacacacactcaacatcaaatgttcttttaaaagattgctatgcagttagattcatttactaccttttttttttttttttgagataaagtctctctctgtcacccacgctggaaagcagtggcatgatctcggctcactgcaacctctgcctcccgggttcaagcgattctccttcttcagcctcccgtgtagctgggactacaggtgcacaccaccatgtctgcctaatttttgtatttatagtagagagatgtttttgccatgttgaccagcctggtcttgaactcctgagctcaagtgatccacctgccttggcctcccaaagtactgggattacaggtgtgagccaccatgcctggccccttcatttacttttaataaaatttggggttacttaaccattataaatggacaacaaaaagagataatggaaacatttgttgtcatatagctttatggtctatcctcaatagaacatccaaagtaattatttttaaatgaaaatttaccattacctttgtgtaagttccatgtttgttttattcactataatatcctggcgcatgatagtcattttataaacatttgataaatcaatgaatgtgtaactgttaaatactatgttaaatgacattgaactgtttaaaagtatataactcattaaggtagcgtaattgttcatttgtatatttttatagcttaggtatgaaagaggaaaaattaagttagtattaatttggagctgccattgagttccttctgtatacaaaatacttcacagtatctgacaaaaactcagtcagctaggctctaagagtaaaattacttgcttttggtcacccagctagtaagtaaacctagtcagttttttctttgtctgccctctgccccatcctctttctttgctaccaaggtcatttgagtccaactgataaatttgtgtagctgttagaatattcaaaagagaccacaataaaacacaaaatctcatgtggtagccaaatcattgagttgacatatgcaatacattatggagtaatttagcatcaatattttctgttacaaaatgtgaacagtttttatattaaaacctgtgcttcattcattctattgcagagtatgatgaaggaactccttgatagaaatacaatacttgcacaaagaaagaagtccaaatccatcctagtttttttttctttttcttttttgagatggagtctcgctctgtcgcccaggctggagtgcagtgacacgatcacggctcactgcaagctccgcctcccgcgttcacgccattctcttgcctcagcctcccaagtagctgggactacaggtgcctgccaccacgcccggataatttttttttttttttttttagtagagatggggtttcactatgttagccagggtggtctcgatatcctgacctcgtgatctacccgccttggcctcccagagtgctgggattacagacataagccaccgcgcctggcccgtcgtagtttttttttgagacgaagtctcactgttggcccccaggctggagtgcaatggcacgatcttggctctctgcaacctccgcctcctgggttcaagcaattctcccgccttagcctcccgagtacctgggattataggtgcctgccaccatgcccagctaatttttgtatttttagtagagacggggtttcaccatgttggccaggctggtctcgaactcctgacctcaggtgatccacccacctcggcctcccaaagtgctgggattacaggcgtgagccactgtgcctagccaacaaattaatttttaaaaaccaactttcagaagtctttttttttggaaggatcttgcaaatttcctggacctgggtataatccacaatagaaaaagagagtacaacacagtgccagtgttccaatacctcaggagatgcatatgaatctattgtggttgatactggggatgcaagggtaaatgagaggtggttcctatttgttaatcttcattctagtagagaatgactgcactgtgaaagagttgacaagtagtaggtacaaactaaagctggagttttcggggttgatacatctggattttgaatcctgactttaatacgtgttcaacacgaagttaagttttctgatctttatatataataggactaataaactctaccttgaagaattattgtaaagatcagaaatatatgtaaaatgcttagcatagtaactggtccctggtggatactccttaagtaggattattatctactgctatcattttgatcaatcttttaggctttttctgaggctataaaatggggatgataatagtacccacctcacagtgatgttctgatgattaaatgagatattacatgtaaatctgcttgacatggtgctaggtatatatactttatagaaacctaaatgcttgatcagtttggtttcacaaatgatagcaattctgctgggagttagtggaagacaggtggtcaagaagtgttttataagggatatgaacaaagtgtgtacataattctgagtcttgaagcccagcctcaggatgtggccgtgcccagtggcttgagagaacactctctagagcctagatgacagggagcattgagacactgaatagagtttgctttctctctggcagcagaggggaagctgctttggggcttgaggggaggacacgggtctgtggtgatgccttattctatctcagatctatactctttgcagaatactttgatcacatcgggccacaaatagatttcagtgtgtgatcatgcagctctgataatcgagattaaagctataggaaaaacaactctcagaactttgaactcattctcataaatgagattttttaaatgaagattattataatttccccctttttcatttttacaatgcgaatttggttttgatgatgaaatatagcatttgattattttttctacctgtgaatagtgtttaaaaattgtggcaattaatcttcaagattaattgaatttggtaatggtgcattttcctcatcatgtaattggtggtctgcagtagttcctctgaaatctgcatcagacaactaaaagccactgaatgtttccatcagagtaacggtggtatttttctgcctatctaaatacctatcttggtttaattcttgcgcctttatttttgtgctcgataataaacctacttatgatgcaaaacaggttttaaattgagacttattttttgttttgtagaaacaagagcttctactatttgtagaagttaaacgaatagttctagacctaaagctttttacttaactgaatgaattaattcagttccggttggtcagtcttgagtgcctgctttgtggaaggagtagaaactcttgttccttgtaaaggagggaaaatgtatatggaaaataacatttatgtacccaccctccagtttgatgactgtttgttcattcatttgtttatgcattcattcaataaatatttattgagcacccagccttagatgctaatgcagaaaataaagaaaggttttgagacgaatagtccttagatcagtaatagcacatagttgtccactgctggttgagggaatgtttctcctactttaagagaaaataatgagtaaatgttcatacttttttagtgcatattaggttataaattcctggtaggttaaagagagtatgctcatctgatgtcttttatcttctctgtaacaaagagatatggcaggcttactggaggaagtatgaaatcagtgaattgtagcgcttcctaggcatgcattgttcaatttccagatagttttaactggccatttgagatttgtcttcatgagttgaaagtggagtttatactatgatttctccagctgctcatctaaacatgaagaggatgagtgggtaggttcaacgtggcttgggtttaccaagcaattcagacagagggataatgggagacaggggagctggttgtctttgcaagggacggtcataatgaggaaccatccagtatgaagtagacaaagattggtgtggagtgagagatgagttaactgggggtgggactctttgaacaaatgggctagcaggctaggaggcagtcattgaagaacaggatgtttgaaaatttttttagggtagaagtcaagacactttttatataaagggtcagagtaaatagtttagactttcaggaacgaggcaaaatgcagggtattatgaaagtacagaacaagaaagaagacaaatttccacaaatttttgtgttgataaaattcataatataataattgagcatggttttcttgtaacacaggtgtactgctgaagagaatgggatgcgtcttggaggaggggtggataacatttcatgtgaagttcaaaatgggtactctcatcaaaatcaattgcagattttaatcttttcaggctaatctacaaggaaattgtacacatttcgtctttgaaaatgtgttcacagtgacagttacttgcacgtattgatatcactcttatcggcttttaaaattgagttgattcattgtttagaaggcatttcaagaattccattagattcttctctttactttagactttaagcttgtattactttgcagattaatcacttaaaattgatggttagatgaaaacatctgagctgcacagttaaatggattttgaagtacgtaaatcctttgccttttcactggagtccaaaatatgctgctggaactgtagtttgaggtcagaaaatacatctgcaaatttttgtagaaatggaaatttcccttcttgtttttacttttgacagcatgggaaaggtgtggagcatctgaaggttattatgattcagaccctattcattgtttcttaatgtcccatttaagtggtcatatatgagcttttcttaataggagaccattttatttctttaattattttttggtataactcacgtttatatnnnnnnnnnnnnnnnnnnnnctatatgaaaggtactgaagaaacatttatttatatctttaacatcaagcataattaccgacacaatgtaaactatatgaaaggtactcaggaaacatttatttatatctttaacatcaagcgtaattaccgacataatgtaaactatatgaaaggtactcaggaaacatttattgaatgcatatatctaatatttttcttttaaaacagtgttgtttttcccattccttttgttgtaggtgaagagcgattatatgttagagatagctgatcaagtggaccaggaaattgctttgaagttgggttgtctagaaatacggtaagatgataactatacattgcggcctttatttatcaattttttaattatttttgaatattttccaggtattttccttttcttcataaggattatcagtgaaatactgaataaaatttgagtaaattatgaactattggtttggtgcaaaagtaattgcatttgttgctgttaatttttgtttattattcagatgcctctcccccagtttttatcacttaacaacacaaacattccttatatatacatataaatgtatgtcttccctgattttaggcgatcatactgggagatgcggggcaatgcactagaaaagaagtctaactatgaagtattagagtaagtattgtacttacaatctatacctgcaaatatgcagaactaaattcttagtttattttaaaattaaatactgattctgaaacactgctatttctaaaattttatatccagaagaggaaaaggacagaatccttgatgacattaattgtgttaataaacatttagatttgttgatagatgtcttaaagctaacattgtatatggcccattaacatacactttgtgtagatttaatcattgcaagatgatatttttttctaatttatattgaattctacagctgcctataaattgcttataaattattattcatgttctctgtataagttactacagattgttttgcacaaatagagatacggaagttactgctcatgtatcagaaaaatctagaataactagaaatttttccaataatgaaattaatgtgtgcatcagactgttatattagattgtattaaattaacccaacgtggagtttatgtcgtgggaggctagaaaccctatacttcatctttttcataattaattcagcaaaagataactgaacactgagtcctttgtagctaagtgccagagattcggaaataaaacaaaattttaacccccaggaagcattccactaaaaggaagactctcagacaagtaagcaaaattataacataatgtgctagaaactaaagtggaagtatcagctgggtgtttacaggagaatggtacttgatgtgtgaggtgttttcacatggagatgttatttaacctaagtcttaaagaatgagtgattcacaaagtgtagatatgtggggtttgttgcatgggagccaggaagccagtcaagaggataaatcagcatttgcaaaggcacagaaacatggaccatcaggcaaaggttaggaaactgagttggttgggggtagatagaataccattcttatgagggagagaggggtatgtatacagggaccaggtcattacctatctagtacattcttcaaagagtctggacttggcctttgagcatcgctgactcatcatttcaagcaggacaattatatgatgagattcgcaatttagaattccatatttgtgagattagaatttcattaaagaagattgaaaatggtagcaaggagccaggaagctgttgtacctttcttgtccatgtgagaatgatgaggctgtgagacagaaggaagcagtggccatggagacacgggctagcagaggtagagtctgactggaggctgattacatttgaattaaggacagggaggaacccaaggagtctcttggttttctgtcgtgggccactatggataccagtcacagaaaaggagtgtgcttgaggagaaagaagacaagttactcggagcatgttgatttttagttctgtgggaacgttcatgttttttaaaatgaaaaaggaaagataaatgttggtttatttcactgttatgaaatgacaaataccagtagcattaaaaaaagtctcttatggtaccctgtgcttagatcttggtttctagtaccattcttcagtggaaggcaccagagctgcttggaaaaatgcagtttgagggagaggaggaataatacacgggtgagccctagagcagcttgtagtgccagaaagaaggaagtgctcaaaaagcaaaacgatggggctgtgtcaaaggatgaatgagccagtggaaagagttcccagtgacaaaagctggaacaattcgagcaacaaattaagttacatagtattagattgtaacccaaagtataaattaaatacccatgagtccatagtaatatagatacttgaataaataaatatttaaaggagcagtgacaaatttcctgtatagaaaaattccaaataatttatgtaaataccctctctcaaaggaggtggagcataaaacccacctctaacgtatgagctacatttagtggcttgtttctaaagcgtataataaggaaaggaagtgtggggaaaaagtaattttacagtgaagaaacctgacaggcatgaccttagccaggtggtcaaagtcaacatcaccagtgatcagtcatgttgatagtgtgcaaccataatgtaatgtgttgagaaaggcactttacctctgtggccttcctcataataaaaacccataaccacagtctaatcacgagaaaaaacatcaaacaaatccctcttcagggacattttacaaagtacctaaccagtactcctcaaaactgtcaaggtcatgaaggaaacagtggaagtcagagaaactcacatatccaggagttgcctaaagaaacaggatgattacaggtaatgtggtgtcctccatatgatgttggaacagaaaaatgataggggaagaaaactgatgaaatctgagtaaagtatagagtttgttaatcataatatatccatactggtttattatttgtgacaaatgtaccaaagtaatgcaagatattaatagtagggggacctgggtgtggactatacaggatactctctttgtaactcttttgtaaatctaaaactattgtaaaataaaaggcctatctaaaaaaaacctgatgggagaattgaggtcagcaagtagttagagatgatctaagaaggtacaatagatggcaaatagttaatgtgaagtcaagaaaggagtgctagttgagtggcctggctgagttacagagagaggactccaggaacacatgtgatcatctttcagggtcactgtggaagcctactctagtatagtggctggggaaaaagaataatgtgaattgtattctaccctatctgtatgtgaggccaagataggaaaatgaaatggtaactgaaagatagagtctatgtgagaaccagaggtatacaaaggaatgaagagagccagacatactgtcaaaaggatacagagttacaggaagagagatacttgaaagaaatttccatgaataatacattgacatatttttaacagccaaaacagttaaagaaagaaaagcaggttgtctgtcaaggtgaattagtgaatggtatgtttggagagaagaattttaagttcaagatctgtttgaaatgagagtcaaattttgcactgaagttagtgtaaatttggcttatttctggaaattacagaacttcagatgatcagagaagaggtgaatagaagaggacaacttagggctttaaccagtgttaaaggctttcaaaaccttacgcagtttttgtcaggggtcagtgaaatggagaacatgagaattgctatacataagggcttgtgattattattacttgaaacaggagagctagacacagcataagtttgtaaattagatccttcttagaggattgcatggaaagttgaatgatctattgttttgatatggctgtttcatcttagttaatttatatgtgtgatatttaaagtaagtaaatatgatagttaaaagaaagaggaatctttagtttattgtagttctaggatgctattgtgcttattttgctgtcccctctttctaaattcctgtgcttttgctccactgtagtgattcgttgcagttatacaacttgtgtgaattcagcaccctatctccatataagtagattagttgagtgacctcttgaagcagaatatctgggttcaagtccttatcgcaccttgactattctatttgccaaattttattagtaagctcttggtgtctgtttccaaacgtgtaaaatggggataatggtgatacctacctatatatgagattgtcgtaaggagttagatgagataatttatgtcaagagcttaatacctcttgtacccaacactgaataaatgtggactataattatgattattatccatgggagatattgattgtcaatcaggataaaaaccaaactgtagagtttctttaaagagcattaagaaaaaaaaatagaaaacaatgttattgttcatctgttgatttaattttgagcccttttaaaatgatttttaatttatttattttcaaaggtaataatacattctagttagagaaaaagtgaaactacagtgtcaaataagaaaatttcttcaactcctctcactgataaccaccatcatagttttaataaatatccttatagctctctgttttaacacttgtgtgcacattcaatgcatagttttaatataagtggaataatcctatatgcatcttgctttttttattcaactttatgtttaatagatctttccatgtgactaaataaaaatatacattagtatactagtccacccaatgagtatataatgctacatacatttaaacagccacataatagtggacattcagttcaggttaataacaatgtaaggcatggtgccattttttgttcatttttgcctatatgataggcaacagatgataacttgctttatattagtttgattactggtgatattaaacctcttcacatatatggccatttttaagttttttttgtaaattaactatattttaaataagcttttctaatatattttttctttattaattttaagcagtctttgtcatgttaacacatcttgtaatgttagttctgtattttctttcccagctcgtcattttctttcaactatgtgtatatggctctcatcattacagaagtttgtctttctttaatgtagtaaaatcgtattttcattttggtttttgagttttaagatccgatttttaaaaaggcattccagaacttaagattgttaaatgtttgttttgaaacttttgtgtattcatttctgtttttacattttcaaatgtgtggattttaaaaatattttctttttaaattaacttttggcttaatgacattatgctcagatagcgtggtctgtgtgataagagcttctcaacttttatggagacttcttttgtggaccctagaataagatcattttcccctagtgttttatcatgaaaaagtttcaaaaatacaaataagttgagagacttgttcagtgagcatctgtgtgtctattacctgaatgctacagttattaacattttgttgtatttgctttgtgtgatcagtttttataaatgttttagtgtgattcaaaaaatgcacttcctaatcaagcttgttaacatacccatctgtgataatgactttgccaatttcttcctataagtctattaatttttccttgatattttgaggcgcttttatttaaacatacgaacaatataccttcttggtaaattgaattttgcatcattatgtagtgatcttctctatgcctgataatttgttgttgttgttctgaaatctgttttgctttctttaggttagccttgacctggtttatacttttcatttcttcactttcaacttctctgtgtccttatactttcaggtgtgtcttttaaaaatgtcatagtgctggatttcttaaatccagtttgctaagtgtttctttgaactgacaggtttagtacatctgtatttcttaggatgcgtgatatattggactcgcttttattatttatttccggtgtcctagaaataagctgtgtgtgagtgcatgtgctgtgtatttcttagttggtattcttattccacattttcttctgtaattacgttgaaatttataaacatctctactctttcattagttacccttacatttaaccttctatattaaccaactccagattttaaacttatctaaccctctcttaaacaatacaaggacctttaaacaccttaactctccccatcttcttccaacttacacatcattttttcctgttattttagttatatcttttcaaaattgaaactccaaatattagacattattattattttatacagttattatttttggctttccctacatgtatatgattttatttcttaaacatcctatattgggccaggtgcagtggctcataacctataatcccagcacactgggaggccagggtaggaagatggcttgaccagcacggatagcatagcgagacctcatctctacaaataattataaaaattagccaggcgcggtggcacgcagctgtggtctcacctagtcgggaggctgaggctggaggattgcttgagcccagcttgttgtggctgcagtgagctatgatcatgccactgcactccagcctgggcaacagaggaagaccttgcttaaaataaccatttttgtatctcagaccacccttctggtatgcttttccttttattccaaatatattgttctgctcattgtttttttctcaacactgtaaagatactctgttatgacaagaaatgtctgttgacatttctttatggttgctctttcttttaaggtccttttcctacttttcatcttttctagttttattcatgtcttgtgcttcgatttctttttataaatccagttggaataagacatacttctcaattctgtagattcatgtttttcatctggaaaatatatgccactatctctttaataatcaacagatatatttctgatctttgctgtctcttacatttttcgtgttttctatctctctgtctctctggattctctcttttttgggggagatatttctttggatttgtcttataattctttaattctcttaagtagtatctttatgccatacgttgttcattgtttttttcattctaccacttatattttttcatttctagacattccatttcatgtgatgtaatcttcttcatgcttggtaacctctggtatgcccatctgtggtgtttgtgccgtttatttcttcaagtttttatgcatagctgttttctgttctgtatttgacaataaccttgaggtactggggtgtctcaatctgctgttactctgactctcactcaggccaccaaagtggcttggattagaggctggtggccctagactgggcaagctgagttccagggggctttgtttacactgctgcggcttctggcaagagccaggaaatgatgccacttccgcctccgtcaggtccaacctcagtgcccaagcgccgggttcatcatccccaccttgcaggtaccgtcggtccagaaacccaaaaacagtttcccttctgcctgtcgtgctttgtgttagtgtgtgtgtgctgggggcgtcctagaaaccggcatgtttatcaccctgttgcctaaacattcttcattgtagctcaatctgtttccaacattagtttcccttttacttttacttataagttttttttttgtttttttttttgagacggagtctcactctgtgcccaggctggagtgcagtggcgcgatctcggctcactgcaagctccgcctcctgggttcacaccattctcctgcctcagcctccttagtagctgggactacaggtgcccgccaccatgcccagctaattttttgtatttttagtagagacgggatttcaccatgttagccaggatggtctcgatctcctgaccttgtgatccgcccgcctcggcctcccaaagtgctgggcttacaagcgtgagccaccgcgcccggcctagaagtttttaatatgtagtttttgataataaaattctgtttttaaatctgtctctttttaaaaaatttcacccttgttcttgaaaggtagcttaacagatgctggtcaagcaatcttcccactttggcctcccaatgtgctgagattataggtatgagtcaccatatctggcccgataatagcttaacagagaaaatgtaactattaacctggttacattttatataataaagatacttaacaatattgcatttggccattgtaaaggctgatgccagtgctttaggagtggcctggctgagaggatgtgcagggactcgcatgcacacaccatggctgttctaccacaggagcaactgggaaccccagcagctctctcaaggagtgtgttggcatttctttttcctattggttttggctagtaacttggagccatttagaaatttatatttcttcggtacagaaaggaattatacatgaatacagaatactgcttgtttcttattagttcatttcatggttctctttttcctttctaataagaaaactcatgaaatgttccacataatttattagattctggcaggaattttaaagtcaaactcagttgtttacagcctaatgcacaatgccctttcagctttactgtacttttttttttgagatggagtcttgctctgttgcccaggctggagtgcagtggcgtgacctcggcttgcagcaacctcctcctcctggattcaagcaattctcctgcctcagcctcctaagtagctgggattgcaggtgcccaccactgtgcccggctaattttttttgtatttttagtagagatggggttttaccatgttggccaggctgattttgaactcctgacctcaagtgatcagcccgcatcggccttctaaagtgctaggattacaggtgtaagccaccgtgcccagctgctttactgtatttctaaatgactttttttgtttttgtttgtttgtttgagacagagtctctctctgttgcccaggctagagtgcagtggcatgatctcagcccagtgtaacctccacctcccaggtgcaagtgattctcctacctcagccacccaagtatcagggattacaggtgtgcaccaccacgcccagctaatttttttattttcagtagcgatggggtttcatcatgttggccaggctggtcttgaatgcctgacctcaagtgatccacccgcgttggcctcccaaagtgctgggattacaggtgtgagtcaccacgcccagccataaataactattttgagttatactagtactactactaccactaaggcatagtttctgagagtgtgacaaatacatctagaagcttaagggttttttctttaaaccaactagagagttcatcagtctttcttttcatgtctttccaatctaggaagaaccaaggtactttttttgtaggcaaaggaaaagtataagacactgaagtcccccaacccctgtccctggtacgttacttcctgtgggctcacacaacagggaacaactggagtgcaaaacagacaagacttttatttacatcatttgtaaataagaggtgaggaggagagaaggcagctaccaaaggaggtcaaatgttttaagaaaaatgtttttcgttagcctttaaaagtacattgctgatattgacaaaccaatacagtgttaaaattaggatttctaatatggcattagagaaggaagactcttattttccagtaattattccccaaattagagaactataatgtgaaattattttaaatgaaccatctaacttttcatttctgcttgattccttattaagtggtttgcctttttttagaaatttgtttttaatcatctttgcatttagtatattttgctatagtggtttgtatagttgtttctcttcactatggagaatgtgagctgcattctgttgtgcggggaatgtattccccacacattatatagtatctgatatctgtaagatattccataggtatttctagaatggataaatttgtggtttaaaattagctgagcttagttatcgctgtacttgttttcatttttcttgtcaacagtagtcaattgcatcctttagctacttataataaatatcaaagaaggaggtgctggtagatttggcaggaattgatggttgcctcactgagacagaagtttatttctcttatataaaagaagtgatagacaatcagtgtttctcagtcattggggctacaggttactttaattttaccattttgtaatccatagccacctcatagcctaagaggctgctgaacatcactcatcaccacgtatgtattctagtccccaggaaggaggaagagatgggcattctctttttcttttcaaggacacaaacgtgtatacagtaagtcttcacttaacatcaataggttcctggaaactataagtgaaacgacataaagtgaaaccagttttaccgtgggctaattgatataaacaagagttaagttcttgtggaatgtttctcgtcacaaaaacatccccagcttctaagtagagacccaaaacacttctaatattaaacattggaataaatgtaagcatacattttaaaaagtctgattaaaaaaaaaaccagataattatttacccagttattccagttcagggtcgtgggtggctggaccctatcccagcagctcaggatgcaggtcaggagccagccttggacaggatgccattctcgtcacagggagtactcactcccccaaccccatactcactcatcctgggacaattcagacacaccagttcccctaacatgcacatctttgggatgtgggaggaaagtggagtaaccatagaaaccccacacagacacagggagaacatgcacactccatatagtggcccagctgggaatcaattttttttctcatcaacactataatgaaacaacattacataataatgacattatttatgaacctgctgtttaatactttcccttagagggacataggagaaaacatagtcgcatagccatacctgctacagaagagactggggaaggcagcactttacctggccaaaagacaacttcatccccaggatgaaggggagaatgtcattaagaaacagcaatctctgttgcagttagataattttaacatttgtctgttaagaagcttgagtataatttagaggtgaaagtaccaccatactatttctaaattaaatatactcaattctgacagttttggagaaagagtaagagttactacatggaaatgcctatttaagttatatttgaagttagttttggctgcatttttgcctgggttttaagtatttgagggattatgttcacaaaatattaaacagggtcaacagacaagaatcttctcagaaatattgccagaagagaaataaatttatccttgacttaaaaatgtgcttataataagcttagtttctttttaatatgtaaagaaagttgattcccatctgaggcttctaaaagccagctgtgttatgaatttgtggatatgaatacacgtgcaggataaggccacaggctgggactagatgggcacctagaggattcatctcagtgagtggggaatgctgatggcagtcagctggtgcaggtggggagaggccctcctacacagcctcttttcctgcagcattctggatggccactgtggtgtgaaaggaggaatatgaggaggtgcatagtcatcatgcaggaatgtgggagggcagagctctctaaggattttccaaaaatgctaaatggcaacaggaatcagtggagtgttaaatgggattctgaggtttagcaaaagagaaagaagaccatatcagtcagcagtgttctaaatctttcacttaaaggatagaggtcagttaaacattaagagagttctgtttaaaattggccagaaaaaccttaaatctcgatggctaagtgtattggttttaaactcttatcttatagtacctttcacactgtgttgtagttagttgtttatgtaattatctcacttaagaaaaggaaacatattagcgatttttctatcccatgatctgttatagtgcctagtatgtcatatggtctcagtgagggagtaaatgaatacagcctctcttttctttgtagcttcaaatctaaatgatttgaatcttagtgaatagatcatagaaaccgtttttgttagtcctgagagagaagtaggaaaggtaatacttagaagccctctgctatgtatatacaagcagtcccaacgaaaggcttcttaacatacagctgtctcctgtgagatctgctgccttctgcattgtcatggtagagctctctcctcatgcctctataccttctttccccagtctttctgagcaaggcaagaaccttgagtggttgtccctgtggtaactctgcacctattcccagtgctcatgcatttcacccatccctgtgcttactgaggagcctttgggcccacagcaccaagccctagagaatgagggtggctgaagtcctagattcattgctctggcccagccccacccattgcagctttctgcgacaatggaactgttctgtgactgccccacctagtttggtagcctctagccacatgggactgctcatcacttgaaatgtgatgagcattgcagttgggaacagaatttttaatttaattcaactaatgtaagtataaatagctacatatcactagcggttgtatattggacaacacagttctaacctaatattagtgtcttgtcatctgtgtatgggttcaagaggtttctctgaactgatgtgggaatctaataaactgatgcttgggtttgggaattggggtttggcaatattctaaaagcttcatgtgagttagttttttattacatgagtttaaatgcatttaggacatatcctttgacagttaatatagtaaggaattattgtatgataaaggttagtaattatattttgttgatgatgtgtaagttgtatttgttgttttattcgcatacaggacagttgtgtagagtttgggctcaaagaaggtttttacgccacttgaggcaaaactactgctgattagagtgcacattgtaaaccagtcccaaacacacagatcatggagagaggcgacctcatattaaaaatgggacagcctacaagtccctgtttggtttcctaaggctttaaatttagatatctataataggctttccctaaaaactttgaacatagtaccttaggtgggctcagagtcctctatcacaaaacctgaagtagtttgatttcgagattaaattaaaatgtgttaaaggcagcgttgcagaatttttaccatgaccttgtgtacttgagcctcatttttattttctcaactgccaggtatcaaaaaagttctaacatatggacaaacgttacaaattcattattagtcaaaagaagtttaagaaaacctaaactgtatatatgctaattattagccttcaggtttcttttttttttaatggagttgtcttcacctttgaagtaaaagcaatacctagtattcgtctttattttcaaaaaacatatgcttcctttcatttttcttgaatcatacaacacttttggtttatctttaactttcttatttgtgacagcaatgaatatggtaagttctttagttatgcctggctctgagaaaaatagatgtgtagctgggttgattaatagcagttgacagccacacagtggcggagaggatattccctgccctggtctttccctcacccaaatactgacgtgtgtgttgccttcttgaaacatggccagttgccttcttgaaatccctactagaagggcgtgcacgtacaccttgcccatgggtctgttttaggccctcacatgtctaaaacagaactgttgatgcccacccacctttctgttctcggtgcgtagcttcagcattccctcacacctcatgtccagtcactcatccctgttgcctctttgtccacagtagcccctcaatctcaccacttctcaccgcttctcctgtccaccagcaaacctcaggtcaggccatgcctccctctgcagtaaacagtgagacacagggcatgtggaccagaagctgtccagacagcagtgctttcttctaaggcagaacagaaactgcccccttcacattccaggaacttcataaacagtcttacttaaacctcagcaccactgcatggtagtaggagttcacatccccactttacaagtaaccggaggttcgcaggtgttaacagcaagtctgtcctatggcagagccaagattcaaattaagaactctctgaggctgggcgcagtggctcatgcctgtaatcccagcgctttgggaggctgaagcgggcagatcacttgaggtcaggagttcgagaccagcctggccaacatggtgagaccccatctctactaaaaatacaaaaaatagctgggcgtggtagtgcaggcctgtaaacccagctacttgggatactgaggcacgagaatcgctcgaagcctgggaggcagagggtgcagtgagctgagattggctactgcactctggcctgggtgacaaagcgagactcagtctcaaaaaaacaaacactctgatatgaaaataaatgcttgctgttaaggaatagtggcttgaaaatgtagatagaggcagaaatcctcaagaatactgccttgtagattccagagtgtgtcttttgtgtactaattttgctacttttccgtagtgattggcataaaaattcttaaaatgcaaagaccctgtgtttttaggaggcaaaatgaaaaggaggaacttgtgtggattcttttccccccttcatatccaactgtcaaaatagataatgatggttttgtaaaggtaaggaagggaagttacaaacaaaagtggctagagacagaaaatgtaaaaccagtagttaaatgaattaactgatgggtaaaaccagaaagtagtatatcatagaagctgagagagaattataggatgtaatgaacataatatcagaataagaaagaatgagaactgagaccagtttcgaatttaccagaggaggaattcattggcttaggaactactagcagttagattatagaataagggatttaaaatgtttgaatatagtatcaaccaaataaactgacatgatgtctctggttttgtttataacgccagctaacttaacagttacggatgaagaagtcatccctgtttcttgatactttatattcagtttattatatgtgatatagtatgtgattctgaaaagatacctgtatttcccttttctccttgatccttttatgtgtttcctgacgttccttaatgtcgtcagaggcattatttcacattgctagcacacgagtgacacctagtggccaaaacatctgagtaagttagtaaccaaagtactaggaaaagaatcagctattctttccaacctattttcttggccagagcgttgaggttcttgataataatgatcaatttaattttgttgcctgacttaaagaacattgctgcgatttccagcatttccataaattcaccttttttacctagggcataaatttatctgtttgttttttcctaatgtgaaactgagacaagtgaatgagtcacttaatcaaaaaagtctatttttaaaaatagtcaacttttaggataaacctaagggatttatttctgtaacttctcgggtatatcctgaatcatttactaatcaggctagctattttctctacaaatacagtattacccagttggaagtgatgtttataaccttcaagaaatatctgaaaaaggacagtttttaatacactataatttacaaagagggaatattttagaagagttttcaacaataaaggtaaaaaaagaaaaaaccaaaaggatttctatttaaaccaacttgtattcatgtttccagtacatatctagaaaatgatttgtcccatccttcctgtgaatatactggtaaattaaagcattattatacttgtttccttcctaaataatatatggaaggataaataatttacagtgcttttatgttcttgcaagtttgtcatattaattgatttggtggtgttatttgttaatacgcttctttttatatttcagaaaagatgttggtttaaagcgattttttcctaagagtttactggattctgtcaaggtaattagagtctcctttatcataataaaataacaaaattatgccaagaccttttccccagtggtaaattgcttttgggaaagtaaaatgtagtttccttccttacatgtaaaatatataatttaaaaagctgacatttattctagtcacattaatggcaaataggtttttagtatagctttctcccataaaacatggttttacttcttaattgtgtttgatactctgctaagcataaaactaaaaaagttatgtgcacagttattcctgtcatctaggtcttcacaggctaaaatattttgacatgcagaagaaaaggagcaatatgtaaaataatcgtggtggtggaatcattaatattgtgtgtgtgtgtgtgtgtgtgtgtgtatgtgtgtgcgtgcatgttagtgcattttgaaggtctgtcttttgtttcaaccctttggatgcttccccgcattagtagctttggcagagcctcagttcttatccttcccatatccagcgtggagagcaccttggagtgaggtgggaggactctgaatgtgtgattcccccagctaatccagagcacacatcaagattttcaagcgcagcaggggatacaaactttagggttaaggcagagtctggctcagatgagctctgccattttctagcctcagggtcttgggcctggtttcttatttctacaatgaagaaaatagtattttgtagggttgatgtgaatatttaacagattagtaaatatattacttaccacagtacctgtcacatagcaacagtggatgttactgctcttactttttatttttcaaagatcttattctacatcccatcagctgaagcccaagcaggagaagatactcattatgagaaaatgtagctaactttggataagttatttcatcttttggtatttcagtttacacatccgtaaaatggggataaaatccatttctaacacgagattaataagaggattaaatcttagaaagaccaaaagagagagaactgtcgacgtcatgttgattatcattgggccggagtgttggtataatttatcagatgcaatctgtgacaaaagctctgtattcagatatctgggtcctgctctctgtcaaacccatccagaataggactgtaaggattagtcactgtttccctgagtccagaaagtaacagtatcccttcctctctcacatagcttcttgataatctaatgggaaaaatagatataaaggtgttggctttaaaacacaatgcattctagaaatgcaataagacgtgcatttaagaatagtacaggaaaaatatactctttatttcaggctctctttctagtgatgctgctcgactttttcagtgttcattcaagtttcctgatctattagtgaaatactacagtgaattattagggaacagagcatactccatttagtgtggttgaggccaggactacagatcgagacactgtcccagtctacaagtagcccacagaccattggcatgagtgggttgagtcagatttgaaagagaacaaagagttttaaatgaagtttggcacagtggaaggggaatgagagagaatgacacaattgtgtccttcgagagagttattaggtgtgggtggcccatactcttgcagttgggagaatgggagattcagtttgacctggaatgtttttggtgtgggagccgagaaggcatgggaagacccttaagtggaagggatgctgctgtgtgtaaacctgctgggtgctgcagtgaggaggatagtggagacattcaaacaagtgtaagctacagttttagtgaatttacattgctgttggatagaagagtactctacccaatgttctgttgatggttatgtcacattagtagtattggtcaggggttttcagttgtgaagcactggtttatgaagcctcagaattattgcaaagtctccttaaatctgtatgtgtataaacaattaggaaaagagtgactgttgtcatttaggagtccaatacattctagatttttaaaggatccccatattcaaaacggaaccacaggtacaggtcacaggtgccatggtgtgagtgtagccagagtgagacaggtgcccaaagaggttcggtagaggactggccctgtctcctccatgactggtccttctgaacctctgcttcaatgttccctctcctactcttttctcaccacgcaaagtggaaatggcaaaatactcccttcaatcttgggaccctgtttagtatcttaatttttaattctactttctctttttttttttttttgttgagacagagtcttgctccatcgcccatgctggagtgcagtggcgtgatctcgactcgctgcaacctcctcctcccggttcaagcaattcttctgcctcagtctcccaaatagctgggactacaggtgcctgccaccacacctggctaatttttttatttttagtagagatggggtttcactgtgttggttgggctggtctcgaacgcctgagctcaagtgatccacccaccttggcctcccaaagtgctgggattacaggcgtgagccactgtgcctggcctcaatttttaattatgtagtttgttacttgtttgtattttatctgccttcctccgctatattttaagattgttgagggcaaagacaatatctgttgctgtctccactctacaccctttgtttgacattgtacctggcacgtagtaacatttggtaaatcctacttaatgaataacagcaatatgatgagtaaaataaggggagacactttctgaacactgagtacaatgtgaacaaaaggtgtgaagacaggataagactttagaagatagtagaattgaaaagctagaaagtttctttccttggttatgccttccctactgctctccatccccacccccctaaaaaaaaccctcctctgcaggaaatttgtgcaggtatcttaagatatgtttccaggctatcgtttaggcttccattgccctggcctttgctgctgatgcccatgtgctttttttcctgccatcttgagctgtacctgggtatcagataactcctggtggccagagagggctcacaccctagaaacagcgagccctgatagccagagagggctcacaccctagaaacagcgagccctctctgtttctaggctgtctaggaaacagaggtcagacaggaaagggggttttggttgagtagagtcaatatgggatcattgtgggcagtcacttggtgtgggcttaaatgctgaggtaggagttgagggggattggggactcattgcagagtgtgtagagtatgcagagagtgcagagtgtgcagtatgatctctttttggattctagaatataaatttgacagcaacatggagcacagattgaaagcaaaaagaaccaagaagacttgggaggtgattaaggaagatgagatgtgcaatgatcaaggcctggatggaatggcttctgtaagaatgggagggaaggatgactagagggacttgagaaaacttcttttccttttttttagagacagggtctcactccgtcgcccaggctggagtgcattggcgcgatcttggctcactgcagcctcggccactcaggttcaagcaattctcctgccttagccacctgagtagctgggattacaggcatggaccaccatgcccagctaatttttgtatttttttctgtagagacacggttttaccatgttgccctggctggtctcaaactcctgacttaagccatccacccgcctccgcctcccaaagtgctgggattacggatgtgaaccatcacacccagtccagaaaaccaaataacagatgtgctttttgagcaattcaattgctgctgattttgatgtaaatagaattaatttttagctactgttagctatggattcatcagatttatggagtggctcataaatacggttcttagaactggtttctcacatgccctttttaataagggaatcactgtaattttgtgtacccaatagtgtgtatttggcttaggaattcataaccttagcccaaggttttttcacatttgacataaattctttggacattgcactgattgccatgaaacttctatggaatatggtaccaacatatgctcatgggggtaacaactataatacaaattaggtggtgtctagacagtcccttcttcaaagctattgccagtgaaacttcagctagctagaaattcacaccagtttcttgtttcttctgaaatagctctatagaatggctaagtcagttaacattggcttttccataaacaggctacatttgtttctccaaaaatcattttgttttacctgattttttttccctttctatttatattcgtagaagattatttataattaacattcacattgaattgttgaaagattgttttattatctttagtgaaacttggattagctatgttttatgccaaaaatggaatctgggatatatgtgcctcaattactaagaataatttgcaagtattttaatttccgtctcgttgatgttagtagttttaaagacacatttaaaaattcactgtaccagtaaaactgtcaaacccaaattgagggacattctacagaattctgatgattactcttgaaaaatatcaaggtcatgaaagataagacccagaagctgtttaacagctggaggaggctgaggagacaagatgtgtaaatgcagtgtggaatccggagcagtgaaaggacattagtggacaactagtgaaactggagtcacttctgtagttcagtgaatgttgtcctaccagtgggtaccaagggtgctccccatactggcattacaactctactctgagcttaaattaggcagcaagtcaaaataggcaaattttaatttattgcaatataatgcacagtagaaacctaatttcagaactagaaatgttaagagatcaatagttatcagtttttttagtatctgattctcaagtaataatgtggtttcctagaatactaccaggaacacatgattttattcttggagaaaatagtcattattttcatttctaggatgagcagatgactattttaagcttaatattttcaccaagcacagaaatgcatatcttggtacgatgttcagcagtgaattcctgttatctgctgtatgccaggacctgagttggggatgctgggtggggagtgaaacctggcctctgcttacagagcttatcatctgatgtgggtcctgtagataggagtaagaagaggctctcttcacgcgctgttaatgtatctgcatttaaagcatttggtgtttgggttgagaagttattccttaaaaactctcttattgcagattttccttggcattgccttacaacctttgcatctgggaagtcctaggaatctattgttgctagcagcatctgataatcattaggttgactaataggaagttatttttgtagctcaacatggatgaatagcagcagtttcttatggttcatcctagcaataccacttcattttgaagaagtatcacattcttagtaaatttatcactatatgtaaattggtttaaaataaaatagtgtgcgtagatgccttgtttccaaaatccaggttaacacaagcaggtgttcaaacttgaaatgcaatgagaacagtcttgtttacttaaacaagttctgcaagtgtattgattaatatccagagattctacacagattttgtggaattttgttccccactgagtaattaggaaagaactaatgctttctaagatatccttttcgtaaaaactgattttggagtttcagacagcagagattttctagtttctgtccagcactgaacaccataggtttggaactcacagtcctcattggcagtcgcatttaagtacagaccataagaacttgggtatattcctgccaaaggcgccaacagttttagttggtggagaatgagagagttgtttctgtgtccataggaaactaactctgaatgatatcgttttcctttactccagctgcttgagcttactggtttgttgtgttgtttgttgctctcacttcttgggtctcagcttgttaatgtgtaggatgagcaaggtaacaccgcctacagaaaaagcagcatgttttcccacattcagctgaatgagacaaatacagtaaaattggagtccagattgtctcttaacattgcatagttattactttcaaacacatttgccccagttacttggaaattttccagcagattaaattatcggggagagcagttgagttctttaccaccacacacattccatgtctaagagtttgggatgagaaaatgaggatcaaaccaaattgactcactttatttagcaaagggttgatggcttcaatccctgttgtagaagaacagcacacaacttctttttaagattcttagtcatcagatgctgagaaataagaggccaagagaaacaaggagggcttgaatttaaaggaggcagagggtagagagttgttgggttacatttgaagaatgttacgggcgtaaagtctaacaggacttagctactggtctaatgtgggaggaggaagaagaaaatacagggcctggcctcagatttctgtcccatacacttaagtgctgtctagtgctactagtcaagagacaatattgaagcagaatctgaactgggtgggactgcccgtgatgcattcagctgtgtaagtagtgaactagaagtgcctggagactatgggggtcaaagggaaggggtataggaaagagtaagttcagagtgatagagttgcaaccaagttagatgtatatgttagggtccagtcgggtagggccaataagccaccacggctgaaatctcagtgctcttagtggcaggttttagatgtctgtgagaaactgcagtggaactgtcaggtaggcaggtgtgtatatatatatatgcattttaacctcaagagcagattctgtttcctcgacttctatctccgttacttcatagaatgttttaggttaattttaaaaagcattgaacaaatgagcaggtgtcagtatattataatattgccaataatttatatataaaccagcagctggttgggaattaggtacaaagtagagaattgactttttttctgtacctattttacataatttttgatcactgcatgtcagtatttacctgagttgaaatattcctcttagagtcatgaatgaatataccaacatttggttaatgttaatagaaatgttttgtcattgtgttctggtccctgtgttcagttgacaactgttccttgcaactgctaccatattccaatttattgtatcatacacttaaagagatttttttatattccagggcttttgctggacttattttctattaatacttgtagatgggagacatttcttacactcagagcatttgtacattgaggcagcatgttctatgatagaagtttgaaactaaagaaatctgaactgtcttcccacttacttactagaaagtgaaacctaatttatcacaggatagaactagattttattcatccatattatctgtttgagagtttgccagaatccaagttgttatggcagagacatgtaattattcattgtaaaagcacatcattgagtttcagctgcgggctatactcttttctttggggtaacaaggcagtgcatgctcccttatcaccaacgtggatcttatataagtgccatgtctaaaaatacattcaaagcagtatgagacccatagggatgtggtggttgtttcttcctggtttcttctatcaagcagagcatcttagaaaaggaggtgtttgaattggtctcatagcaagtaaaaagaaatcaagtagttctggattagaatcacaattcttgtaccccctcgttgttacctaatgtttcagtctctgtttgctcagtaatatatgaaaaatagtatctcccttgcaagggtcattgtgaagactttgtttatttccacggaagggcctacagatgtcttttctggtatcattttttggtagtgtgtgtgtgtttgtgtgtgtgtgtgtgtgtgtgaatcagcgcctaatagcactatatgcacagaattatactgttcctcctgtagccatgaatgaagatcagaatgctctttttccagctgtactctgaatttattgagaatagatacctgttctgattatgcagtgtatgccaagtgccaagcacagagtagaatttccttagtggatttgttctaggtccagagtgtagcgggcctgcttcttagagactgctttatattcagcaaagtcccaaggtactatattgttaatttataaggagaaaaacatcatgtaggtggctacaagcagtactcaaatctccatgtccaatctgcatgctctgttgtagagtctgtcctacataggtgatcataagcagagaatgtttagaaagcctggagtcaaaccaagaatatgcttttcggacttttgtttatagagcatctgaggctgaccacctcactttccatgtgatacattttatagtcaagccttgctaaccttgaacccattttattgctcttcagtttaagttctgtgaagctgtaattaatccttttcaaaacagctataattctcttattccactctgtcatactcacctgtcaaaacctcagccctggttaaaaccaactattggtcagcttacttagctttggccttctcttttgtcttcattttatttgcaggtgccatctagtcccatgtatttaaatacttcagctggtggctctgaaatttctagcaacagtgctgccctctcctgagctccagacttagatccaaatgtctccttgatggttcatgttggaagacttcaaggtcaaacacatgtacagggttaacatgactttatttttttcaccaagcctgcctcttatgtttgcctgtttgttccatctaaaactctacttttcctggattctttactttccagttgtcttgcatatgatcatccaaatgtcccaaaagtgcccatttctcttcttcaccactaccttggggtccatgccactagtgttttcttgcttgatctgttacagtgacctgactggtctttctgctttcactcctacacactcccccaaccctctgtgtgcaagagcagagcgagctttttaaaataaaagtcacatgccttaggtaatcctcccatgttccactatcttggctcattgaattcctgtcttcaggaatcttgtcctctgccttacctcaacctctcactctggtcttattcatttccagtaatcgaaccccctccctaattgtgtgtatccttctctctgaccatagctcctgtctttccagctcactttctgtagtatcccagatccagtaatccttggatcctactaggaccttcaagccactacagacaggctattacctccatgaccccaccaaagtatgccatgccctcctagtttacggtgtacctgacttagcagccacacctcaacctgggcccctggctgctccccatgtccctgacccactgagattagcaggtcacctaatccatcttccctgtctgctgggccagccaggacctccccttgaactccactgggcccttactggcctgcttgacagctccacttggatttctggtattcttctggcattctttctgacctttacccaccaaactgctcctctcacaatttctgccatttcagtttaatggcaactcttaattattagcatatcctgttggttctatgtttaaagtaaatccattggagtccagttactctggaaaaaaaaaaaaaaaagaagaagaaagaaaggtagggtctgactacttgactacttctcaccctctttctggttctgtacttgtgccatctgtctcctcctgcctggattatttgggttgccctgacttggtctctcctgctcctttcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctattaaaaaaaaaaaaaaaaaaaaaaaaaaaaaaaaaaaaatacccaaagtcagataaagtcactcctcttctcaaagtctcctgagggcttggcatctcatcagagtcaaagccaacttgttaactatggcctacattctcttgcccctcttcattagacctcatcacattccctttatccatggccttctcagactgcttcacacaccaaggactgggggtttgctgcttggaaagcatttacctctgctatgcagatttccatgtgtttaagtagaaaactcaaataagcgaaaaaggactggaagaccacctatcatcttacttcatgaaaaaagcaaaagcatcgttgctttatctccttcatgggtacattgctgtgtgctcaccaggacccacacgtgtgctcttgccttttaaaggcatctgtactccatgctgactgttttgtcatcttttttcatgtaacaatgtaatatgggttttaatgccagtagattagttctccaaaacagttcttgaggctgcatagaatgttggttgagaagatagatacaccatagtttacgtaaccaggctctctattactgtaaacagttctgcagtgaatctttttgttcctgaatctttgcatgtatctctaatcatttctaaagaataatgtcctggaattttattttatggataagcattgtggtttttttaaagtttttgatttgtgctttccttcagaaagatatactgtttttttccctcctaacagtggaatgtgcaagtacctttatacctttggcctggtgttttctgagtcatgtgcacatatagtacaaacttctgtttaagaaataaaactctatatatgaactttacagttaaaaatggttaagatggtgaattttgtgttatatgcattttgccacaattaaaagaataaagctttgataaatacatttatagttatttgacaagtatactttttggcagtaatttgaatgtaggtgttagtaagtagttggtaggaaagaaatcttaccattattgttgtggtctttactcattgctgatttttacaagatgttttggtaattttgtcatgcaggccaaaacactaagaaaactgatccaacaaacatttagacaatttgccaaccttaatagagaagaaagtattctgaaattctttgagatcctgtctccagtctacagatttgataaggaatgcttcaagtgtgctcttggtgtaagtatgggaatatgggaaatagtgggctagtttgattttactttttcttgtctcttgctgtatatctaaatttctgatgaaaaaatgctaacttgtcccatttttttcaataaaatgatattttttcattttaccatgtgaaaaatagaaaaagaaaataattaatgtgagaataaaatcacctttttaaaaacagcatgcctagcttcataattaggtttttaaaattttatccctgtgatttgttaattgttctctaagggctagtttacctatttagataatcatcccagagaaacccttggcatcaggcatgctggaataagcacagtgcactttgtgcaggcttaacacatcctgggtcaatgaagttataaatattttatcttatttggttagatagattaatagcaaaccaaaccagcccctgctttggtcctttaacatatccacggctctttatctaaagtatttcttttttccttctgccacctctgttctcacttgtttcaccttcaaaagtcaagctggattatttcagtggaactggcaatcggcccagaagaaggaatcagttacctaacggacaagggctgcaatgtaagtctgctctgacctttcgggaacttggcgttacacaaagaagaatcaaattaaggaaatggggcattcttttggaaaagatcattttacaattaaattttcctattgcactgcatttattgttcagtggagtgggggacaagtaagagaaagtctaggtgctgttgaaatacctcggaattacttagttttggaaggaaaggaatcatacaaacctaacatgtgttagtgagacctgaatggggttgttactgtttatctggagaagttttaaatactaatttttaaaattaagttctgaatgatttgggtatatttgtactggcatcttaccctttgaaacagcctcttcaggttatttccaggaaaaaaaaaaattatacattcacaattctcttgaaagccttattaaccttatttacctcgaagaaaaaatgtccatcagatggaaactcacacttctaccccacacctcacttcttttgttatcttcctagcagaagtgctgaccatttcctgtgtgatcctcattcttccaacaagtattattgagaacctgcttggtgccaggcagtctagaggtttgagatacaataaggaacaaaacagaagtcctttgtctttatgtagcttatagttgagtgcacaaaataaatatggaatacatctgtgtcatacaacaataagtaccgagatgaaaagtagaacagtgtgagggtgggtgtactgagaagggcatgctcccatttagatgagtgttcagggaacatgattctaggggcttcttctcaggccttgcactagtaacatttcttttccacttaacatagtgtagtgatttgaactttttacttaatttattcataccttgacctgtacatataatttcctatacatatataaatgtgccaaaccgtgtctgacctgcttttttccaagtgtactctggtttccattcccactctgctcagctcctgcctctaccattcttttctcttcagccttctctgtaaccccccaccccctgcccatacttaacatgtaagtgatttagtaatcttctgtgtttttcctcatattcctgttttgttattcagaaaaggggtcatcatcaggcacactgtcctacttggttatttcactctgtgaacctggtagaaattttttcaagccccgcctttctttgccccttcctccctgggggccagatgggattctgtgaagggcaattactttgcttttagatttctgccccaagacaatgacataataaatactcctttatatataatctatgtactactgctttttctccttgtggaagagatttccaaggatggaactgcagggttcgtttcaaatagttgtaattttaaaagaagctgttggattgcttttcagaaaagctaggaaacttcatattgtcactggcagtgtgtgagagtactattttcgcactcattggatggcagttttaatagctcttttaatttttccattttaatagatacaaagttattcttgtaacttttttgctcacttagatgtaaagcaaggacctagtaactttaaacatattttcatgtcttgactgtttttcttctcacctctgtgaattaactgctcatatcatgtactttgcctattttaccaacacaattgtccttttaaattaataagtccctttacacatcaaggaaatcagtgtgttttcctgttaccttttttatgatttttttccccaaatctcttgttggctgttgactttaaacagaccggcctcccttgtcccacatcctaaggatgaccactgtcctgacttctgccatcactgattaaatctcattaaatgctgctgtgtcagctggatattcacagaggaaaacagaataaatttttgtgaaattttgtgaaagtgctttttttttgatattgtgtttcaggacttcttttatacccttcaataagatctcaatctttttcagataggtcttccatattaaaccaattcataagtattttatagttttgggccttatgttgaatgactttttggggtttttcttgccacttacaatttaaaatttatattgtgagcatagaagatattcttgattattgtttaacatacagtctgcaaccttattattgattgaacaggttttttattagaattttggattttataagtgtataataatgtaatcagcaaaagaataattttacctttccccacatacaattttttccttcagtcacaagaagctcaaagatcatgtttaataacagggcagtagacaatattcctattttgttttagattttaatttatcaattaaaagtgtgtcattatttgggattgtttttattgttgagttttaataacatgtctttaatatttttatcttttgcttagagttttatgagtagctcctaaatttaatcaaagacccttttagcatctattgatatgatcctttttctcctttatcattatagtagattatattaatagttatgataatattgagccaattaataatatacaatattcttttaaaatattgagttatatttgtagaatttttgcaactatttgtgagattaatctagacttttttatgttaactttattagacatggtgttaaagttatattaatttcattaggtgaattggaatctttcagtgatttttttttaaaaaaactttttaagctcaggggtacatgggcagatttgttatctaggtaacctcgtgtcacacagtttatcatacagattactttgtcacccaggtattaatcctagtactgattagttatttttcccaatcccctccccacttttaccctccaccctctggtaggccccagtgtctgttgttgccctctgtgtgtccttgtgttctcatcttttagcttcccttataagtgggagctaaaagatgcagtatttagttttctattcctgtgttattttgctaaagataatggcctccagctccatccatgttcctgcaaagaacatgatctcattcttttttttttttggctgcataatattccatggtgtgcatgtaccacattttctttatccagtctaccatcgatgggcatttaggttgattccatgtcttggctattgtgaatagtgctgcattagacgtacatgtatatgtgtctttataaaagaacaatttggccgggcgcggtggctcacacctgtaatcccagcactttgggaggccaaggtgggcggatcacgaggtcaggagatggagaccatcctggctaacacggtgaaaccctgtccctactaaaaatacaaaaaatcagctgggcgtggtggcatgcgcctgtagtcccagctactcaggaggctgaggcaggagaatggcatcaacccgggaggcggagcttgcagtgagccgagatttcgtcattgcactccagcctgggcaacagatcgagactccgtctcaaaaaaaaaaaaaaaagaacaatttatattcctttgggtatatagccagtaatgggattgctgggttgtatggtacttctgtttgtaggtgttgaggaattgctacactgtcttattattttatgtattattgtgaggtacattccttcaatgcctagttcattgaggtgttttaacatgaagagatgttgaattttattgaaagccttttctgcatctgtcaagatgatcctgtggtttttgtttttagttctgtttatgtgatgaatcacatttattgatttgcatatgttgacccagccttgcatcccaggaataaagcctacttgatcatggtggattagctttttgatgtgccactgctgggtttggtttgctaatattttgttgaggatttttgcatctatgttcatcaataatattggcctgacattttctatttttgttgtgtctctgccaggttttggtatcagaataattctggcttcatagaatgagttagagaggagtccctccttttcagtttattggaatagttttagtaagaatggtaccagctcatctgtatacgtctggtagaatttggctgtgaatccatgtggtgctgggctttattgggttggtaggctatttattacggattcaatttcagagctcattattggtcacttcagggcttcagtttcttcctggctcagtcttgggagggtttatatgcccaggaatttatccataacttctagattttctggtttatgtgcatagaggtgttcctaagattctctgatagttatttgtatttctgtggggttggtggtaacatcccccttttcatttctagttgtgtttacttaggtcttctctcttctttattaatctgggtagtggtctattttattaatttttttttaaaaaaacaactcttggttttggtttagcaacaggcaggaatggtttttccatctcactctccttcaattcatcctggttttggttagttcttttcttcttctagttttggggttggtttgctcttcttctagtttggggttggttctctagttcttttttgtgatcttaagttgttaaactgagatctaacttttcgatgtgggcatttagtgctacaaatttacctgttaacactgccttacctgtgtcccagagattctggtacattgtgtcttggttctcattcatttcaaagcacttcttgatttctgccttaatttcattatttacacaaaagtcatttgggagcagtttattcgatttccatgtaattgtgtggttttgagcaaatttctcagtcatgatttttaacttggccgtgctgtgctccgagagaatgtttattatgatttcagttcttttgcatttgctgagtactacaaatttacctctttacactgccttacctgtgtcccagagattctggtacattgtgtcttggttctcattcatttcaaagcacttcttgatttctgccttaatttcattatttacccaaaagtcattcgggagcagtttattcaatttccatataattgtgtggttttgggcaaatttcttagtcatgatttctaatttggccatgctgtgctctgagggaatggttattatgatttcagttcttttgcatttgctaaacggtgttttgtgttcaattatataattgattttagagtatgtgccgtatggtgatgagatgaatgtgtattttgttgctttggggtggagagttctatagatgtctgtcaggtccatttgatccaatgttgaattcaaatcatgaatatgtttgttaatttccatctcagtgatctacgtaatattgtcagtggggtgttaaagtctcccactattattgtgtaggagtctaagtctctttgaaggtctctaagaatctggcttattaataatgagtgctgctgtttggtttttttatatatttaggatagttaggccttctcgttggattgaaccctttaccattatgtaatgcccttctttgtcttttttaactgagttggtttaaagtctgttttgtctgaaattaagattgtaacccctgtttttttctgttttccatttgaatgatggatttttctccattcctttattttgagcctatgtgtgtcattgcatgtgagataggtattttgaagacagcataccaatgaatcttggttctttatccagctctgtgtcttttaatgggggcatttagcccattaacattcaaggttagtattgatatgtgtggatttgatcctgccatcatggtgttagcttgttattaggcaaacttgtttgtgtgtttgctttatagtgtcactggtctgtgtttttgtgatggttggtaacggtctttcctttccatatttagtgctcctttcaggagctcttgtaaggcaggtctcatggtaacaaatttcttcagcatttgcttgtctgaaaaggatcctatatctcctttatttatgaagcttagtttggctggaattataaaatttcaggttggaatttcttccagaatgttgaatgttggcccccaatctcttttggcttgtagagtttctactgagaggtctgctgtttatctgatgggccttcctttgcaggtgacctggcccttctagtttcctttaacattttttctttcatttccaccttgaagaatttcatgatgatgtgtcttgggaatgatcttctcgtgtagtatcttactctgcctttcctaaatttgaatgttgacttctctagctaggttggggaacttttcatagatcatatcctgatacatgttttccaagttgcttacactctccccagctctttcagggacaccagtgagacatagatttggtctctttacataatcccgtatttcacagaggctttcttcattccttttcattcttttttctctattcttttctgactcctatttcagaaagacagctttcaagctctgaaattctttcctcaacttggtctgttaggctattaatacttacggttgcattatgaaatctttgtagtgtgcttttcagcgccatcaggttgattatgttcttttctattctggctattttttctctcagctcctgtattgttttattgtgattcttagcttccttggattgggtttcagtgtactcctacatctcaatgatcttcattcctatccatgttctgaattctatttctgtcatttcagccatctcaacccagttcagaacccttgctggagaggtggtgcggtcatttagaggaaagaaggcactctggctttttgagttgttagatttcttgcagtggttctttccatcttttgggccaacgtttcttcaacctttgaagttgctgacctttgtatttttgcttgtttgtttgtttatcctatttgatgaccttgagggtttgattgtggtaaggtggactcaactgactggctgcatttctggaatattttaggggaccagtgcccagcccccaactcctggactgtgtgctctaattctgggagactggtattgggctgcaactttgttctctggctcctggaggttaggaatccactgcacttgtggagtgttgggggtaggggtgctcccagaccactggtcactacactccaatgggtggtgtcagccaaagcatttcacagtgtggtggcataggatccgcccttgtttccatgtgccagcagcagtggcagcacactgggatgcacgctcatcagcccggcaggttgctagtgggtactggggtgcctgtctccatttgagcattcactacagtggcagtagcagcacggtttgggtggggggttgcctgttggcaactgtgcagcattggtgctggtggtggtggtagcacagggttgggttgctggcaggcccaggtctgtgtgtgcaccctgtgcactgtaagcataggtgtttgctgtgggtaggggagaatctgctattctctgtgcctgctttcactcttgggataatgttgacataagcatggggtgctggcagtggggacagggctggttggctctgtgcctgccaaggctccgactgaggtggctgtcaggcatgggtgagttttggggttgcgtgcacatgtgcactggtgaggcacggaaggcaatacctgcctgcgtacacaggtgccagcaaaactctgttgggaattgctgtgggctagaggaacctgcagtgtgaggaaggagcgggtgggctggtgtgtggcaatggaggctgccccgtgggagctctctgctggtcagaagcggtcagccactgcaggggctatgatgtgggccccagggcacccaaggctaccctgcaagcaggctcgttcaggctgggaccccaggagaagccagaagcccaaggggtgctcaggtcagactaacccccttctgataggtaagcccaccctgcagagttcaggtccaacagttcccctagggctaaagtctcttatgggagcaagtcagggcttccctggccatgttccactacagacgctcctgcaccaaaccctctgggctccacctcagctggctgcaatccctagcacttctctaagcagctctccctgccacctcaagtgtccgtagtagttgaggggccccctgctcggatttaagaggcctgtagtgagagcaggttgctccttgccagttccactcacccattcccccagggtaattgtgggccaggaatgagtcttggtgtgtggtagcctcttgcagggttcccagcttcctcccccttcagcccagcttctgtgtctttccttcatccattctcagtgccttccctctctctggtgatttttaatggcctgaaatattttaattcaaattggaattgcatgttgtttaaagactaggtagaactgatctacgtaacaacatgatgcctttttaaacggcaggtgtttatctttttaatcacttcaaaagtaatagatcttttttgagacacggtctcaccctgtcacccaggctggaattcagtggcacgatcaaggcttactgcaacctctgccatctgggctcaagcagttctcctgcctcagtctcccaagtagctgggactacaggtacacaccattacactcggctaatttttgtatttttttgtagagagggggttttgccatgttgcccaagctggtctcaaactcctgggttcaagtaatctgcccaccccagcctcccaaagtgctgagattacaggcgtgaaccactgtgcctggcctaatagtaatcgatctatccacattttccacttgtgtcggctttggtaatttagcatattatccatttctctacattttcatcttgctgccatagagttgcctctcatagatctgttaaaatctttccagtaactttgtctctatattcctgtttcatgcctaagctcttttgatttggctctttttcagacttgtaaaggtctgtctattctaattgttttttgaaggacaagtttagtgatgtattgcagcagtactattcattttcattgatttcagtatttttcttcattctgtttttgtagtatcttcattatttttgtcttttttattgtgctcttcccttttaagtgcatctttaaaatgtattcttgtttactttggaggccattttcttcttgcacaacttttaatatgtcttacctttctaggtatgtggtattcttctttccattgtatttctgtatactcatttgaagttttatctttggccaggcaccgtggctcatgcctgtaatcccagcactttggaaggctgaggcaggtggatcacctgaggtcagaagtttgagaccagcctggccaacatggcaaaaccccgtctctactaaaaatacaaaaattagccaggcgtggtggcgcctatagtcccagctacttcaggacaccgaggcaggagaatcgcttgaacccgggaggtggagattgcagtgagctgagatcacaccactgcactccatgctggacgacagagtgagactccatctcaaaaaaaaaaaaaaaaaaaacaagaacaaaaattttatttttatttctctttttcattatagcattatttagaagaatattacttaagtttcaagtagccctggggttttatctcatttttatttctatgagcatattatgagccaaaaatttcatattggcttatgagcaggtaatatgatttttaaatgttaactgtttcacagttgttaagatcttctttatggccaagcgtatgatttttataaatgttccttgaaaatatatgttttccttttgagtttataaggacctctgtgcctatgaaataagaggtattagttatataaagtagaagaaagcaagattggagcaatcaggatagagcccccagaagattccttgcactgcacttctcacatttctgcctgccacactcctcctcctcatttgttctgcctcccatgggtgaacttcatgttcctgaatgagaccaaccctctgctatgtaatggcttctatcccatcttacctgttcatggtaattcttcagttctgcccactctttcctgtagcagcagacatttctaacatactggattgttcctgtcagcatagaaaaatgtatagtttctcccatcctaaaatcccctcttttagccctgtgtccctctctctccctggtacctcatgttttcgtgtcatttattgcaaaacttcttgacagattatctaactgcattgtctttaattcttcccactccctcttcaacctgcttcaaccaggcctttcctgcctactaccattacactaccaccgtccacccctcaatgccttgccaatgatgacagtgatcctcctgtagataagcccactgggtaattctgagtcctcatctactttacttgacttctccagtgctgtccaacagcaatacgatgtaagcctcataggtgatttaaaattttatagtaaccacatttaaaaagataaaaagataggtgcaattaattttaatatattttatttgatccagtatatccaatgtatcatcatttcaagatatagtcagtgtaagaattcttgagactttatcttatttttatcattccaagtttttgaaatctggcatgcattgtaccctaccagcatatctcagcctggaggagccacataccactgggtgctccatagctgtgtgtggcttcctgccaccagttgaacagcacatctcagattctccttctcaagtgctctttccctctctttttgcccttgtaatgaccacttacatgcctatcttgagtgttaccttagtcagtttgcttatatattgtgtgcagctgccttgtgctaggtggtaggctagattctgctggtgcagtactgtatctgaatgtaatatacctagtcttaagctcgtgttgctcaagtcttgttctctttttcgcagtgaaactttttctgaggctttatttcctccctcctctcctttccaataaattagatatttttatacagcaccgtgtattgctttgttatagtccttatcacagttgtaatggtttacttgtgtaatgtttgtttaatgtctggattcatgttatccttgtttgctgctgtatatctgatacttggaacacagtctagcacctaataacttctcatacttcattcacttacatgccaggcatggccctgcttccttgtaatctggtggtggacaaggtggacatgatactcccatcctcatggggctttccttctagttataaaatagaatataaagaagaaaataagcaatataaataatgggattgtgctaaagggctatagtagggtggcgtgagagagtatctgagtgtttgatttagagtaggtgggcagtgccagcccctcttaaccctgttctctttataacagatgttttaaattatcttttgctatcctgaaattaaaattacagagcatgttattcccctactcaaataattttttaaaatctctatcaatatcttaaagtttagcacaatacattggaaggcactctagtcagacgcacctacttagtaaggacttttaattggagggagaacaatcagaagccactccatacaagtggtgtaggaaagtgatagggaaaagttatgtgactgaccttggggaataatgccagagtgaggcagaaaaacaattttaaaaaatataatttccataacctagatgtcttactgtgccttcgaattttttttttaattatgagatagcaataacaaggactaattgagatagtattcctcatttcatgtgtcaccaccaacataatgatgttcagctctcggtctgttggaaggcgcctccgacatcctctgttacgtacgtgcatgcagtagctacagatgcaaactgatacaggtgcattttgtcactgaccaaaataactatagcaagtcttgcccttggtggtgtcattctccaaaatggtgaggaactcttaataaaacttcaaaaacagcatagtataggattcccttgcattacgcgtaagttgcattcctggaaagttcaatgcagagcatactttgtggttttaaacagactttgtttctagagtcagatttttcagtgacataaatacacaccaggacatttgaaagccgtcgaggatgcaggacaattttttattgtgcaggaattacccatgcttcatgtgacatctagcagccttggttataaaaacaacccaccccctgaaatggttctaccccaacgaaactagagcacatatcatcaagacaagatcatgacagtaaattaggtcagagaggcaggcaggggtcaaatcatgtagacagtttgctcatagaaatcatgctatgtaaatcatgcaagttatgatgctttgtattgtacctttttaagcagaggagtgatatgatctggctttcaggtagggacattatatagtagcatggatgaagggaaactaggaaaaatggcaggactctaagcagaatatcatatggtggcctggactatagtgacaactgtgaagatgggaagtaaacacatgaattctggatgtttggagctgaagttgccaggacttgtggagaggttggataatggggaaagggagaagaatcagtgagaatgccttttttttttggctcaggaatcttgttgaatatgatcttttttttctcttcttttttttttttttgagacagagttttgctctgtgcagagtgtaatggcatgatctcagctcactgcaacctctgactccctggttcaagtgattctcctgcctcagcctcctgagtagctgcaattacaggcacatgccaccatgcccagctaatttttgtatttttagtagtgacggggtttcaccatgttggccagggtggtctcaatctcctgacctcgtgatccacccgcctcatcctaccaaagtgcagggattacaggcatgagccaccacacccggccaaatatgatgctttttattgaagtcaagaagcctggaggaagaacatgttttgagggagtacccttttaactatgttgttagtaatctcttgcagacatccatgtggtagtatgatatagggagctggatgcatgagtctgagttccagggagatgacagggctggagatggtacttaacgccccaggactgtatggtatttgttttgccatggcagaactagggggaataacagggcccacccagcacagagccctgcagccctttcacatttgtagattgagtaggggagaagccagtaaaaagaactgggaaagagagaccagtgaggtggaagaaaccccaaaagggcaggatgtcccagaggataagtgggaagaatatgcagaggggctgtgggacatgctatgagaagcctgggaccagagaatggagggctgcctgtggcctcccggggaaaggcaggagccctgcaaaacacatgtctctacaaacggcgcaggaagatgctttgctgggaagggcagcccagtgtgaacctctttctgaacaattccaactccgttctagtggcatcatctgttcgccatgcaatgggaaggggcattagctgacagagtggccttaaccaagcaaattgttttgaagaaatgtataggaatcttcacatgcaaaatgatcatcctcatgagatgctagaaggatggaagattcatgtatcttttatatgtatttttttgaagaagggtctcactgagttgcccaagctagagtgcagtggcgcagactcagcctcctgagtagctgggtctacaggcacagaccaccatgcctggttatttttttttttcttttggtagagaaagggtctcactatgttgcccaggctgcttgaactcctggcctcaagggatcatcccacctcagcccctcaaagtgctgggattatggatgtgaaccattgctcccaactctatctttttttctttttaagaaggagagtgtttattaatttgtgcagcagtaatagaagaaaaagaaaaaaaaaaagaagaagccaaagtttatgctacttaggaaaatgaccatagactctcctggcatggcttaagaggttattctgtattgggaagggccctttgggtacctactgtctccctagctacagatctccagttagtttcagaacttactctagcccagggtgcatggggattaatcccagatcccctctttctttgggaatgggagtagaatgttctctttgactaagaattccataagattcctcccaggctggcaaacgagtcaggccaaaggttgcttcaacttccctccctcctttatcttctgttctctctcagtggtaactgtactctcactcatccaactcatgtatgggtctcctcagcacatcacagagagcagacctgtacctgaccttgaagtgcaggagacagtctcatggctgctcccctggggcagcatggagaatctgtttttttccccagacctccagtcttagggaggatgtcttcaggacaacgaggatttcacagaacatttacagactctgtgaaatgagttttttatccgtagtctaaagattttacctttcctttttatagcccacacatcttgctgacttcactcaagtgcaaaccattcagtattcaaacagtgaagacaaggacagaaaaggaatgctacaactaaaaatagcaggtgcacccgaggtaaggaactgttacgttcatcattaagggaaaatggttaaatagggatgttttagaattgttgacttttttatgaaaaggatgaagtttttatggatcatcagaatcacaactttcttatatatagaaagggttacattagaaacaataatgattaaatgtccccaagaataggacaggagacagatttaaaaatcatccaagaacgttattgtaaagataatgatgattaaagattatcatcaggccaggcgcggtggcccacacctgtaatcccagcactttgggaggccaaggcaggcggatcacttgaggccagggttcacatggtgaaaccctgtctctattaaaaatacaaagataagccaggcatggtggtgcacacctgtaatcccagctacttgcgaggctgaggcacaagaatctcttgaacccaggaggcagaggttgcagtgagctgagatgacacaactgcactccagcctgggtgacagagcaagaccgtgtctcaaaaaaaaaaaaaaaaaaaaaaaaaaagattgtcatcaagtaccaaggaaattaacttcttggaattatatgtacagtcatgttttgcttaacaacaggtacgttcagagaaatgcctaattccctgatttctttgttgtgcaaacatcacagactgttcttacacaaacctaagatggttgtagcctactgtacacctaggctatacaatatagcctgttgccctaagctacaaacctgtgtagcatgctactatactgaatactttaggcaattgtaacacaatggtatttgtatctctaaatatatgtaaacatagaaaaggcacagtaaaaatacagtatagaagataaaaaatgttacacctgcatagagcccttaccatgagtggagcttgcaggattggaagctgctgtgggtgagtcagtgagtgaaggatgaatgtgaagatctacgacattactgtgcactgctgtagactataaacactgtacacaccatatacttaaatttatttttaaaacctttttcagtagtaaacattagcttacagtaacttttatattttataaactgatttttttcggcttttttgactcttgtaataacaattaattttaaatatattgtacagctgtacaaaaaattttctttttttacatacttattctgtaagcttttttctagttttaaaatgattttctgtgttttttactttttcagcttttttgttaaaaagtaagacacaaacatacacgctagcctaggcctacacagggtcaagagtatccatatcaccatcttctacctccacatcttgtcccactgggaggtcttcaggggccgtaacacacatgaaactgtcatctcctatgagaacagtgccactttctggaatactttctagaagccctgcctgaggctgttttacatttaactttttttttttaaataagtagaagtacattctaattaaaaaaaaaatagtaaatacataaaccagtaacatagtcattatccagtattatgtgctgtacataatcgtatgtgctatacttttataagactggcagcacagtagattttttttacaccagcttcaccataaacatgagcattacaacttcaggatggctacggcatacctagcaataggaattcttagctctattatataaatcttatggaaccaccattgtatatgcggaccatcattgaccaaaatgttgttatgtggtgcattgactatatatactgtaaactgagttaatttccacactgtgttgtccatgatattacttctgggtagaaattattatgtgattataatagttattattatatgattataataattataacagcagcagtacctgatactgggcacatgctacctgtggttctttacgcagaagccaagagaagctgtgtcattgtcacaaccaaggaagtagatactttgatatactttggttaaccccattctgtagctgaggaaactgaggcatgagaggttggccacatcaagtaattgacaagagatggggttcatacccaaacagtctggatccaaagcctgtgttcttaatcaacaggcaacagtgatttaaaacaagtggcatgagaaagagccatttggcaaatactacctaatgtggtcctttctgcaagatggacaaaatacactcgtgtatgaaaggatctggacagtctggtggcacacacggttgtgctggtgtgtaaagcatgttttttgaagctcatctgtttccatcagcacaccaggattctttggtctgttaacggccagttctctgggtagctttatttgcagcactcctcacttaggctgatgcctcgtcactcttctgccctgtgattctgtgagtttggtgacatctgagggctctaggaactcttgttgattctggagattaagcaaatattaccaaacaatatcaaattttatattggaaagagaatgatttctaagcccttgggcgaacatgctatatgtgctaaaaataatgaaattttattaattttcttttacattagaaattatgatggatggttgataaaaaatttactccacattagtttctgatagaagtcatactttaacttactgattgtctaaattcttcccttaactggagtatgccagaggggccagacactctgaaggaaaatacttttttcatctcttttgattctagaaagtgagccccagtttaagtgatttttctgttttcatctgggtttgcatttgtcacatattctaggaataatgtccttaaatatcagatttcctttctcaaatctcatgacaaatcttgtttcattcccactcttctctgttttcaagtgtatagagatgtctgatgtcatagcacagctgtcctttgcttactgggaagaacaatgaagtctgttttcttgatcttttctccgttagcctctgacagtgacggcaccatccctaaccattgcggagaatatggctgacctaatagatgggtactgccggctggtgaatggaacctcgcagtcatttatcatcagacctcagaaaggtgaggtgctgtttctgagcattcccaattgcgcttctaccaaatatttagctgtgcttgcccctaacagcctgttatcctcttttaggtaactgtaaaaatgaagaccaaatgaataattcagctcagtataatctgaggacttatttttctagggatggtgatccgtttcacaccttccacaagccaagagctgggtttgaatagagcctaaaaaaaacattgtctgtgttttgagctacctacttagaggattttctaaattgccattactatttttaaatacattagtatttttaaaattttgggtttaaataaaattctgggtttaaaaaaaggaatccgttataactcactataaataaagtgtcctttctactttttcttatatatctcaaaagcttagagcattcaaagaagaaagtacagtctaagtcatgatgttaaaaaatcaaagattagaatgaataaatatcctagaaacgtcactataaaagcggtgtggagtttttgcaagcatataatgaggaatgcttttgaggatttggatttctgaaagaatcaaatgaaaatattcccagcaggataatagcatacatagtgtgaagcagggaaagactgagtttgggaattatgggacttaagttcaaatcatgagtcctctgtgacaccatctataaattacttttctgagcctcagttctgtcatctggtcaaacacgaagaacagtaactgtcttctatggtattaggaggataaaggacttatttataggcttggaactatgcctggcacacttgatgctcctagattttagttgtattgttgttcctgttgttgctactagttgagtctgatcttgacactgtatcagcctagactttgagatacctcatctgtaaaagaatgatacctattttgtagggttgttagacacctcccaaggagtaactgtaaagcagctcacgctgtggaagtggggactctgaatgtgggttttgccaataccccttctagcactcacctcagtgactaggatgattatagaggaaaaaaagtcctgaagtgctgtgtggagtgcattcaagtcagcagaattgtattaaacagcgatgaggatagagaaaaggccaaaggtcaagtgaagcagatagaaacgcagaggatccagccttgcccagcagggaagtgctctgtttacaaagcagtttgaggaaggcatggtgtttgcatgggaggtacatgtgagtgttgtgtgttttatagagaggagtcattggaccctttatttatgtatctcaaaagaggtaactgatggtgctgtgccctgaaaacagcagctgaagccatgagccttcgctaagtaaacataaatctgtgtgattccaggacatggcttttctaaaggaaaagtgttttcccacggtgatcacaccaataagcctattcatatatttttcctaagttttctttgtataaaatagagtaatgaagttgctttcagaaatctctacagttactctcagttaaagcctttgcagctataggtcttgatttttcactttgtgctttattttttatttttatttttgacgttttcttcttccagtgtcgcactttatactttaaacaggagtatatgccttacaaatattatttaaatgttttcagataatttctttacataaagatagtaatttaggaaaaatgttaaatgtaatagattgcccatttcctttttagtgaataatttttcatcttttatcttcagtttaccaaaaggtccttgacatacacatttaaaaataacattcggatgtcaggcattaaatgagccttccatgtttaaaacgtaaacatcttcctgtgttgatttcactattagctagcgttttttgctctctagggagaaacatttggatatcaaacatgaaatgcgatgctttttaagctctttgttcatatgaaaagagcattaatgaaaatgcttgtcatgaaaagctagatagggcattggttgtttccaattttatattgtctttataaaatgaattattaaacttggtaattttcttattctcaatcatagcatgtttatgtattatataactatttcatcatagatccctaaggtgaagatacattgcctagttaaaataatattaaagtcaaacatctttagtggattatagtcaaaaatacatgtgaacacagcacatgtacattttttaattgagattttttaagagttcaaatgttaaacatgtttctgcaactctaatgtaccgttttcctggaaacatgctttaaataataattatatatgcccatctgtcttctctagatcataaactacttatacatgtatacatgtatatgcataacatagcatgacagtaataagtgatcagtacattctacatgtgaattgggtgtgcccagatgcattttgttagttctttgatctaccatagttactttggatttataaagtgcttttaaaagggatgttaccttgtcatagtggctcatgtctgtaattccagctacacaggagaatccctgaggccaggaatctgagaccatcctgggccacatagcaagactgtatctaaaaaaaataaattaattttaaaaaataaaaataaaaggtgattttcctggggagaacatagtaagagccacaagccaaattgtcctggactgcattccaccacagtctgcataaccttggccctttctgtagggcattatctaacctacaccttacctgaaagaaagtatacaatcaattttgcagtgttagtaaaattctgtagtaacattttttcagaggaaagtgtatagtgtaatatagagttgtaattacataattgtaagtaggttttctgtgtatagaatgatggtgaatactgtgcatttcaagggagggagtgaatgcttctaagcatggcataaattccagaagacataaaaatagaactgttacatttaattacataattaaaacacttatgtgctgctgaagcgacacaattacataattaaaacgtttcgtttagtacaaggtaacatttttaaagctatgatgacaggggaaaatattatgacacatataataaataattaaaatttctcatttttcaagtgttcttccagctcattcagtaaaagacaacctagtataaaaaagaggaatgtacacacaaatgtccagtgaatatatggatacagtgatatatttcattttatgtttattacattgattaaagaaacctgataaccaccactggcaagacttctggagaatgccagaatgactcatgattgtgtcattgtaaattggtacattttcagaagacagtttaggagtactctgcccatttgtctgcctcctggaaatcagtcatacaaaccactgacctgaggaggatattcactattgcagtgtttataatagcaaaaaatgagcaaaaattaataaatgagggagtatgcatacatgatgtaatactatgcagctgtttaaaaaaatagctctattaatgtattaaaaacctacatgtaaatgtgtgtgtgtgtgtgtatctccaaacttgtgtatttataagcattaaaaagtctggtaagttaagtcaccaatttcagttaatgaacacttctaagaagaatggaagtacatttgaacaaaaacattaactcccagaattagacattttaggtagtgagtccttagggttttcttaaatgctgcttctactgatggtgtctgttgccatttttctgtattccattactctgtttataaaaatattctctcagaatccttctgttgtttatctccttctttacagctgcctttctacccatgcccagctacttagaaagtctcctgttaggcaaaaatataataatggattcctttttctttcaggaaatagaaatttcaacagaatacaaacagaaatcacactaatgtgtcatttgaaaggctatattattaacaatttgggtgtgagtaaagtgggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgttattgctaatctttacaagaacctgaaaaatatgtggcattctggctattttacaagtatgaaaattaaagagaaataatttatgttaattttcttgtttatttcctaattttatagtgggcatgttgatctacaaaactaaaagaatcgaatagtaataccaaaagaacttatataattttatattctcagccaatttgctaggaactggggactaagatatgaatgttaaaatctaaacaatcagatacataggtaaacacacagttatagctgtgtggtaagtgctttcagagatatttacactttccaagacactgaagaagaacagtgagcctaagaggccactggaatagagagggtgaggcctgggctttgttctgtccctctccttcttctccatagccagtcccttactatttcctccagttccatgttctaaatggatccatctgcttcactgccttcccactgtgtctcccccgtgtttagctatctgggctacccaagtacacttctgtgttggggttccccaagatctaggagtcacaggactcagctatgatgtattacagcaaatggatacaaagcagaatcagcaaaggatgaaggtgcatggggtgaagtccagggaaaaccagatgcaagcttccaagggtcccttcccaatggaggccacaggacactctgaattccccagcaatggattgtgacgacctgtgtgaaatgttgcctactgagaaagctcattagagacttggtgcctagggtttttattgagggttctttttacatgcactctgtgcctggcatgcatccaaataccagactcccagaaggaaagcaagagttcagcataaaccacattttttgtacaaacattttaggcatagtgtaccatacctgtcaggggatggtggcaactctgcgaaaatccaagttcccagatagcaggcaagggacaatcatgtaaggtcagtcacaggcctgctacattaactcttttctgtgtacttctactaaatcagtctctgtccagttttgctccttagcctgtccgtgctctgtgctacagcttgaggaagctttcctaattaaatatcttacatgacctactcttgctcttaggatactttgcaatattcttaacctagcttgcaggagcccgtgtgattgtttcctgctcacttctctaaccttggtttttgtcactcctcatactattcttcaagtacatttacctttttttcaattccaggagcaaacatcctgtcttttgcctgaaggcctttgccaatattctgtctttgcatgatccactcttcttccaacccccttttcgttgctaagcctaactcatcttctaggtcgcattctacatcacttcctgtagaaacctcattgacccacccccaagccaggagagcatccccatcatgttttcctgtaatagtttctagttattaattaccagagtcctaaacatgggcttttaacttgtctaccctccccagccaacctggcaagttgctgacagccagggtcatatgcagtactgtgggcctcacacaggcaaggtctgcatgtggctagtgcacctctagctttggacagtgcactctacagcatcagcagtgtctgatagaggttcatttggggtcatatcagggcaggaactgatgtttatttagagtacctttagttgtgggaagttaagggataattttggattaaaatcaaagctgggcaatgtggcatgttcctgtggttctgaggctgaggcaggaggatcactgaagcccgggggtttgaggctgtggtgtactatgatcatgcctgtgaatagcaaccacactcgagtctgggtgacttcgtgagactccaccccatttcttaaaacacagacacacacacacatagaggaatcatgaacataggtatgaaagtgagtgaggaaggtagtacattgcaagtgttaacagataaaggaaactaaataaatgaagcaaactttacaagagtggaatttccacaaaccttatagcagcaggacaccattattgctgttgatcagataagagctgaaatccaagctatcgtgagaaagttgcttagcaacagcatacataattgtggcgcagacaagggaaaaccccagtgttttggcagcacaacagggaaggaaatgatgtaatttattgatttaaaatgtgtgtcctctgactgcccaataaatatagttcaaagataagttgtgataaatcatgtagcgcaatggaagagaaagtaatgagttgttagaaaacaactttgattaaatttttatactaaagatataaaatttcaaatatttggagaattctgtaaaaggaacacaagtctatggctgtttgctgtgattattatagagattatacagtttcacattaaatagttgtagtgcttcgaaacgatgtacaagttgagcatttctaatctggaacttcaaagttcaaaatgctccaaaattggaaactttttgaggaccaacatgttgcagcaagtggaaacttccacacctgacctcatgtgacctcatgtgtaacaggttgcagtcaaatatttgtttcatgaacaaagttatttaaaatattgtatgaaattacttttgggttacatgtataaggtgtatatgaaacataaacagatttcacgtttagacttgggtcctatcccctagattcctcattttgtatatgcagacattccaaaatccaaaaaatctgacattggaaacactcttgttccaagcattgtggataagagatattcaacctatactgttttaaatgtcaatatttcatctggaaaaggttttctcttataaaaagatcaggtaactttgacatctaaagactgtgtggctccttttttccctgtgttttgtgctttccaaaagttttttaccaattttttaaacggcaccaagacttttggccaaaattttattttttgtgggtaaatatgtaaaactagtgttaaaccatgtcatgaagcaagtagcaagatacattgagattacttttttaagtatgtaggtaatagtacatattaatgtattgcttgataattttttatgtgccataaatttgagaaagaccagtcatactgtagtatttcatattatgttttagagagcaaaatccacttccaggtgtatgttttttttctcataactttaggggcaatcctttagtgtgtagcatttaaatttatatttttatatttttatttaacccattcataccagattaaattgtattgcattgttttaaattattgtcaagagtatctttctcagaacagttcaacattccttcagttgtgtattttaatttgtgatctttaaagcattaaagcagcctggctattttaatagtagaatccaatttttaaagaaatcacgtatctaaaattttgtcttcctcatccaaggcagttccccacttgatgaggccgagttgcggggtcctggggaaattgcagggcttacagctttgctcttgtctgtcacaggttggccaacagcgaaaagcaaggcatgcggacacacgccgtctctgtgtcaggtaaggggctctaggtagcagacctcgaaaagcactctcatggggtaagacgatcatagatgtctatttttagtataattgcttcgttctagaatagcttatgaaaataagcattctggctatccaaatttgcataattttaccatcattaaatagttttaagtatggctcatagttttttttttttttttttaagatgggacatagataaaataccagatcactcagcaagttgtatagaattccaaattatttttgggttttaatatcatgttaatcttatccagaatgaagttgccattataatttatcttgcaattcagtagaatatactttgcatatttattttaagaagttcaggaaatgtgagacattttaaaacaatttttgtctttcacaatatggtgtttgagtattgctttttaaaaaatatagttaagattctggcatgagcattgtcttaactatttgctggtgcaattaagtgtgttgtactttccttggtatgtttcaaaatagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaggatgagaaagcatcttctgtgggcccatttgatatcttaaaatacatataccatctgtatatgcacatatatacatacgtaaccatatacacacatatgtaatttgttcttatatatgtgcatacatatatgttacatttctgaaataatagtttccttttaactttagcatctcacttagaaaagacccaattcctgtttattttgaatcagttttttttgagacagagtctcactctgtcgcccaggctggagtgcagtggcgcgatctcagctcactgcaacctctgcttcccaggttcaaggagttcccctgcctcagcctcccgagtagctgggattacaggtgcctaccaccacaccctgctcacttttgtatttttaatagagacagggttttgccatattggccaggctggtctcaaactcctgacctcagatgatccgcctgcctcggcctcccaaagtgccaggaattataggcgtgagccactgggcctggcttccttgtttgtttgtttttttaatggtgcacaaatgtcccataagcccttactcaagaagtatttttgcttgtatttgtacacttggcagagatactcaataaaggtgaatgatgtgttatactgtcaaagtactactgcttgagaaatcattgctcacttcctaactaagtagagagaaggttggaatgctagagctggtcttatggaagcttcggggttgccagcatgttctcaggtaaacagttaatcatccttataagcttaatcgtgacttcttggagtagccctagtttccagtagtgacactggggcagtaaacagcactcagcatttgcatttgttcagtctgtagtgggtacagagaattggcaaacttgccaggccctcacggagtttgtaatctagttggagagagaaagaccaccacacatgctacagtcacaggagtctggaggagggagcaactgctgggcatcaaaggatgttctgcaggatgttctgtagagtaggtgagatttgagcagggctttgaataactcgcaggccctttggtccgtcttcttgccaaactgtaaagcagcttttgggatgagccccggggactgcccttttggtgcttgccacacactgtctccacagtctccccaggcttgatcaagagagaagggaaatgtcccattatgttaataaggactattcctggcatctgtctttgggtaccaaagtaatgaaatgtaataaaataggccccagcagtgccttcaaatcttgttcctcctgttttactaatctcttttaatcaatactctccattcaaggtttaaacctcagatgtgtcttttagcagctggtcatcaccaaacttggattttacttcttccagccaacccccactttatgatctcagtgttttcttcttatttcagaaccccattaagaggaataaagttagctggcattttatgagtactgtgttccaggctcaggtttaagttctatgttcttgtacatgtatcatctcatttagtccttacaacaaagggcctataagatagttttcttgttgtaaagctgaggagactatgttccagagaggctaaataatttgtccaaggttacatagctgctaaaatctggagtcattattcaaactctaatgtctggctttaacacccccctgaattacttgtgatcgtgctttcattttttcttcctaggtattccgtaactaggagttcatacttcagtaccttctccatgctcttagattgctaccatgttgatttaaataggcagttctctggtcagaaacttttagtaatcatttagtatccatcagatgaagtttgggctcctcagcttagccctccaagacctttcattatctgcccaccacccacttctccagtcttccctcacctcctcatctacattgttttttagccaaaaaaaagttggtggctgtggctctcccatcctccttatctctgttgttctgcttgagctgttccatccagacttgctcttttcatcattacatataaaaatagtttcactttcagagttagtgatacttcaatatatgactatcacttaggtgatttacaaatccaagcaaagaataagtggtgtccagtggatatttaatgacatggcattaattgttcggagtcctgtttgtccttagtcattcccctactgcttgcttacttaggtggaaccagagaaacaagtgtggtatatttcttttcttttcttgcctgccggccctccctcccttcttcctcccatccttttttccttctgtcatcctgacattcaatggtgtgatatgtttctatcttccacaaaaccataaaacctaaaaactgataagcctagctggccaggaaccagtacattgcacttagccccagagctggtaattcacatttctagggacatctttgttaagccgatacctagaaaaacggtaatcttactaaatcccagggttatttcttacctgccaacctggaaacaccgtactatgtgggatgtagtgctgacacaccaaggtagaggccctactgctcctggatccttgtgaaattctgcatgtgcttctccacagtaagcgtgttcagtgtctaggatagtggggtgaggctgcagtcaactgtatgccagctgcaattacttgtttttctgtcatacgatacttcatttaacccctaacaagccctgcgggattgaagagacctcagttttacatttctgttttacattaatccggccaacagatagttcttgagtgcctgcagcgtgctgagcactattctagatactggagtctgctagaaaacaaagccacgtccctccctttatagagtttacattcttggtgaaagagtcaaaccatagatagtgaattaaaataaagcagatgaattgagagcaacaggaaagttatttaaaattgtgtttctgtatgacagtaaacctgcacatgtattaactcgtgtgggattgtaaagcccttcataattgttaaatattatttaatcccacagtggccttgcaaggtatttattatctctccatttcacagatatgaagaattaaattcagaaaggtaaacaaacttattcagtgtcacacaggcttgaaaatgatggcactaggatcggaactcaggtcattattaccctctaggctctattgcctgtcatgagcaatttgagagagtttgctcccctgtactgatgaactgttacactcccaagtgtcaatgaagatggagagtcttcatgggatttgtctggctctcccatttttcttcacaaccaaagagttcttacctgacccaagtctgggttcatatgtcagtacctcatagaaagctttcctgagtactttaagaagatctggactcttcctcctcagagctctatagtgcactgtacatttctctcttatgcatagtcctaaaataaatgtcattgtgttttagaaaccatcttgtccacaaaaccatgaacccattgcatgtaaagacatgttctgtttatctctttattgtctgggatataagttttgtaattgtttttaaataaatccatgaattcctgagtaaggtatggaggtgtgctgggtcttagaggaatgcattctgggtagcgggaaccgacagcagaaaggcaggaatatttggaccgaccagtgtcactggggctctcaagggattacctgtaagcttgtcactgtaaattgttcttgattttttcctaggaatcattataaatggttctagattccttcctaggagatgttgggcaggggtagagaggataaccaacagaaaaagcgaggatctagataactttaggacagtttgtcgctctttgtgggtctctcttgttggcaaataaagcaatatccttacattccggagagaagataccaggtactttttcatattttgttgcaaaataaaggtagttattggatcaccttcagtaagattgcagtgacagttgatgttgaatatatgaacagtgtatctttgaaattcacacagtatttctctacaaaaataagtgtaagattaacagagatttataaaaatatctaacagaacaacatgtgtccctgcctgtattgttctgagaacctgtagaagtcttttttttaagcctaattattaagttataaggaaacttgtgcttgttgtggagctcgggtacaacttggaacatatctgaaagtcaggtgctgcagtctatcataagggacctgtaagtatgctgaaagaggaggtgtggcctctgtggggagggagtgcttaaccaatggttgtgtgggttaaaattaccctagaaatcaggtatttccaaatcaatgagtaaagctgtattttaaatattttgaaggtataaacttgggggttttgtttggtggattattgtgtttgggtttttttttctttttcttttctaaaataacgaagcccttgatcaagcagtaaaaccttaattatgaccagaagtacaagataacacatgatagtaataccattgcattatgcacatggctcttgttacatgtttggactacacatgtggcactagagataatacaagttttctcatttgtatctctgtcatgtacaccaatgcagtgatctttttcaaatgcttggtttgattgtctctaagcccttcatgctaaagggcaattatactactttgtgatagtttttttccccccactttgtcacccaggctggaatgcagtggtgtgatcttggctcactgcaacctccgcctcccaggttcaagcctcctgcctctgcctctgcctcccgagtaggtgggactacagttgtgcaccaccacgcctagctagtttttgtatttttagtagagatggggtttcacaacgttggccaggctgatctcgaagtcttgacctcaggtgatccacccacctcggccttccaaagtgctggaattaaaattagtcgtgagccaccacgcctggccctttgtgatactttttcagtatttgttgcaatttaaataaatttttaattttctaacattattttggttcagttgtttatcatgcaacataatttcctttattcaagattacttttaggtttttcaggttagtgactggaaattattctgaactattaaaacatttaatgaaataaatgttatttgtattttgtattaagctgcttcattacaaattctaaaacagctcacttgtatatgcaaaggtggtttgtaaactgtaaagttctataaaatataaggtggtatagtctataataattactgcattttatctctttctgtgtggtctctgatacactagatttgttacctattcatgactatgccacttataaatacaggtagttatttacatatgcatgtgtcttagagatcatgcctggcccatccacaggcatcattttgtttaaacctcatgagagtcttcgtaatattttcactttacacataaagaaataaagacactcggagctgaagtggtttggccaagttcacatagctagtaagtaatagcctgatggaaatcttgatcttggactagaaggtttgttctctttacattagaccatattgactcatttctttcttttttctggagacatggtctccctctgtcacccaggctggattgcagtggcttgatctcagctcactgcagctcaacctcctgggctcaagtgatcctcctgccttagcttcccaagtagctgggactacaggtgtgcgccaccatgcccagcaaatttttgtattttttttgtagagacggggtctccctatgttgcccaggctggtctcaaactcctgggctcaagcgacctgcctgcctctgcctccgaaagtgctgggattacaggtgtgagccactgcacctagcctatgttgactcatttctaaagcttgataatataaatgtgtggaaggaaataatactttgaaagagtttgcgtgtgattccattaaggttttttcccctcatttattaggaataggatagtgctgactcagttccaactctcagaagtgtgccctgtattcaagtttgaaaaaggttcttctgtctagttttacactctagtttcaattttgataatgctgtgggtttccaaggtagtctctatctgttgctgaaagcttgatttaaatgctagcttttaggaattaaaaggggaaagaaaagaaaaaaaaaaaccttgccctaatttgagagcattgtcacctattatataagtagttcatttttttccctaccaaatctacgggacactgaaaaaattaaaaagtaaaactaaatttaggccaggcacagtgcctcacgcctgtagtcctagcactttggaaggccaaggcaggcagattacttgagcccaagagtttgagaccagcctgggcaacatggtgaaaccctgtctctacaaaaactgtagccaggcgtggaggcgtgtgcccatagtcccagctactcagaaggctgaggtaggaggatctcttgaccctgggatttggaggttgcagtgagctgagatcaccccactgtactccattctgggtgacaaagagaggaccctgtccccccccccaaaaaaaaaaacaaccaaattttaaaagataaattcatttttgtaaattatatgctttgtgacataatttaatcaaattaatgctactaataatttttatgtgcacaaagtagtaggtattgaatgttattgatctgttcctagtacctggctcactggaaattattctggtagtcagtctggtattaggagagactccaaaccactgagaagcgtacagttgtcactgacttcatatggatagactggctgatcgtgttgtgcatgaataaggaagtgaacaatcaaaatagcccagctgtgctgccttctttccgatagccctccctctcccaccattacatcattcgaactccctttgccactgttgagatcggggtgttcttcgtagtcataccgtttcttctctgggttctaaagcagttgaaaagaatacttggaggtcatataggttttgaaatatcagcatcgtatgttgtaaagaagtatcctgaaaaaggacccggaaccactccttcacccttgagctgaactcgtctcagctgcaggcagtgcagacagtgcagacagaaactcacagacctccctggcaaggggtagcctgaggcactttcaaatttttaaaaaggccaaatgaaaagctgagcaataatgagtacaacaaaaatttaaagtggatttttgtttttataaactcttcccagcccacagaaatccagctcagtcttataaattttgtttccagaagagagtattcccatcttctcccaagcagcccccacgctataaaggggaaaagactatatgagagtattagaaacaaaaatgtatttttgtctttataaaataaatgcttcacagttggcagtattgggtatacttggcttatgaaccatcttgatcctctggcgaaacttattaacaataattaataaacttctcaatctttttaaaaaaatatattattaaaacacaaaaagcccaagtatcatcatcttaccaaatataaaataaatattgctaacatcaaaaggcccagttatttttttctttgcagaaaataattttaaagggaatgcttgaaagtttaaaatataaattctagagtttgacctcaagtcttcccccaccccgtttgtagcttatagctatacaataattgtggattaaaatcaaactgcatgagtcaagacaaaatatttttgatgcctttacaaagaggagaccatggaaatgaataaatattaagtacctactatgcttttgaattttgagtttttaaaactttttatggaaaatttcaagcatatacagaaaagagagaatagaattgtatcatgatttttcgtatcatcatcacccagattcagcaactaaaaacttctggccaattttatttcacctctgcctctgtccacttacatacacacataatccctattggttattctaaagcaaatcgaaggcatatttcacctgtaactattcctaaaagatgagactttttttacaaaacattatcagctatccagtcagtgttcaaatatccctgattgtcccattttcatatgtggtttcgtctaaacaagaatcagacaagaagtactttgtgaatttgcttgagtatctcctgtatgtgtcagctagaccttgttggttgattgttactagttgcaattactctgttgaagaaattgtgtcccttgtcctattctcatattctggattaggctgattacatctctgtgatgctgtcttgtttaacctattcttttctggcccgtttatttcccatcagctgcttgttagaacctaaagaagtttgatccagtttgggcttgattccccccctccccacaacaagaatacttcttaggtgatgtacatctggttgttctttgtgatgttaagactaatcaatgggtttaggtcccatcactctctgatccatacatgagaacgttcccatgagcatttcacctaatagttttagcagctgttgacattaatgcttagatttcatcagaggccacaaaatggcaccctgtgaatcctgtcatttcttctccctttgtttagctggaatgcttctagagacagcgttccctcaccagctgcttcattaccctcgggagcaggcttctcctgggaagacaggaactgcctttttcttttcctttatttaccagtttttaaaatagtaaattataccttgctagtcagatgtcattctttgagattttctttttaaaatatcagtatgaatttgtgtgtttttcacattgttggaataggaggttcccccatgaccaccccaggttggatgattactgggaaacctgtttgctggaacacagagttcggtagtgttcagctttgtcagcaccacaccctcatgcccaaggagaagaatagaattgagaggtatggtcaaaggaaaatatcgccttacttatgtaactagaaataaaaaggaaaatgctgatccagttggactaatctcattatgctctttatccctattcatacctgttcctccagaagccccagactcccttgttgctggcataccctctgcataccctctgttttgtctttattgctcagtttcccccaacttctaaaacactacacctctgtcttctgggacttctctatatattcctctttgtcaccttcctctaactaaaactctggagggcactgataccccttggtgcctctgtaaccctactgatggtgtctgagaaccatggtagcactaggactggagatgaggtaagggtgccctgattctcattgccccttccagactactctccctcaaaaacatgagctttgaatctcacatatcagaacaaggctgtcctatgttcctcaaagttctgagcacccagttcactgtcagtgctccagcatcccccatcgtagtttgggaggatttcaatattcatggtaggcaattcctccagcatgtcttctttttttttttttcttttttttttttttccatcgcccaggctggagtgcagtggtgggatttcggctcactgcaacctctgcctcccagtttcaagctattctcctgcctcagcctcccgagtagctgggattacaggtgtgcgccaccacactcagctaattttttttatttttagtagcgacggggtttcaccatgttgaccaggctggtctcaaactcctgacctcaagtgatctgccctccttggcctcccaaagtgctgggattacaggtgtgacccactgtgcccagccccagcacctcttctctccattcttccagtggtgctgtctgctatttctctttcctgtgagacctacactttatctacaactataactctcctataatttcaattttaagaaaaccctctctgactgccacctccaatttttctagcttgtccttgatcccatccccattctgctgtctacatcacatttttttgtcttctctggtttcttaacaagcctaaaacccctgatcaataattgtatccttccctggcctacatccccatcatctctgccctactcgtttgtttggttttaactcacttggccaagttaaagccagctcgttctgtcccatgtctgctgtagcacaactgaaccgtaaagcgaatagcacaaccacattgctttggtcttgctttcaattccatctcacagccactttgaacctttccttaaacctccagcatttgccagccataagtgctgcctgccttgatctcacaatagatgacttgtcctcacccagttagatctactactttttttgagacagagcccctctctgtaacccaggctggagtgcagtggtgcgatctcggcttactgcaatctccgcttcccgggttcaagcagttcttgtgccttagcctcctgagtagctggaactacagatgcctggctaatttttgtattttcgatagagacagtatttctccatgttagctggtctcaaactcctggcctcaagtggtccatgtgcctcagcctcccaaagtgctgggattacaggcatgagccaccaggcccagcccaattaagtctaatttgttaccagtctaccctctatcacttgttacctggtcaggaattttccctgctctactactgttagttttttttcccaacgtgcagcaagccaatcattgtggcaacaggttttgccaaaggggaaagatctcattcccaaggctgccgtgtgaggagatgagagaacaaatgtcaaatatgcctctccaaagatgaagttttagggatatttatgggatagaggagcagggcagttgaaggcatgggaaaaagtgattgggtataaggaaaagtgagttaataagtgatctgcccacacatagtcaggcttcctgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccagttttggaggtggggcctggtggatggtgcttgaatcatgaggcagatcccttatgaatggcgtgggccgttcctttggtgatgagtgagctctggctcttagttcacattagaacctggtcctttgaagtatgtggcttttccccaccccaccccttgctcttgcttttgctgtgtgatgtgcctgctccctcttcaccttctgccatgattgtaagcttcctgaggcctccccagaagccaaaaagatgtcagcaccatgctttccatgaagctggcagaactgtgaaccaattaaaacgtcttttctttataaattacccagtctccggtatttcttgatagcaatacaataatggcctaatacagcaaacaaggcaggttaagtttggcaggcttaatcaggttagctctggtttcattagcacatcacccactgtggtttccccgccttagtagcccccttctgacatcactggtccgcttatgatagaagaactctttatgtgagttattgcgattcagtgttgctccttattgaaattgccctgcttttgcttccagaataccatattcttcctacttcactcattattcagcacttcgcgcctgaggatcccaggactcagttcttctgacactttgtgtcagccacagtcacacccttggggatctcattgtgtttcatgacttaattatgctgctgactctcagattgttatcttagtttttcagacttctttcttgaactccagacccgtggccactatgttctcgccatgtggaatctgatgtctcataagcatttcagacttaatatactcaaaaggaactgatattcacgccaagcctgcttctctccccttctccactcactaaatggcactactttccttctggctggtcagattatccttggggttatttttgatgctattctttgttttcttctcccatatccaatctattaacaaatccaaattgctcctgcaaataaactctgtacttatattaattttgcctaagttttttcctttagggtttacactgggaatatatttagaagaccaagtcatagattgaagttgtcctatataggtactctgattagcagcaattacaagtggatttgtaaaggaaaaaagaacagacagttcttaaattgtttaccaaaaattggcattaaaataatgtaactattggccaggtatggtggctcacacctttaatgccagctctttgagaggccgaggcgggcggatcacctgaggtcagaaattccagaccagcctggccaacatggtgaaacctgtctctattaaaaatataaaaattaaccaggtgtggtggcggatgcctgtaatcccagccactggggaggcttaggcacgagaatcacttgaacctgggagccggaggttatagtaagcaagatcacgccactgcactccagcctggatggacacagcaagactctctcaatgagaataataataataataaactattgattgtccattgttctttatatcacagattccaggaatgtgaagataatattttagtggtttaggtgcaggggcgaagatacccttaaaaatggtaatttcctttataggtgtaaatttctctgacagaggatttcaaaataagcagctaaatgtcagaaagttgtattttggagactgatttattttgataggtgtccttttcaacttagcttgttttttaattagattactgacttcaagttggagccctttaatgaactgggcaaataaagcatttgcagttttcagggcctagtatttaaatatttgaaaagcaggcatagctggaaggcccagcataaaaatcaagggcctggtatgggtggctcacacctatagtcccagcacttcagggaggccgaggcaggcagatttcttgagcccaggagttagagaccagcatgggcaacatagcaaaaccccgtcttaaaaaaaatcaaggaccccactttttgtttttgtttttttttaaggcagggtctcactccgttgtccagactggagtgcagtggcgtgatcttggctcactgcaacctccatctcccgggctcaaacagttctcacacctcaccctcccaagtagctatgactacaagcacacaccaccacgcctgactagcttttgtatttttgtaaagagagtattttgccatgtttcccaggctggtctcccaactccagagctcaggtgatctgcccacctctgcctcccctagtgctgggattacaggcatgagccaccatgcctggttcccacttttacattgaatcctggttcccccgaaagagggaaataccatggtgttacctgaaaggagttctgatccagaccccaagagagggttcttggatctggctgaagaaagaagttgaggcaaatccatagggtaaaatgaaagcaaaggaataaaagaatggctactccataggcagagcagcagtgtgggctgctggactaaggatacttacagttatttcttgattatattctaaacaaggggtggattattagtgagttttctgggaaagaggtgggcaattcccagaactgagggttcctcccctttttagaccatacagagtaacttcctgaccttgccatggcatttgtaaactgtcctggcattggtgggagtgtcttttagcatgctaatgcattataattagcatatagtaagcagtgaagatgactggaggtcacttttgtcaccatcttggttttggtgggttttggccagcatctttaccacaagctgttttatcagcaaggtctttattatgacttgtatcttctatcaacctcctgtctcatcctgtgacttagaattcctgacctcttgggaacgcagcccagtaggtctcagtcttattttaccgagcccctattcaagatggagttgttctgggtcggatgcctctgataataggaccacgctacacaatgttccacagtgttccatgctggagagacactcctgtgatgctgatgggtgacccaacaccaatcagcccattctgccatcttccataggagtcttacccgttggtggtgagtgtttccttagcctccaagtgttcaaactgcttttcttatctaaatgtgtagagaagtaagtagccctctgcagttataaccattcactgtgaccactgtcagccactccaaaactgcagcttttgctggtgacttgccaattgatcacacattgccacacatacaaagttcaagttctccctcacagtatggagtaatccctgtaccgcaaaagccaaagagaacaagtaactcagtacaaaagagagcagagaatgagaagagtgacatcgtctgtcatttttcaaaggcttcctgggagccttctaaaagggaataggtaggattgcagtaagctagttgagactgaggtaaatctgaaccagcgtaatcacatagaaagttggactggtgagaaaggaaaagctgctcagagcagcctgaggtatgtgaggtctgcaaaatttatcagtcccagagaggcaggagtatggggcttcagtcatgccctcctcacccctatcctgcacccgggcccggagcaattgttgaaaggcatttttttcttgactagtggccttacccattatcttcacattcctagaatttgtgaaacaatgtaggaactctctcttttcctttaaaaggaaacaatattctgaatgactcttgacatcatttagaataaaagccagtgcccttaccaggagctaagaggtcttagacactctgggacctcactgagtgcatctcagtgccacctcccccttcccactcccaactcttcatccacctcacctgacctccctgctgctcctcagcacgtgttcacactgacctctgcagagccaaggcctgtgtgtgtgctgcctggcctcccctgatgtgtgcatggccctttccctctcctcctggaagtctttgcagatgactccctccataatcaccatatttaaaatggtagccccacttgaaaatattccttctgctggtttttccctagcacttacatgttgacatgccataaaatttacttattttatcttccttctcccttactagaacgtaagctcaataatttgaaagtttgggtttctattttgttcactgttctaactccagcacctacatggtatgcctagtttatggcaggtgttcaataattaaaatgattatcttgaatacaataaaagtcctaatcctttttgtttttgtttttatgatgtgtgataatattcttggtattactcaaaaagagttgtacttttttaaaaaattcactttttaagttagtataaagaatattcagtccagtttagaaatgaacagtagaaaagtaagaagagctagcacttgtggagtggtcactctgttctgggtgcccagagaatcccatggaatcctttcccaacctccttaatggaggtagcttctgttataaccccattttacaataagaaaactaagcaacagaagttgagcagtgtatccaaggtcagaatgaataattgagccagtatttgaatccaaactgtctggccccagagctagtgttccatatatcttttatttttctgtaactttacgcttggagaatagttgtaagaatagtaacgtgatgtctcatatgttctttcctccatttcactatatttatattttggctcacttgctttatcactctatgggttttttgttgttgttgttgttgttagttttttccttgaaccatgtgaaaacaagttacagacatggtgctgcttataaacatttcagtgtgtgtttaagaccaaagatatcatcttatgtgatcagagtataattatcaaaatcaggaaatttaatactgaagaaatgctcttatccgcagtctaaattatttcataccagtaatgttccgtatcgctgttgcttcctgatctttcccttccccagcctccagtccagaattcatcctgcatcacacagtgcatccagttgtcaggcccatcttggcgagacagggtctccctctgtcgccaggctggagttcagaggctctgcttctgtggtccaggctctacctcctggctccagcagtcctcccaactcagcctcctcaatagctgggcccacgggtacgtgactccacacctggctaatttttgaatttttttgtagagacagggtcttgctatgttacacaggctggcaggcccatcttcttaactgagagaccagtttatgctttcctctagggccatcatatacaaagtccagaaatttagtgtgtgtaaaggtagcttttaagtcaagcaataagatgaaattgtcagtaaatgttactgggatcggccgggcgcggtggcttatgcctgtaatcacaacactttgggaggccagtgtgcgcagatcacctgaggtcaggaatttgagaccaacctagccaacatggtgaaaccctgactctactaaaaaaaaaaaaaatacaaaaattagctgggcttggtagcaggcgcctgtaatcccagctacgcgggaggctgaagcaggagaatcgcttgaacccggaggcagaggttgcagtgagccaagatcgtgccattgcactccagcttgggggagaagagcgagactttgtctcaaaaaaaaaaaaaaaaaatgttaataggatcaaagcataccgtttgaaaaatattactgaagtgtacatttctgttctcatttctgttgctaatatattgacaatgtcaataagattgttaccatcttgatgggcaaacagtcctgacccttgttcttgggtccatacttctgatctttctttatgataccccgtgagtatgcagttaaatgttgatgttacctgtgtctgtcatttgttaatgactgctgcatcttaaagggctacatccctgcatccctggctttgacttcactttcacacttgtccactattgccattaccatactgcagttgctgcttattttctcattttgctatatgcttctggagagctgagatgtgttttatcgatccagctttttgactctaaaatgagctttgagtacatgaatgagtgagcaaatgaatccgtaatgctagtagaggttttgcaacctgtgttttcaaagatcctcatcgccagtttttatgttaaggtaatttatgtaaagtatataactcaagagctgtgagtgtgtctttgctaatgatttggggaaagttgttcgtaaaactctttcacaaatgaagatctgctatttttctgctatggttgaatgttaaatgttcacaagagtcttgaattatttattggtctttgttttttcctgtgactgttgtcatttggaaaaatatctgaatattcaactggctggctctacagagctgggagattcttacgtcttgtttctgtatcaagtgctaatctacaggaaattaaatttaaaaatattagtatgttttttaaaactcaagtcaatcatagtaagaaataaggcatgccaatagtcaaaataaaaacattgcaattttgtatctggcttttatagataagcctttaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttagggctgctgcatagtagaggcagctatgccatttggagcattttctaggaaagcaaagattatttataataattgaaacagtaatttctccagactattcaaaacaaaatttattctgtgcaaacttaaatgggaaccttcgttgtcagcagagcttcaagtactgcactccccacagtttatagtagtgggcctggcctatgtctaccttataatatttaaatcccactggcttattggaatgggcttgctgagggcttattctcttcttgtaactaaacatacagattaatgactagtttgtttgcatttttatctgaggggacacaagttccctttgaggaaggtagaaaccatttttaaaatttaattgtaagaggcagtcaaattaactttgcttagtgtggcagaaaaaatccagtttacactctgtaatactttagctgtgtaacttcatgtaatacattgacagctttaaacttagcattatgccctcaaattcaagtaaacatactaccactacagtctttctttatcttttgaattaaaccctggggggtaattgttttttatttttcttacactttggtttacttgtcattttaatagtgttttcccctctcttccctcttctccttcctatgtctccctccctctgttccctacttccctttctttgcatgccacccggatctgcagatgaaattagtggggacggtaatatttattttcacatttgtgttactgctatgagataattatttatgaaaataaatatagtttagtatttaatgaaaggcaaaatgtgcttttgatccaacagaaccaagtacaaaatggtatgcaaaatattttaaaaattgcttagggctttggcatggaaaggataactatcaatttcttaatcacattttagtggtaagtttgagttgtatgtattcctagtaaatttcctagatttcattattaaaactttgagagttcttaaaaaatgtcaaaagcaaaattagtaacacttgaaagctgtaaatggtagcggtccatacactctgtttcccaagtgtggtatctgtgtgataattcttagtttgggaatgagatattagaaaggaaagaatgaaaaatgattttaaagactcacagaaactaacggaattagggaaatatcagcaataatgataattggtttttcaaatagttgatagcacttaaggtagaaatttaaaaattttaaatcacattctatgtcttacatttcccatctacttcatatactgcttgcatgaaactttatcctcctttatactaaaggagtaagattttataaactaaaattaagaaggaattgtatttttttcctcctgattaaatgaaagaatgcttttactgaagatttcacctatgttcatttttgtaataggatagagatattgataacgagtataacgagctaagcagtttcagtaaaaggtcttaaaagtgcgtgtttttcacaggatttgaggtcagagatttgagcttcatttttagattaattctgtgataataatcaattagcagctgcaattcatctagagctttctgcatgtgacactttactgacttgattcctaattctcacagcagtcattcagaatatcactgggtattgtcctcactgttttgcaggtgaggaaagtgataatcagaggattaagagagactctaaggctgctagaggcaagtggtcaggtcttaggctccagccttgccctttttccactgccccatccagtcagcagctgactagctgagggattacaagcaaattgcttcatctcttgggtcttcatctgggaaaggtctcaagtggttgttgtgaggattactctgtaagcatcaaaatttagataaatgtctgcaaacacttgtatgtattttcccacctatgaatttctcaatactatgaattagccagggcaagtgtacttaacccattttacaggtgaataagctgagccttaagggtagtcacttggtcttggtcagtaaggcccatggaccaaatatggcccacctgtttttgtatgctaccgtttcttgcctgtgaaatagggatggtgatcatagtacaacttcaaataattttgctgaggattaaatgacaatatatgtaattatttacaacagcatctagtatatggtaagctcccaataatatgattagtagtcaatgtcattattaaatatagaatgcagacctagcttcatttgtgcccaggcctttgaacttgtttccttttttctttgtattttccttatcttttgaattaacccttggggggtaatttttctgttttccttaaactatgttacactaacatgtggagggcccaggaagtttcagactgtactccaatttttagggcccttgaatatgtaaaaatacctatcatatcagtgtaatactatcttaacaatcctaaaaaccaggaaagaaaagcaaaatacagccaaatcaatgtcaagaattcttgggaaggctgggtgcagtggctcctgcctgtattctcagcattctgggattacacttgagtccaggagtttgagaccagcgtgggcaacatggcaaaaccccatctctacaaaaggtacaagaaattagcaggcatggcggcgcgtgcctgtagttccagctatttgggaggctgagttgggaggatcacttgagcccaggaggtgaaggctgcagtgagtcaagattgcaccactgtactccaccctaggcgacagagcaagaacctgtcttcaaaaaaaaaggaattcttagaaatatacaccagatattaccatacatatgaaactcatatatagagggttataaacttttgcagatcatttacctgcaacattgttgattttactccatgaattctctattcacattgcatcatagtacacacacctgcaacccaaatataagtaattcctagacagctttgatacatccccagagattttatgtacaattcatccagctaaaaaaaaaaaagaaagaaatttacaggttttctcttgtgattgtatgaattaattgaaatgtatgcaacatgatattttccacaatgtgtgctagcctgatatatattagcctatttattttactccttcacaattattttagaggttggtatctctactgaggattttataaaatgagacagtccttgaaggactgctgtcaaaccaaaaagattggctgagagtatcagcacacaggaatcctaaatcctcaactgccaggtccctttcagagagccctcagaagaagcaaaacaatcagaggagttactgttgcttgatgatctgttatgtgtagggcacatctcaactttctgtcatgtctcctgtaatcctcataacagtgctacaaggcagatgatgttattttacccacgagggcacagctgaagcattgccaggtgaagtgactttccaaagctcaagcagttttccccaaatgggcttgtgtattttgtcacgtgtattgcagctctaccattcacttctgtgctgcctcacacagattaaatcctttgcctcagtttcttaggggtatagcgttcctttactgattgttgcagtgcattcattcttttggtttagcatgtgtttcttgagggaccttctctgtgctagacactgttttagctgctgaggacacagtgttgagcaagatacgtgaaggttccactctggtggctgttccattctagagaggtgggcatacagttcacaggaaacaaaattatatcaggttgttataggtaatgaggaaaatgagtcagggaacatgattaagaacagtgggatgggggcaaattagtctgaggagaggtctctgaataggtggctaaaaccagaattggctctaggccagcataagctttggtgcatggtaaagccctcagttggaggtcactgccactggtgttagcagcagctttatgcccttcttcattaaggcagtagacacctgtcacctgatagacttgggcttctgaacaggcttttaatgaactttgcagccatatgaagctgtggtgacaagtgcaaaacatctgcttcgtaacaccatgagctacgtgcagggttgtagagacttttcagcagtttggataacagggcagctggggaagggaagcagaggtgcagagtttgagtggctctcccaaaatcctgctgcagcagggccaattcatgtgctttactcctaaaggcacgtgctttatatgaaaggaagcagtgagggtgctagggctgttgtgtggaaagacagctttagttgcattcattttctgaggagagtatcacaaagttgagcgtgttaaactatggaatcaaaagagaaatgattgcaaatggccatttgtgtggcttctgttgccttagctgttagagtagattcctcccctgcttagtcttttttgttgcaagtgtgttagcagcttccttccgtccccaaattttctttcacagggtgttttgataagccatcttacacagaagcagagctataggcctacagatgccaatttactgttcttagtatttgctgaaaacagattaagagggagaatacagaaataaaagaatgtatgatttggagtctattaaaacttttttaatcttttaagtattcttataaacgtataagaataatatagattatctgcctgtcatataggacttaggaatagtttacagataataactgtcttaaagagaattgatttattggtgttataatctgcttccccaacttttttttttactgtaatcacttttaatgatgattacataataagaagtgaattcttccacttgtagatttgatctcagtcattaccatagatgtggaatgattgatatcccagtgactgtaaaccatatatattctctatttgctttgaattctgtacctttaatatctgaatgcagtaataaggcgtcacagaagaaagaacttgtagcttttcgtttcattggtgttaaacaaggatgctaggtcaaagtatcaaaatagagctccttggaaatgatgcatcacaaagtcctgtccctgctttactgactcacaagaatggcccagcagttaaaatccttatacatggagcagctgaagattttcgtttttctagaaagagaaaaaagacaaggctgaagtgattttttcagtataggtgttaccacatgagtgactgttttcttcagatgggtatttttaaatttcccattaatatagtggtggacttttaagttggtgtattacccaaaaagagtaggtagatacattggaacttcttgacgtgatctcaaaaaacctcattgtaatatgctgcttattctcctttttttctttgtagatctgcccttttgacattaatgcctaaaatatctgagtttaaaagttaggaaacaaattcctgttgcatttctcaaccctgagcaaatggaatgaattagcacagttaatctcaaaaattaggtaccatttattttctaaaggttccgttcagattatgctgtcaagtctaattgttaataaaatcagataccgtgttttatagataccagtcttatttggagaaagcccagtagacaactgtagttttaaacatgtatttggtgtagttgaggaagagctttgcggttggtagattggttaatttgaagcatatacatagttgtttcatgtcgttctgttttttacaagggctttctgtgttagccctgtttgctctccgataaacaagtctgtgtattataacgtattggacaatgatgtcacttttatttccataaatgactcatgtgtgagcaaaatttgagtaatagtgttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaagtaagtaaacttctgattttgttcttgctcagacttgacagatgcctccttgcatttaaaagttattgatacttactgtctttttagagccatttttaatacttccttggatgctgaacagaaatattcttttcaacctttaccattctatattacttacatatgcccactctaaggtcagaagcctaaaactcaaatatctgtaataatttttagttacaggatttttgtaatcttgttttctgactctatcataatagaacctttattgattagggtattttctgtctgtagaaaattagtattattggttaagtatatatgtgaatgtgtgtgtatatacacacacaatatatatatccatatatgtataatacacatacatacacacacgtatacccatactttcacacacatatattcaaaaatttgcattttccccctttaaattgtttattctttgttgccattgactaaccaatacaaatagctcataaccatcgtcagtttgtacacctcagggatgggaggtgtggggagagaaacagaactcttaaaggaccttcatacagcctggaaatgtcaagattctgcttctctctgtgatgtgcagcttgttgattaaggaaaatcttgaagccccaggtctcatgttggagtgtatagtctccagatcttgaattagataaactcttgaaatttcatttgcaaaaagaaatttatttcttaatttcattttcttatttttttaatgttccagacagtactgacttgagtataaaaaaaaaaattaaacctgccttttaaagagtcttcagaagtcttagaaattaactcaaaatctgaatgtcctgatttcagtagagctatatatatttgtaaaataaatgttataggtgccttattctatagtataaatattcttgtaaatattcttgtttggattttctgtatacattgaggaagcattaccggaatgaagagaaacaacccagtgttgcctttcaagtgtgcattgtgccctgtgggcccatgtcccctttcaggagcttcttgactagagagttactcgaaagaggccagagctgaaacttgtgtgtacattttgattgccagtatcagtttggaaaaatgtttaaacttaggtttaactttttggcatggtggcgcacatctgtaatctcagcactttgggagacagaggcaggagaattgtttgagtctaagagtacgttaccaacctaggtgacataacaagatcctgtctctaccaaaaacaaaataaattaggcaggcgtggtagcatgcacctgttgtttcagctactcaggaggctgaggtgtgaggattgtttgagcctgtgaggtcgaggctgcagtgagccctgattgcacaactgcactttggcctgggcaacagagtgagaccctgtctcagaaaaacaaaaaaagaaaaaaaaaacaccaaaacacttgtttacttttttaattagccatatagacacttgtacattcctgcagataatccagtttttatttgtatatttattatttatagttgagcagtaaatgtccaacatggctttcatccatacctgacaaaaataagttacaggaacttgatgagataggaacttaaaagcattgtttaactaacattgagttaacttgaagatatttagtttttacttgtatttagttctttaaaattcatatttgtgcttaaaatattttaaaaattaagtattgttgaaatattctcttcaagtttgtgttgttaacctaattgctgttagttatttctaagcaaggtcttcaatttttttctctcttaattgcaatacagaaagctatggaatagatgaaggtaacaggattcctttaaattaactgcatttgcttgcaattgcaacctgtggagtgatatgggatgtttcagtttttggttaacttatttttaaactatttgtcattggtttacttatactgttaaatcaatggaactactagctaaagtgattttaaagaggaaaataactgtctaaattttgggttgaatgttctgtgttgtttataatttgataaaccagggagaacatgtaaaaatatttggctcttggtgtatttcattggtgattacactactggaatatatatgcaataacctatggagatgagtttcttacctgaaataaatcaaaataccaagtagtaaatgggttataattgaatctattacattcttaatgggcattttctttccatgtgcctcaaaaacctactgaataatcgattttgtatattacaataacagtatattaatttgaggcacatggtctcaaaagtatatttatgatttataatgttgatacatccaaccttgattctgagtcatctaactttgaaattagttttaagaaactacctctttaaactcttttagctccatgagtaatgtagagataggattatcataaagtggaaaactcttaaactttcaaaacataaagtttacttatgacataattttatgttgcttccatatttacaaactgtagttatttgtaaaataattgctttaataactgtgcttttatagccttcatatattaatacctaaactaatagttcttaatagttaagcatataatttaatagttggggcaattatttagaaaactatcaaatagatataaaataaatcggaaatttaaaaactcctaggaacaacatgaaaaatatctacctttagtagaactcattgtttcagtagttcttctaataccataactaattacatgaattcctgttaaaatattgtttaagagaattccactgtgtttaaagcattttcatagattgatgtgccacagatgaaattttacttatggatgatcaagaaatacgtcaagtgttatttctacatttggaatattttacttaagtattgatgtgtgaattatgttttacagccagggattatgagattcaaagagaaagaatagaacttggacgatgtattggagaaggccaatttggagatgtacatcaaggcatttatatgagtccagtaagtcttttaagactaccaaacaactagactaattttgactatttaagtttaaattgcttttgtttgtcttcatgagtccttagttcttctaggtattaatatttacgggtgtcttttataaagctcttcataaatgtcagcttatacttggcgtattcagaaaccaaaaaatggcaacattagctcctacaaggctgggcctgtcttttattcattttaatctttcagcctttgtcatcagtaacagtttttataggtgactgttctttggatggaattagcaaatcagatgagagtcagaaacagccagtatacctatttacctgcatttttgagaaagaaatgttaatttgccccagtttaccctccaaaaaagatgaataaattttaaaaatgattgctttaataatagcttaatgaagtatcatttgcttactatgaagttcactcttttgaagtgtacaattcagtgcttttcagtgtattcacaaagttgtgcagctatcaccactgtcaattggaacgttttcttcacctcaaaaagaaactttatacccattagcagcagttacttcccattccacccttccccagcctttggcagccactcatccactttctgtatctatagatttgtatattctggacattttgtataaatgaaacatataatatatggattttttattatcagcttctgcttagcataatatttttaaggttcatccatgttgcggtatgtgttagtacttcattcctttttattgccaaataatactcttttgtatagatatagaccaccttttgtttatcctttcatcagttgatgaatatttgggttgtttccactttttgactattaaaatgtttctgtgaacattcatatatgagtttttctgtggatatatatatatatgttttgttttgttttgttttttggtgagacggagtcttgctctgtcgccaggctggagtgcagtggtgtcttctcagctcactgcaacctccgccttccaggttcaagtgattcttctgcctcagcctcctgagcagctgggactacaggcgcgctccaccacgcccagctaatttttgtttttttagtagagacggggtttcaccatgttggccaggatggtctcgatctcttgaccttgtgatccgcctgcctcggcctcccaaagtgctgggattacaggtgtgagccatcgtgcccggccctggatttatgtttttagttctcttttgtatatgcctattagtggaattgcttcatcatatggtaactattgtttgtgtgtgtgtgtgtgtgtgggtgagagagagagtcttgctctgtcagtcaggctggagtgcagtgacgcaatcatggctcaccgtggcctcgactttctgaactcaagttatcctccctcgtaactaggactacaggcaagtgccaccacacatagctaatttaattttttttgtagagacagcgtctctctacattttccaagctagtctcaaacttctggactcaggtgatcctcctgtcttgacctcccaaagtgctgggattgcaggcatgagccactgagccagccaactttttctttctttctttcttttttttttttttttttttttttaggacagggtcttactctgtcaccaagggagtacagtggtacaatcatggctctctgcagcctcaacctcccaggctcaagtggtcctcccacctcagcctaccaagtagctgggactacaagtgtgtgccatcattcccagctaattattttattttttttagagacagggtcccatgatgttgcccaggctggaatgtttaactttttgatgaactgccaaaatgatttccaacacagctgtaccattttatattactagcagcagcgtataagactgcagatctccacatcttcaccaacatttgttattgcatgtctttttaaattagattggtgattttttaaatgacactttagactaatagtacaatcatgtgccgtgtgtaaagatggggatactttctgacaaatgcatcgttaggcgatttcatgatcgtgcaaacgttacacggtatacttacgcaaacttagatggtctagcctactacacatctaggctatataatatagcctgttgctcctaggctacaaacgtgtatggcatgttactgtattgaatactgtgggcagttgtagcacatggtatttgcatatctaaatatagaaaaagtactgtaaaaatacagtataaagtataaaataacggtacactcatatagggcacttaccatgaatggagtttgcaggactaggagttactctgggtgagtaaatgtgaaggcctggattatgactacactactataggctataaacactgtacgctttggctacgttaaatttatcttaaaaacttttcttaatactaaattaaccttagcttattgtaacctttttacatcatgaaccttttaagcttttttctatttaaatttttttaattttttaaacttttttcttaactaagacacaaacacatacattaggctaggcctacacagtgttgagatcatccacatcactgtcttcgacctccacaccttgtcccactggaaggtcctcagaggcagtaatgtgcatggagatgtcatctcctagggcaacaatgcctccttctggatacctgcgaaaggccctgcttgaggctgttttacagttaactagtttttgttttgttttgttttgttttataagtagaaggggctggtgctgtggcttatgactgtaatctcagcactttggagactgaggcaggaagatcactcgaacccaggagttcaataccagcctgggcaacttagtaagaccctgtctcaaacaaaattttaaaaattaacctggcctggtggtgcacacctgtagtctcagctacttgggaggctgaggaaagatcatttgagcccaggaggtcaaggctgcaataagtcttgttcacaccactgcactccagcctggacaacagagtgagactctgcctctaaaaaataaataagtaggagtacactctaagataacaattaaaagtgtagtatattagaaaaaaagaaaaacaaagtatagtaaatacacaaaacctgtaacatagtcgtttattatcattatcatgtattaatcactatacataattgtatgtactatacttttatatgactggcagtacggtaaatttgtttacaccagcatcaccatgatcacataagaaatttgatttctgtcatgtcactaggcagtaggaatttttcagcttctttataatcttatgagaccactatagtatatgtggtccatcattgaccaaaatgttactttgtggcacatgacatgcttgctcaagaaactgtctttgaactagaatagtagcaggtgaacagagatggctctaataaagttacaataacagagaaaattgactcttattttatacccctgcttggaaactgcaaatgaccatttttttcttcagtaactccatgtttatgcatttttaatgtcctttacacgtgtactagtgatgctctgagcattacttttataacccaaaagttataaaagggttttttttaatcaaagataacagataattgccaccagtaaactaaccaaattagttcacttttggaagcctttactcttgtgcttatatcaaattgtataatttgttgtatattttttgctgttttttactcctttttcaattttttttaactatgggtgtattgtctatattccacagtctcttaactctgccctttgaggcaaagtagagtagaaggagcaatggatgcaaatttagtgaaaaagaaacaaacagacaaatttagatctggctctgcctcagtttgagattgggggagataaggtgactacattactggaatgtaactaaattatctctgagcttcctataatctccaaaattcctgataggtaagcattctaaagttcccagagtaccatgacttaaacacaggtaatagcagggttagtggactttatttcattcacttttaaaatacgtaatccattttagttgtgaaaatacaagataattttttaaaatagccataatctaaatttacttttttctttttttttttttgagacggagtatcgctctgttgcccaggccagagtgcagtggcgccatgtcagctcactgcaagctccgcctcccgggttcacgccattctcctgcctcagcctcccgagtagctgggactacaagcgcccaccaccacgcccggctaattttttgtatttttagtagagatgggatttcaacgggttagccaggatggtgtcgatctcctgacctcgtgatccacctgcctctgcctcccaaagtgctgggattacaggcgtgagccaccgcgccccgccttttttttttttttttgagacagagtttccctcttgttgcccatgctggagtgcaatggtgcaatctcagttcaccacaacctcccgggttcaagcgattctcctgcctcagcctcccaagtagctgggattacaggcaggtgccaccacacccggctaattttgtatttttagtagagatggggtttcttcacgttgttcaggctggtcttgaacccctgacttcaggtgatccgcccatctcggcctcctgaagtgctgggattacaggtgtgagccgctgcgcccggcccataatctaatgtttactaaatgtttgttgaatgaattccagtccccaaggattcacattttgttaaatatctttttctttttttttttttttgagatggagccttgctctgttgctcaggctggagtgcagtgatgtgatctccaatcactgcaacctctgcctcccgggttcaggcgattctcctgcctcagcctcccaactagctgggattacaggcacacaccatcacacccggctagtttttgtatttttagtagagacagggtttcaccatgttgctaggctggtctaaactcctgacctccagggacccacctgccccggcctcccagtgtgctgggattacagatgtgagccaccatgcccggcctgttgaatttctttcttgtgtatattgtatatgtttgttttgtttttaatgtgggagtctaattttatagtgcaaagcagtctgttcatttctcttaagtttctattataaatcctttttctagaacatgttctttagtattctgtaaaatcaaataatattttatcaagcattcttgatgattggtcaaaatgtaacgtggcataaatttcatgggcaaggaccaaccattggatactttatttaaggttcagttaattctttgagcaattttgtaatcattttctgctctgtgacagctactgtttctaggtggtggggggatataacttaattctacccaaggcacaagttgacaggcaaaaaagacgtacgctaaatcccaagagggtctgagaaaaacaatgcatggaaaatgggaggtcaagatgctgttccacatgggatgctcagaaagaacttctgacaagacgtgttagcagagctttgaagtaagacagggagtggagcttgagcattctcatggggaagcctgttctaggcagaaggaacagccagtgcaaaggccatgaggcggggcaggacagtacaccaccaggaggacggtgtggccgcggagtagagggataggaaacaaagggaaggcaaaaggaaaccttttggagactaggagagccaccaggggacatgtgtggggccatgtgaaccttgaggtaagaattttgaccttcattctgagagtcagtaaacatgaagtttatctgattggcacacatttttttctttattaggcaagattatcaggcttgttttttctttccttcaagcacctgctgatcactggcacattctctcattattattcgcagccttaaaatccgttattaaatctaattttctcttaattcatcctagaatagcttttttctacatttatttgttaagatattttaaacgtctactagctgttattaattcagagcctaatcttgcatcccttgtctaggcatagtggccacaaggtggtattttcattgaacaatgaaaaacttctcttttccctaaatattgcctgtattttacgaagattttaaaaatctattttgagtaattaccaattagtaactttttagtttttagaaaaaaccctttgcacacgttctggtcttacttactttgaactgacccattctccagcagtccgatctctgtaactggcccttctaacagttcagcattccctagacctctgctgtccactttaggggccactagccgcatgtcctattcgccaaaccgaaggctgagcctcataatctgctcatgttggcattttgtatatttgccagctatggaatcttacacttagcattcatttgaaaccctaggtctttaaagagcagtattttgtttgcatttccttagactgtcttaataaagcaccatgtttactgagtatttgattagttgacaggattaatgatggttttaaggtcttatcaaagattttgttgctctgatcgtctataaaatggacattttcggtcagttttacagtataccagccatacagttttctcgtatacctgttacttgcagccagcctcatatttagctagaaaaagaattcatggtcatggtcctaaagaagtacacagtctaattaaggaagacaagactgactcattcaaagcaaagtggttatattttagcacagatacggttaatgattctaaggttgtaaactcaaacatttagtagatagggtattctgtgctcttgttcacattctgtgtgagccaactactctgtcctccaaggaccacgtcaccattaccacctgaaccccttccttgaggcatctggcacatgggcatgcctcctctggaggtgaagaaagggaatgcagtccctgagtcgatgatacagttctcttaccattcagatttctcttgtttgaaaatgttttatttcctggaaacacatagtatacaactagtgtgaagtctaaaataaataaaggtatttaaggtattttgaaagtatgcgacagctaacttgttaagcaaaacacaatttaaggtatttttaaaatatgacacatctaacttattaatgaacatcttcatttaaaagaaatatattaatagcattaattaattctgcagatctttactgagcatatagtatgcatcagtgctatactaatggggattttttgacaaaacaggcaagttacttgctgtcttgaaacttacattttagtgatggagaatagacagtagttatgtaaatgacaatattatctctgtgttatgtataattataatatataaaatgatataatgtgaaagacaatagtaagtgtgcataatgactttttggctttcagagcaacacattttcttggtttgtctcctgccttcctggtcaccccttctcagtctcctttgacattttccactcttgtccctgacctcttcatgttggagagcttcaaagcacagtccttggacctctctcatctcccttggtgatttcgtccagtcacatgggctaggctacttctggatttctatgtccagttcagatttctttcttgaacgccagtcacagtatcctgctggtcacttcacctgtgtgacttggctatcttactgacatctcaagcttattacatcccaggccgagcttctgatcttccccttccatcttgtcagtttttctggtcaaaaacctgaacttgactctctcacacctgcatcatgagccacctttgccctagcttcagagtataaccagaatctcagcccttctctccacctccactgctaccatgtttgtccaagccaccatcacctgtcacctgtcacctggggtactgtggtagccacccgcagaactccctgtgtctctaaccttgcctctctgcagccatttctcagtaccacagcagaatgctccttcaaaattttgggtcaggccatggtactccaatgtccaaaccctaccttggctctccatttcacttgagtaaaagtcgcatctttctattggccttgaaggccctgtgtggtctggcccctccgttcctctctgactctgtcatcttcaccctcctaccttccaccctctgtgccagcctcactggcttgctcatgttccttgagcacgctatacactgttccctgctgtttcttagccagctccctctcctccctcctttagtttttttgctcttgtctcatctgctcagtgaggtccccctcatacagcagcctccatccctgtctccatatcctgatctgctctctcccttttctgtaacacggttaccttctaacatactatgtaattaattctttatttattatctgtgttcctcactggagtgtaagtgtgacaggtacagggactgctgcctctgctgttcatcagtgtatcccaagcacttagaatagtaccagccacatggtgtatctctaacacatgtttgtagatgaatgaataaatgatttgctgtaatgtttcacgtgcatgaccatttttctcaggggattttatactgagtgtttttaagtatccctctcattcttgagattttgccgttctgattctgtctggtccataacccacatagttgcaaaacagacaggttttcatgaatcaattaatatagcaaacctttttgcatgtgtgtgtgattctataatttccctaacacaggagaatccagctttggcggttgcaattaaaacatgtaaaaactgtacttcggacagcgtgagagagaaatttcttcaagaagcctgtaagtgtctagaaatttctgtggaactccatttgactttctatctgtgaaatccaaactgtctctgaagaaataagaaaaatagtgttttgacttttaggagacaactatgtttattattttgccttgcaaattaatgtctaaatttgtacaagcacctatctacagatttttccaggtaaaccatcatgttttatgtgtaaaggtagattgatgtgcatttactttatactttggtacttaggccattacacatctttgcactggaattggtgcagatatataagtgatcctaatgttgatgctgcccagaccccaggaatgcagaggtgagcatgacacacacagtccctgccctgatggagctcatagactagtgaaggaatagggctctatgaccattccccttgtcctgctacaaaatcagaacaaatcacccaggctgggcacggtagctcacgcttgtaatcctagcactttgggaggccaaggcaggcagatcacctgaggtcaggagtttgagaccagtctggccaacatggtgaaacagtcttctactaaaaatacaaaaaattagccgtgcatagtggcacgcacctgtagtcccagctactcaggagactgaggcaggagaatagcttgaaccccagagagggaggttgcagtaagccgagatagcaacactgcacttcagcctgggcaatagagcaatctctgcctcaaaaaaaaaaaagaaagaaagaaaaagaacaaatcacccaaaaggaggccaggtgtggtggctcacacgtgtaatcccagtactttgggaggccgaggtgagaggattgcttgagaccagcctgggcaacatggtgaaaccccgtctctatgaaaaaatttaaaaattaaaaaaattagctgggcatggtggcgcatgcctgtagtccctgctacttaggaagctgagatgggaggatcacttgagcctgggaggcccatgtagcagtgagctaagatcgtgccattgcactccagcctaagtgactgaatgagaccctgtctccaaaaaacaaaagaaaagaaaacttcacgcaagaagagacctcaggaaaggactcttctgacggcttcccaggtgactttagctagaaacacttatctttttttttttgaggcagtgtctgtctcgggtctcgctgtgtcacctcctggactcaagggatcctcccatctcggggctgcaaatacctggtactacagatgggcgccaccacatccagctaattttttgtatttttgtttggttggttggtttttttgtttttgtttttgttttgtggagagacaggtttttgctgtttcccaggctattctaaagttctaggctctgcctgcatcagcctcccagggagctgggattacaggcgtgagccactgtgcccagcccttagaaataattttctccacctccattcctctgactcttggtttgtgcctcctctgaagaagcttccttgagtgagctctgcatgaataggtcttctttcccaaatgtaagctcttaaagagcaaggatcttgtccacatcaagctcttccttacctgccctcaagcggtgatgttcctcttcctcctttcctatggtttgcctcttctcatgcttcaggccccagcttaaacattacctccaatagagaacctttttctgaccaccatatttaaagtctccccttactattttttgtcacacaagactagttctttttcttcctaatgattcctaattaaagctacattgtttacaagtgattattgcctgtctcttcctctcttcctctaggccttaagctccctggggataaggaccatgtttgtttcgctcaccactccatactcagtgtcctgcacagtacttgacacctagagaacacctggtagatgtttgtcattctggtgtccttcattatatgtgcatcaaatgaatgccttctgttttccattgtaataaataccacccaacagtccaataaattaataattcatagagtaagccatgtggtgactacattaattaagtcttagtacatccttaatcctattcctgaaactttgacttaagtacaagagaaggcctggccaatgacttctgtcttgactagttcatttctgcatagcacctaggccaagaaaacagaccacatcagtcatcatcacccaacaccatatctgccttacctttgctggtattcttgtgcattttatattttcaaaaatgaaaattttaaaaattggttatcttttcctaaaattctgaacagttactatgttgtgattttgtaggactttggaattgtcattacaaaaatcagttatatagttttataggagtagtcaagtcggactaattgttttcttctctgagaggttactcagcagttatttcagggaaatgtgatagatgtagtgtatctaaacttctgtagggctttaccaggctatatataagagaaaaaatatggcctcgatcaggaattgttaaactttttctttaaagggccatatagtacatattttaggttctgcagactatgcagcccctgtcccaagtattcagctctgtcattgtacatccacagacaggacagaaaagaatgagcaagaatatgttccagtaaaactttatttacaaaagcagatggcagcccctgggccttagctttctgccccagatgggtaaataacaagggaaactattctatgtgttgatttttagttcagtttgggtagagtttcctagtggccacaagactctcttagccttgtgctgttttgtgtttctaataattacttctgaggaaatatgaaaggcttgataattatatgtgagaataacataaaaccaaaagttataataaatagttacttacagtaaattgaaagtacggttgtgaatatgctgggtgcctgagtgtttatccaaaaatatcatggtataagcaatgaactgaatgtgacaaggtgagatttaattatatgttttggattatgtgctgggtgtttacattatatgggtttttgttggtgatgtttgttgaaaaaaactaccaggtcctgttcttggaatatgagggaaaacttgtaaaacacataagtgagctagacagaacacccactaatattgttttgcccatttcaaagtctttcacagttttttctcacaatgggcgataccagctattctgtaacatgttggcagtattacatgttgatcgtatttttaaaattacttctgttattctaatttccttgcttggcatcagaattatttttccccatttttatagtctgtgaaatcaggtgtttttggacccactggaccaggtcacctttaaaatcacttccagttttgagatcctatagttctgtgaagtctgtcctgtgtcttactaatcctagtatactgtacaagtaaccttcttagccctgatactagaaattataaatgcatacaccttaacatacatgttcacacacagatatgtatgtctatatgcagtgccctcttggtcatcttggctcaattaggcggtcaaactcatgttactgccataggccacatttagcatcagactctcctgagagtagtagtacaggaccataaacaaagtatgccaaaaaaggcagcagctggcatttctctcatgtgaaagtcctcacggctgtcctggaaactttttttttttttttttttttgagacagagtctcagtctgtcgcccaggctggatggagtgcagtgacgcaatcccggctcactgcagcatctgcctcccaggctcaagtgagtctgctgcctcagcctcctgagtagctgggactacaggcacacaccaccacgcccagctaattctgtatttttagtaaagatggggtttcaccatgttggccaggctggtctcaaactcctgacctcaggtgatcggcccacctcggcctcccaaagtgctgggattacaggcgtgagccaccatgcccagtagaaagtcttttatagggccctgaaagcaaccagttaaatttaagaggacaggaccacagtggtggatgcaggaaccatttatgtctaagatagaaatcctttgtgagtgccccatgggttgtggcttccagggccttgcaaggaacacacccagttaccatagtctccacactcagggcagcttctagctatagctttccaccaggtatttttaatcccatttcacctcctcccccagcaattcaccagtcaggagtgatttttactgtaaagatggttgcttagtaaatgaattacacactcctacttaccagatttctagaggaaaacctaggaagctaccccaaggtcacatatgtccataggaaaaaagaaatggttgtcgtcgtctttcttctccttcacttcctcctcctcccttcctccccctcttcctccttccttcctcctccttccttcctccccctcctcctacttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagccgggcgtggtggtgggcgcctgtagtcccagctactcgggaggctgaggcaggagaatcacttgaacccaggaggtggaggttgcaatgagtcgagattgtaccactgcactccagcctggtgacagaatgagactccgtctaaaaaaaaaaaaaaaaaagaaagaataactatggagaacttttttcctagtaacaatgcgtcagtttgaccatcctcatattgtgaagctgattggagtcatcacagagaatcctgtctggataatcatggagctgtgcacacttggagaggtactgtgatccccaaatcttaccttctggactcagcgtttgatatcttttgcttaagaaaggaaaatataaacagtttatatcttggattttcaggagagttctgatttaggatgtatgtcattatggttttggttcagagaatatgggtataaatatcttcatcattaaattcccaaagcatccccttatgcagtactggcagcaatatcttccccagccaagtactttatcaggattggtagccgcagatggccaaatgtttggttttattttttctctctggtgccattgcctaaaaaactagcccagtgatctgaggatgaagcaatcttaatggagtttgggtaaattaatgctaaatttaggtaagtctaaacatttcctttatctttttgggaattcactttgtagcatctcattttttgagagacaaagtctccctctgttgcccaggctggagtgtagtagcataaccacagctcactgcagcctcgacctcctgggctcaagcgatctcccacctcaacttcccgagttgctgggactacaggtgcatgccaccatgcctgactaattttttaattctttatagagacggggtttcactatgttgcctaggctggtcttgagctccttggctcaagtgatccgcctgcctcggcctcgcaaagtgttctgattacctggctagtaataccttttaaaccaacttatttaaatcacagtttcttttttcttttttcttttttttttttttgagacagagtctcgctctgtcgcccaagctggagtgcaatggcgcgatctcagcccattacaacctccgcctcccaggttcaagcacttctcttgcctcagcctcctgagtatctgggactacaggcacgtgctgccaggcccagctaattttcgcatttttaatggagacagggtttcaccatgttggccaggctggtctcgaacccctgacctccagtgatctgcctgccttggccttccaaagtgctgggattacaggtgtgagccatcgtgcatggccgtactttcttttaaaaatgtgagtaattgagtgaatagctctctcactttctccagaatacagaaacaaatcagtgcatcaccaacacttggaaactcattaaacaagttcttgtgccccatcccaggcctgctgaatcaaacactgggccgggggagcattgtgtgatttcatcagctgaacatctcttcctcctccaccaaatcaaatggagtgcttatgtataatttcttgttcacggtacttttctgcttttgcttttggagagtttgctaattcttccggctcaaaaaatatggctaaatatttctctcatcaattatttagaattagggtattaattgtgtctgcctttctttgccatgtcagcatttacctctattaatggtgtcagtggtagcatgaacaagtaagtacattgtgataaatacccaacatgactgttctgtgcttctgcatccaaaacttcatggggaaggaaataagaggggagattccttcttgtccctgctttctccgcattacattatcctcataccttcgcagagccacagtaaggtttgaagtggagataactgactgtgtattagccttgtttggatagtaactagatcttttttcttccagttgttattattatttagcaataatttgtactgtgcttttgttcattccattgaagcttatctttctatattttttaagaaatttgtcgttagtcaaaaatattttaatttcatgataggatttcaaataaaaaataatctgaatccagagtttaaatgtttcatttattatgctttattagaagagacttgaagccattctaatattattaaaaatgcattgaaaacagcattattgttgaatgtagcttttttgcttttgatttcgattcactgccactaattcttttttttttttttttcttttggtcattgttccaaaagctgaggtcatttttgcaagtaaggaaatacagtttggatctagcatctttgatcctgtatgcctatcagcttagtacagctcttgcatatctagagagcaaaagatttgtacacaggtaagatacagtcataaagctgttaagttcccttctgaaaagtagtgatcaagaaacagggacccatttggaccgtctttggacccttttggatccagggtcccctttggtacagttttgtaccaattctacaaaattgtattctgtataccattggaatctattgtacacagttaatagcaagtcatgctgcattatgtcctatcagagtgagatgccatggcttgttaatacacatttacaggatttttacacacgtggagtttaaaacattgtgatactttcaggtcacttattccctacacaaacactatagagaacctgtacttggcagcagagcagtgaacatgtggaagtggtctctaaaacaaatattgtcctggaactctccaggacaacacaaccttatgagtgacatctgttggcattctgtggaatttctgtttatagcctgagtctctgtttgaatgcaagtaaagacccttaaaatttgtttgccaagtatcatattagaattggtgtttttgttatccggcattaatacaaacttcatccaaaaaaaaaaaaaagaaataggccgggcgcggtggctcatagctgtagtcccagcactttgggaggccgaagcgggcagatcacaagatcaggagatcgagaacatcctggctaacatggtgaaacaccatctctactaaaaatacaaaaaattagctgggcatggtggcgggcgcctgtagtcccagctactcgggaggctgaggcaggagaatggtgtgaacccaggaggcggagcttgcagtaagccgagatcgtgccactgccctccagcctgggcaacagagcgagactctgtctcaaaaaaaaaaaaaaagaaaagaaaagactaagcatctaaaaaaataagctgcatcagcaaaatcatttacaagttttcagaaggcaacttttatttaatgatatctctttagtaatggcagtgttataggccccagttgtatatcactgtcagttaatgccgttggtagtatggttttatgaacagtaataaggattttcattattttagaatgtactttgccatcattcagaataatcattgtattaatgggtaaatatctggcaaaaagaatatatatgaagtaaattttgtgtgtgtgtatatatgagatttattatatatatcctataataaatatcatataatctgctcgcattgtatataagctgtctttcaaagtgcctattggtatgtctttatatatgagcttgtatgtttgtttttcttattttaagtcttattgtctcaaattcttctttatcagggacattgctgctcggaatgttctggtgtcctcaaatgattgtgtaaaattaggagactttggattatcccgatatatggaagatagtacttactacaaaggtaagaaatcagagtagtacctaagaaataggcttggaatctttaacgtatttctaaaaacagtatgttctaatatgctcacctgatctttgacagagatataaaatcaactaaatggaggaagcgacagccttctcagcaatggtgctggagcagttggacatccttaggcaaaaaatagacctcagtttaaacctctgaattccatttcagattaactcagaatggattatagactgcattacaaaataataaatttttagaaaaaaacacgagtaaatatttagcatctagggctaggccagggatccttagacttgacaccagaaacaaggattcataaaaggaaaaagttgataaactgaacctgataaaaattataaatttttgttctgccaaagaccctgttaaaaggatgaaaagagaagctacagagtagaagattcgtgccagccacacgtatctgacaaagctattatctagaatataaaaggaactcttaaaacttagtaaaaatgacacaaagaatgcacttagaaatgggcaaaaaaataggaagagacatttcattgaagaggatatatggattgcacataagcatgtgaagatgcagatgttccacatctgtgtccattaggaaaatgcaaattaagaacacaatgggattacagtacatacctgtcagttgttaaaataaagaatatgctggcaaagatgcagagaaactaaattgctgctgggaatgtaaaatggtagaggcattctggaagaaagtttggcaaattctttaaaaattaagcatacaagtgttatatgacccaggagttgcacgtctggacatttcttctgaagaaacgaaaacttgtacacaaaaccatactcaaatgttcattgcagttgtatttgtaatagccagaaattcaaatcagctccaatgtctttcaatcagtagacacaccatcatcttacaccagatgcggctggttgtattgattgcctcagtgaaggggatctgactgaaaaatatgcaggctgctaactccagcaccttggatctattagtttggtgggatttttgtttgtttgcttgttttgagacaaggtctcacattgtcactcaggctggagtgcagtggcgcaaacatggctcattacagtctcgacctcctgagctcaagcattccacccaccttagcctcccaaattgctggtactacgggcgtgcgccaccatgcctggctaattttttgtagagatggagttttgccgtgttgcctaggctggtctttgatcaaactcctgggctgaagctattctcctgcctccgcctcacaaagtgctgggatttcaggcatgaaccatcatgtccagcctccattagtttttttaactgaaatctagctcatgtcagttgtgtttaattttgccaatcttggaatcacattgaattggttcttcaaattgttactgaactaatattttactgaataatgttttcatattcctagaactttagctaaggtttagataaatccatattgtgctattaatactactaattatgactaccattttacaaaggccagtttctttcttagggtatttgatttttatatggcaacaaaatgagcccagatttttacaagcaaagctagtctgttattttaatcttataactattctctttccatatgtcttctgtatattattgcctgtcactattttattttttaaattcatttttaatttttatttattattattattttttttttgagacagagtctcactctgtcgcccaggctggagtgcagtggcgctatctgggctcactgcaagctccacctcccaagttcacgccattctcctgccgcagcctcctgagtagctgggactacaggtgcccaccaccacgcccggctaattttttgtatttttagtagagatggagtttcactgtgtgtgttagccaggatggtctcaatctcctgacctcatgatccgcccacctcagcctcccaaagtgctgggattacaggcgtcagccactgcgcctggcctaattttttaaattaaaacattttttaagacagggtctcgttctgtcgtccaggctggagtgcagtggcatgagcacaagtcactgcagcctcaacctcctgggctcaagtcatcctcctgcctcagcctcctgagtagctgggaccacaggcacacaccaccatgcccagctaattttttgatttttttgtagagatgagatctcactttgttgcctagattggtcttgaactcatgggctcaagcgatcttcccaccttggcctcccaaagtgctgggattacaggcatgagccactgtgcccagctacctgtcactatttttaaatgatcctttgatatatgaaaagaaaatcaattgtttattcattttaattgtttagtcatttaactttaaaaagacgaagtcaacttttcattatttctaaatacattttatatccagcttcaatcttaactgtcccaagtcctagaattccaataaagagctaaattccaagtagtatgatgtccaaattttcatatcatttgaacaacattttaaacaggcagttgacaaattcacacagatatcttctcagaaaggttaataagtgtacattccattaggctatagaaataagtacaaactccaaaaggttagagattcttcaaaatgctcctctttctaggaattctgatagtcttcagaggcaactcattgcttacagaagaaagtccagacccttgacatgctggcagagcccagccgctcatgctccatgctcttctgaatcagggtgctgttcctgtgccctgcttccttgaccaaccccttctcctcttatatcctctccctgcagccttccctggtcatcctctcagtcattagttcctctctactttcaggacacttggcatgtattcactatctgtgttacaccttgtaccaaatttgagtatacttctgtctgccttttagaatgagcattccttgaaaaaaaggactcgggattgttcatcttgagaactcagcagttgaggaaatgtttactaaggttttgagtggtttgcctttgtggcacaaagaaaacgtttaggcctgaaaagggagctgatttcaggcttccctagagaagtccttcttatcccattgccccttcctgctcttcacatgcctgattatttgtgtagtctgcgctgatgcattcacctagtggctaacatgtttgtaattcccaaaatcaatactcaaggtgctttcatagtcatttgaggacatgcacaaagcaacaaaaaaattgagtattccctaatacccacatatgcagctgaggttcagcaaggccgcagtctctccctcctgtcgcagccagaggagggaagacagggtcagggctgggaggggacggcacagggcagagccagcagctcaggctctggtggttggagaggtttgaatcccaactctggcacctgttagtggggcagccttgggcaagtcacttaacacatctgagcctccttttctaaaggaaatggaacctatcagaatgagttgttttatgagtgaagattgtaatctatgtgagatacgaatatatgtgtacatatttctcctgagagcaggggttctgtgtttgcaacaactttatataacataactaccaccagtgaggatcgactatatattatttattattagcaggacatgtgtatagcgagcattctaacctacagataaggatctcttctgtaaattgtgaaatcttatataccagagctgcacctaatacctgcacctaaacccctggtaaaccgaggtttgctctccctccctgttctttgcctctctatagagggaaggacattggtattttatttatctaccatctaaccattcctcacccctaagtgacctcgaaacaccaaggaaatgaaaagtagttctcccaaataaatggaagcctcaagggttcaaatagttaaagctttttcctttgatactgaaaatctcagctagctctgttagattcttaagcagataacaaggaaaatttattttctaaaattaatcttctagcttccaaaggaaaattgcctattaaatggatggctccagagtcaatcaattttcgacgttttacctcagctagtgacgtatggatgtttggtgagtactcttaaaagttttgtattctttaaaaattatatttcatatgttatacaaaaaaaaattatctctttttggaatatgtaggttgatttgccttccctaacctgatcatctcctcatcagacttcttttgattcatttgacagtaaatagcctgacatctactgtgcatcagcttctgggcacagcttctgtaagggtccacagttctaattgcccagctccttccatcactcttcctttttgttcccctttgctgtctcttctttcctcacagggggatattttgcttatttccttctttcttttctctctctccctttgccatctcattcgttcctttcatatgaatgacattaaacagtaaacacttggcccctccaacccggaagtatctaaaattctaccttgtctctttattctggagtccagcctccttcctgacctatctcaagacttggaagtttgatcctttgtcttctgtagcttctgcttttttgataatctcatttgttcctcctcacctgctgcaaggtcatcattctcctgctctatggttattgcagttccttctagctggtgtagaagtgtggctctcatttattctttgctacttatttaaactactttatccaaatttttaaattactcactatttttaacatgaatggcacttccctccactctactctccatttttcttggtgttattccttctacccagaataccttatcctgataccttcttcttccagttgaaatcctacctaaccctcaaggtccaccttaaatgtccttgaaggcttcttcctttctttacctttcctacactttctctctttgtcataccactcatgttgatcctgtgaatagacttgtggacatgttatctctgctacattagaaactactttggaggagatgccctgttaagattatgtaccttttttctcctataaataaaaataacttgatccagtatgtgttcttatttttttcttctgtttacttactgttgattcttaattatcatttaatgcccccatagataactaggtaaaggaaagaactttcaaatagaacaggatatggcatgacatgattagaaaaagctctgaagtccagttgatgtgtgttcaaatcccaaggccttgattattatctgtgtgatccacagagcaagtaacttatcctttcagagaaatttcatgtttcaaaacttctaagatgcctatttttttacatgttaacatttctggaactggagtgtatcttaaaatcagtggcattttacagttggtaataattggaagcattattttaatgtagttgtccttgctttccactcaagtagagtttgttttgttaatattgttgttactgtaatgtctgaatgactttaaaagaactcttttggtaagaataaaataaaaattctaagagggaagaaagaattgtatcatactttagttttcaacattctcctcccttttttggtcttataaactaataaagtttcctagaatcagtagatgtgatttttgtcaaatgtggtaaaatgcagtgtttaaagaaacataaggttactgtgaggattaagggtaatatatgagactgggcacggtggctcatgcctgtaatgctagtactttgggaggccaaggagggaggatcacttcaatccaggagttcaagaccagcctggacaacttagcaagaccccatctctacaaaaaatacaaaaattagctggtttgggtggcgcatgccgatagtttcagctactcaggaggctgaggtgggaggatcacttgagcctgggtagtggaggctgcaatgagctgtgatggaggctttgtctcaaaaatatatatatttgtaaaatttctaagaagtgtgccaggaacacattaagttctcaagaaattatatccagtgttgctactactgataatattgttgtaacttctggtgagaaaagcagcactaaggcattttttttgtcagatactctttactttgaaattcttggattcttggctaagttcagaatctaattcacatcaagatgataatatgctttgcttcttttgaggcagatttcattctaggttctaaagatgcaaaaataaagtcacagttcctttcttcaagtcatcaattgtacattgttttgtgatagaagtagacttgaaatgacaaaaacttttcccagaggaaaagcattataaagaactacattacaaatgtacctacaaagaagagagcttgtgaggaaggtaaagggatgtttttggcgtgttccacaggtagcaagaagcccagaatagccaggcgcagagcagtgatgataaggcactaggagaaaacatccatcctttacgccaccagttctttccatttcctttacattgcattatatgttcattgccagttttaggtttcttgtttgttttaaaggtgaatttttaaattttttttttttttgaattttagattcagagggtccatgtgcaggtttgttacatggatatattgcacagtcctgaggtttgggcttcagttgaacctatcacccaaatagtgaacatagtacccaatgggtactttttcaaccattacccacctccttccctccctgctgttttattccctgctgtctgttgttcccatcttcatgtccatatgtatccagggtttagatcccacttacaagtgagaacatgcagtgtttggctttctgtttctgcattaatgcactttggataaatggctttcagttgtttccacggtgctgccaaggacatgatttcattcttttatgcctgcatagtattccgtggcatatatgtactacattttctttatcccatcttaaaggtgaatttttaaggattattcagaagatactaagaaagtattggatttcccaagggtagagtgcaagtaaactttttgaggtcacactgtggcatttatagacaagacgacttgaagcccaaagaagttccacatctttcctgggggaaaacagtgaccagtccatgaataaaccagataatggtgcctttatgcactctagacaagaagaggccaaccttgttaagggaagcattttaaggaatgctgagttttccaaaagcgtaagacttatcctaggattttctttattggacctcaggtcagctgctctaattataaatagatgagaccaaagtggggcggattaaaattcagcattttttgaactactgcattaagccacgaagtaccactgtagtctagtgggtgattttctaatagaggatttctannnnnnnnnnnnnnnnnnnnaaataaacctctgagaaaaattacagcatttttcttgataataatttaacatttcattatttacatcatgttaaatcgttaggttattttatactagagttaatataatgctgctttggtagataatttgcccattacctcccagctggtactcgagtgcctagaagaacaatgttcctggaacctgggagttacattcttcatactgagctcactgttgtgttttcattcccacttgacaggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcaggtaggagttggcgggagagagggcctgggggtgggggcagattatgctgcttctcctccttgcagtaatagcattttaaggtcattatatcagtatgtctaaggccgaactatttttcgttcaaatgcaattacttttaaaattgatttgcatttctttgtaccttgctagagtcttaagtaaattatatctttaaaattttaataaagctccaattatggtcaaatctctctcccctagcttctgacttagcatggcttacaagacccgtaataacttagtcccggctttcctcactaatctcatctaacacaaccctccatctctgtctccctcacactttgtgatccagcaatacctacttataattctcctaacacagctcactgcgttttcacatgctgtcttcactcccagaaatccctttcctgacctttgccacctataaacttttattcagttttcagaacccagctcagatgttacctgcttcaggaaggcttcctaatcaaccctgccccgaaagagagaattactcctttgccaccttttgaatacttctgtttttatatttaaaacatccattgcttgttcaggtgccattttgtggctactactttgtgccaggtactgttaaacccctggaggaagcacgcagggacattagtgtgctgaatccctcagagaagcatgtgcatactctaccctgttgcctggcctggagaggttcttgttcgcttgtgcatgtccccagctacactcagagctcttgacgggcatcattgtgtcttactgatttctgtagccccaatgccaagcttagaacctggcaccatataagtgctcaataaacatttgttgaattgaattgaattggagtctagaatgagacttaatactgtaataaacaagatactgtaatataacacataggcatgagaagctttattatataaacaataccatggttcagtgtgtgctgtgtcacctgttttcacacttggggacttcctccattttatgtgagtttttatgggtttgtttttcatgctgtattttagtctttttcctaaaaatcatcaactgcagggtccaggcctttcaccatctagcccagccttctcaccacatgttcaagctgttcaacctgctagacaggattccttttaaggagagtatttcaaagaagaattaagacctataggtagaagcacaaaggattcatccagtctgaaaatgtttgctaagcacctttgttattctaagctaggttctgtgggtccaacagtgaacaagacccaatccctgcccccagagagtttaaagtctggtggaggagaccgaggtatcactggttattacaatacagtgagccccacattggaaagaccagccacgctcttggtctccgtccccataactctcacacaccggcctggttctacttttcaaggccccatagaacaaccctactctgcctttcacacgataggccttcagggtaattctaaacagcttccttacctcctcttagtttcttcaagccaaaaatcttcagttccttaattaattctcatataacttaactgcctattctctcacctttacagctggcttttggacatgctttattgcatgttgttttgctcctatttgttcctccttgatctttcctcaggatttgacagattctgtccttggcattgttcctctctgataccagttctatcaccccacctccctggcatctctttctacctcattgacttgccatctctccacctttaccatgaatattaaccaaatttctgttttcagcctcttattttctcccattttctctcattactcttcccaggatgtctgacccattcacatggctttgctgcttacctctgtctgtctatagttctggtcctgcccttttctcaagtcccaaacctacattttaaattgctggctgggcatcatgtttatccagaaagcaagctgttacattctcttctatgccagcccttcctcctcacttcctccaggttggaatagtgcctttatcttcggcaccatcttggagtcatgcttcactccttgtgcctgccccccaccctccatcccacgctcttttcccatctgtctggcatgaccagcttagtcaatcttcctgaaatgtcactggaaaaataactcccctggtcaaaacaactttcagtggggttttgtcaccttttatgtttgggtaaaggcttccacagtaacatttaggcctcatttcattatggcctgagattgtcttctcatccctttcacacacagtagctaaactaaccctcctgtcagcccagaatgcctccttcttcatttggggagatcttacccatctttctcggcttctttcacgcactgggtcttctgtgacttcacagctgactagccttcaccctctgagtctccaaagctctttgttcttcttgtcaggcttaccctatgctgctatagatggctgcaacccgtgttcaattcagttcgataaacactgttgagcacctacagtagctgagcctggtgctagtcactggggcaaagatgactaaaacacttttcctgccctcgaggagctcacagtctagtatgtctcatcccctactagactgaagctccttgaggacagggatggtcatactcacctcggtgttgcccaaacctccaggccagtagcctagctagctagatacaggaagagtcacccaggcactgaattcaaggcttagaacatatgagtgattcttaatactaaggaatgctccactgaggtaaattatctccaaaaagtatccaatacatatttttagaactacatataattactttaaataggtacctgtagtataatttatggatatcttcttatatactactagcacaggtagttgagcattcattcattctgcattgttctgttttagaaatggtgtttaactttgcgttttgaacatatacaattaggctaccaaataggccaccattttatattataaaatgtcactatataatataattgcttacttggacatttgcatataacagtgtatcacaataactaaataggttattaatttttttcaaaatttttattatttccaagattttaacaaagaaataataagtttggatagccctttggtcgttaaaattatggtagttaaaaatgtttcccaaatcccattcttcttcttgacctcgaaagaattctccttccctaccttgaaagaatatttgcaagtagactcaaattactgtgggattcccctcatctttaactggagtgtatgcgtgtgtattttattttgttgaggcggggtctcctctgttgcccaggctagagtgcggtggcaccatctctgctgcctgcaacctccacctcccatgctcaagtgattctcccaccttagcctcctgagtagctgggactacaggcatgcacaccacaccaccacacccagctaattttttgtatttttggtagagatggggttttgccatgttgcccaggctggtctcaaactcctgagctcaagcaatccacccaccttggcctttcaaagtactgagattacaggcatgagccaccatgcccagccttgtatatttgtttttgactatattagttgagaagtgatttttggtatggaacatgttgggcaaactcataggaaaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacatggtgaaaccccgtctctactaaaaatacaaaaattagcccggcgtggtggcaggcacctgtaatcccaggtattcaagaggctgaggcaagagagtcgcttgaacctggggaggcagaggttgcagtgagccggtattgcgccattgcactccagcccgggagacaagagtgagactttgtctcaaaaaaaaaagggggggggggggtttaatttaattcctggttacttcagttaattctttgttaggtactatgacagggaaaccataataaacagctttattatttgcctttttgcaggtatgttcaaaaataatatgtcccaacagtactcttcttgactaaggtgttggtaccactattttaaaaaagaacatcagctttatctcatattagaaaaatattttaggttaatgttaaaattcttaaatatattttaggcaaattagggcagtaaacacaattatcactttaaaattttgtgttatgatttttgtatattttaaaactttttattgatgtttaataaacacaccaagaagtgacagcttactggatttccaccagttggatacagtctgtcaccagcaaccaaaatgaaaatactaccagcaccccagaaatcttccacatgcccctttctaatcactgttcaccctccaagggtaacctctatcttgaccatagattggttctgcctgtttttgaacatgatgtaaatggtatcagtcagtacttactttatatatataatttattttactcaacagtttgtgggattaatccatgttattcgtgtagttatactcaattctcattgttatatagtgttccatttgtgaatatcctatagtttattccactgttggtggaaatttgtatacttctaatttggggctatcaagaatattgctctgtgaagtagagaggatatagtaagtgttgtgtaaacagatttacctgaggctttatgttctaaagaacaccagtctcaagtatcaccttggaaagcagtccatgattttgaactggtcttctatcattgagctctttaggaatatttttagaaccagtaccatgtgcattgatagcaagtctccatcctctgcagttagctcttctagttataacattgaaataactagtagttatagagcaatgtctgttggcaggcattgtgccatgaacttttatacactatttcatcttaatcctcacagtcctggggcatactacgtataggtagtatcttcatcgttagtttacgatgatgaggagactgaaactgtgtggttaggcacctgatagaaggacacagagctggaattcaagctaggtccacctgagtccagagcttgagctataagctgtcatgctctactgactgccttgatgtttattggctagaagtcattaagtgtgcctgccatcttatgatttggactggtgagcaggttgttaatattggttagttaaaaaggaaaaagaaaggaaaaaaatactattacagagaattcctgcagcttgttttcttacattgtttgagtatcaaccaaagtccttaaaaggaatggcagcatcactagcagatgcacagaggccctacccacgggctttgagggggacatggcttccttttgtactttcaaagtattttcttactggttttacttgtttcattggcatattttgagtgtgttgtattttgcttctgtggaacacaataatttcacatacagtggggagccgatttggaagttttgaacaagtcacccagagttgacttcaagcaaatcagagccaagccatgacacggtgtcatccagagagcctgctgggaaccgcttgtatatagagctttcactccagctggggggtgttgggagtttttgtttggagtttttgtttttgattttgtgcgtgcgtgtttttttggttttcagtttttagttatttgtcttaaccatgtgctgtcatgttttgcttcttaactttatcaaacaaaaccagcctttgggagagtgtttggtcagggttatagcttagctcagcatgggtgcagacagattttcttactttttttttcatatcgcttctcagtatcatacctaagtgaagctgcaaggcatctaaggaacacaaactatttcagttgatctgtgagactgccagttcaagctattatagcaacaccttgagagtaaatggacatgtgtgcgtgtatcaatttttcaaagaatgtttaaaagattatgtggccttgggcaagttactaagcctcccttgtaagagcaggatcacaaatactacccatattctcaagattaaataaataatctggccgggtgcagtggctcacgcttgtaatctcagcattttgggaggccaaggcaggtggatcacctgaggtcaggagttcaagaccagcctggccaacatggtaaaaccccgcctctactaaaaatacaaaaaaatagccgggcgtggtggcagatgcctgtgaatcccagctactcaggaggctaaggcaggagaatcgcatgaacccaggaggcagaggttgcagtgagccgagatcgtgccactgcactccagcctgggtaacaagagtgaaactctgtctcaaacaaacatataaataaataatccatgtccattgctcatggtaagcacacacactgtgttagctaatttagaagtaggtagtagtaacaacagagattttcctgaaaatccagaagggacctggtgatcttagagtacagaagagttaccagttatagttagacatccttaaaaatatatagttatttgtatttaattttaaggtaaccagtaacagaatcgtgcaaaattatgagctttggaatgacagatctcactttgaatcctggccccaccacttaatatccttggggaacatctttaacttttctttttctacttttttttttttttttgagacggagtctcacactgtcatctaggctggtgtgctgtggcgcagtctctgctcactgcaaccaccacctccctgcttcaagcaattctcttgcctcaccctgccgagtagctgagattacaggcgcgcaccactgtgctgggctacttttttttgtatttttagtagagacagggtttcgccatgttggccaggctggtcctgaactcctcacctcaagtgatcaaccctcctgggcctcccaaagtgctgggattacaggtgtgagccaccgcgcccggccgtctttctctacttttctaaaaagtgtagtactctttctactcagtagctactttctagggttcttgtgagatttgaatgagtattaactattcttattattcagataataagaataccaagatacttgttatcaaaataccaagcacatctttttgatgttttatagatgtattatagagatatgaattttaaaatattaatctgtgaacagcatcttaaacatgtttaacctgttttggattcttcccttatcccacaacacgaactttaaattagaagttctaggtttgattaatgacatgaaattgcttgtactactgtgttttttttaagcgattttgtatttgcttccaaaattcctttcaaaggtggtgtctaaattcctccttagtcattataccagtatttttttttttttttgcattgctatcctattgggtctagatattatctagaagactaagctgtttcacaattatagctacgtacagttaaaatgttcacagcatgtgaacttcaggagttttttgtttgtgttctgttttggcccgcagtcttcccagtgataaaaaacaaactgcaaatctgaatttaataggaatttaatgtaaaacgtaaattgtttctactgaaaattattcttagctgcttcatatctaacaataattcttacccctttttggttctcacccacacgtccctatcatagttctgtctttgcacaatttgccaaagtgcacaatttggcactttgaaaccaataacttaacatccacctctctttctctgccttaacctttttctcaaacttgcattttagcaataccttttgtattatgttttcagtgcttgctctgggaattacagtatacatcttaacttttcatagtttagttagagttaatcattgtacttcatataaaatgtagaaactttgccagcaggaatgtccatttaccaccaccaccttggtccattatgctgaaattgtcatgtatgttacattcacatatgccattaaccccacaaaattagtttatgatttttatcttaaataccattttaaataaagtaagcaaactcactcttctatatttaacttcgtacagtgctccattcttcttgaagagcttatttccatttggtttcccatcagatgaataattttttttagcatttcttgtggtgcagatcagttggtggtgaattctattagttttatattatctaaaaatgagttgaacttaactttgttgataggaattttgggttgacagagttgtaattttttttttccccagcaccttaaagatgttcttttactgtcttctgccctgttatgtttaatgagaagtcactggccatacaattgttactttgtatgcagtgtgtgtttttctctggcagcttccatgattttctttctttgatttttcagcaatttaagtaggatgtgcttgggtgtggttttcttaatgtcagttgtgtttaggatttgctgagcctcttgaatctataaacatatcttttataaaatttagaaaaacttagatcattgtttcttcagatacatttttctgttctattttccctctcttctgagattccagtcgcacgtgtgttaagacttctgatggtgtccttcaggctgagtcccagaagctctcgttgtcaccttctcttccccttcctcttcctcctctccccattcctgaccttccccgcttcagattgaatcatttttactgacttaccttcaggtaccctaactccttttctgtcatccccatcctactgatcacttcatccaatggagattttatttcatatactgtattttttggtaatagaatttttgtttgcttcttttttttgtattctgtttctctgctgacatttcctatcgtttcatccattatgaataaattttcttttatacccttgaatataatagcttcttttaaatccttgctgatttcaacatctgagtcatctttagaatcagcctcctttaattttttttcctcttgagaatgggtcacatttttatgggttttttttttttttgtatatcaaggaatgttagattatatcctagacattgtggctgatgggtaggtagcagagcctctttccgctgtgagcagcagtgcaaatctctgttccattattttagccttagctgggctgcttggagtctgcactgtgtgtgcatgcttctaggatcagcagagatgtgtgcagaatatatactcagaatttgaagcactccttctctgcctgtcttcattctgggatttctcccttcacttttttccgattacctttttgctagctataattgctccaaactcatttctctggttattcaagccagtaacactggcgcctgccttctcactaatggccactgaaaagtggggacccacccagtgccgttctcttccttctcatgacagctccctccagaatctggctgcctatggttgctctcccatgctgtcacagttgtttcttatatccagagtatacagttcctgtctgcaagagggttggtcaaataagagctactcacacgtagcagaaacagaaaaaggtgtcaacattttaaagtaacatttgcggtggctcatgcctgtaatctcagcaactcaggaggctgagatgggaggatcacatgagcccaggaggccaaggctgcagtgagccgtgatcgagccactgcactccagcctgggtgacagagcaaaaccccaattcaaaaaatagaaaaaaataaaggtacagtcttagtggatatcagggtttttttaaaaataattttgagatcgatacagcacaataaccaaacaaaagactttatttactgcagttggagaagcaatgagagaaatatgatttcaatatatccatgaagctggatttccagtccacctggagactaaaggccataatctccagcatcactgcttaagagaaaagagaaaaagagcagaggcataagcagtaatgctgtgatcatggcctttagctactaggtcagctacttccaggtatgccatccctagcttcatctcaaacctcagacttgttttctgcaaagacggtagggttttgtttggttttgttttgtttttaaaaggccaattccattcctttgtggtgaagcagcgttgactaattataagaaatcatgtttcaaaactggtattcccatgaacttgccaaaacaagccagttcccgcttgacttttttcccttcaaatttattgctgttctctctctgggtgttttctagattaacttaaataactgcaaacccagactgattttatatccaaagcaaattttatgatcaggatcataaaacagatccttagttttacatgattcctttaagtatcaaaatccaatcttttttaaaaagtttttcttcccatatttaataaagcaaaaagtatttattacatttaaaaggagaaatgttttgtatttgcaaagagaaaagttagtagtacagtcagtctcagggaaaatattacagaaatgaagacaaaaacacagttctttcctagtggtaaatgaggcaggtaaaatacagagctaattaacgtttacttagaagtttactaattttttattaatacatatgttgtttttccattctaacaatagttagggtagactgtgatttttacttgtaaatgacaaaacaggttcaagtaggcaggatctcctctggaattgcataactcaccagagaagcagcttgtttatctatctgttgcttcttctgggacagcttgaagaaaaacactcagaatcaattggccttttctacttctgaaaattgcctttgttggagctgtatttttgtgtcttagctgtccatactggaaatgaaggactactttcttgctcaccatcaagttgtatagggaatgttgcaggccaaaagaagaaaatcagagcaactgtttttatgtccttttactgtgaactgatcacttcaatgattttattttaaagtaagagaagtaaaaaataaaactaacactaaataaagtactcctttccccgcttcaggattctgttcctcagtggtgcacgtggatcaataaagtgtaattatcattgtgctaatgtttgttaaatgacaagtctcagctttcattgttccatctatttgcaagtttgagacttggaaaccaccattctgggaaaaaacatgagggctcatttgttgccagttcacattaggcagctaagagctttcagatggaatgtattgctactaaaaatatttatagtttgggaaaatatgcttcagtttgacctccttgatactctgcacattctagtttgttactgtggattcttcagcagctgtaaagagaaaagttcagtactgtctccttgtgccctcctactccatctatggactagtcttcccattgtaaaaacagatattttttatgagttatttatattcttggttcctctgagcagcaaattatggtttctcagaaacgttttgacaggctattttgggtatgagaatgaagtagtgagattgaaggaacttgcttcccagttgtcattatgttctttgaggaacaactcggatgtttaattaaatatcaaagtgtctataatatgcaagtgatacttagcttacaagagaaattagattcatgtctgacaactgtagggagtttacaagctaaattccacaacatggcaatatgtgattaagggctgaaatgaaacattcaggcagtaaattcagtgggtcagagaataggggaagtgtgtgtaggtagaaatatcagggcagatggagcctgagagagtcttcttgtggcaagggactccacagggtccttttagagatgcttggggaaaacagtaagtagccttaagatcagagtggcccatttcacaaaacaatctgtgtgaaataacattgcctgatgagaacccatttaaaactgagttcccgttgccttgaagaatatgtcccacttagccttctcttagcttgcctttattttaattatttgaaggagtagaagaaaagacacttgttttccccaattttttttcttgatttttatggactttttacctgtttaaaactaaaacttttacaaactctgactgagggtgtggtgtttattttaagggtgaggcaatagagagcagggcactgtaaaaccactaaccagggatgtgcttctctctcaggccagctaggccttctttgctcctggtctctgactggtctcctgctcccagtgaccattcgcaggtcctttcctgtttggccagttgagagaacaggggctgggcatggtggctcacatctgtaatcccaatactttgagaggctgaggtgggaggatcactccagcccaggagttcaagaccagcctgggtaacacagtgagatttttatttattatttaattgttacaaaaaataaaaaagaatcaaccaggcctggtgatgcacctgtagtcccagctactcggagggctgaggtgggaggattatttgagtccaggaatgatcgtgccactgaactccagcctaggctacagagttagaccctgtctcaaaaaaagaaaaaagaaattggccaggcacagtggatcacacctataatcccagcactttgggaggccagggcagggggatcacttgagcccaggagtttgagaccagcctgagcaataatagcgaaaccctgtctctttaaaaatataaataaatttaaaaagaacaggaagcttggtaatgtgctcttcttcactagtcagtagacctgctccactgatagggctttattcatccatttacctgtcatttattaattcctattatgtttcagggtctgtgctaattctgagcatttgaaaatgggccttcaggtaacaacttttggcctaatgggagcaaaagtcaaacaaacagatatttacaatgccttttggcaagagttaagagcaagttaggcactagtttctttggaagagaataaggagagtaatgtaacttagcctaaagggaggagggagcttcagggaagatttttctggaggaactactatttgacacttgaaatacaagtaggagttggccagagaaagaagagaaaggtgttccaggcaagagacacaacataaagaggcatgggagagcataatgacttcggagaacttgccaggacataaaggaagaaggtgtataggtgaggaaaaagggaagtgaagcgagattaatcacttcacttttaaaagcaatggtagttcccgccatgtgtgcacatgccctagctctaaaaaaaaaaatacatatttttaactcctttagcagccttttgaggtatggatttactggtgttttatgatctagaaagttaagatataccttcccacattttcattggtaaattctcaggactgggtgaagctatattacctcataccaaagtatcaactcctattccttatagttgtaacatctttacatttgtcaagttcaaagacattgtatatcagtgactgttttagcaggcatattcttgatctgttggtttgattgatagccagtcttagtagttgtattgctaacacttcataggtgattagatggatttgtaaaaagacatggttgctcctttgtatctcaagctctacttggatattaactcatttgaaatacttgcacaggcatatggtgtaagcctgtagtcccagttactctggaacgcaggagttcaggaccagcctgagcaacttagtaccattccatctcttttaaaaaaaaaaaaataaagaaagaaaggtaggaggccaggcatggtggctcatgcctataatcccagcactttggaaggccaaggcgggcggatcacttgaggtcaggagtttgagagcagcctggccaacatggtaaaaccccatctctactaaaaatacaaaaaattagccaggcatggtggcacatgcacctgtggtcccagctacttgggaggctgaggcaggagaatcgcttgaacctgggaggtagaggttgcagtgagctgagatcgtgccactgcacttcagcctatgcagcagagcaagactccgccccaaaaacaagaaagaaagaaagaaaaagacttagagctctttgtgggaatggtagccattagttacacaggatattatctgatggggaatttctaatagttccttctattttttaaaagcttcttgcatttcagagctcgtcacctaggttgtctaattttcatttagatattcgcaacaacccttcaagataggtagttagggaggtaccccattttgtggatgaggcttggagggacagagttgtccatggtcatctaacctgtctatggtagaatttaaacctgatgtcagtgtgactcaaactccttgagtttgattgagccttgctgttttcccatccggttttttttttaaccactaatgatccctgaatttactcagcttagttaaacatctaatagatcatgataatgcatgtattttatctatatgcagtatttgttcatttagcaaatatttaagtgtcagctatgtgccaggcactgtttcaaagtataacagaaggtgtttttttaagtcataaattaaaataaataaggaaaattgaaatataaaggtatttattttcacataagaaatggacagaaagcattgctgtgctttggtcatgtaatgctcgttacatttccaaaagcacacaaacattatgtgcttggtgtgagtctgtaactgtgacctgctgagatgctgtgactcttcctcccaaaccacccccagtgcctgggacagtgtcctctcccgcttagttctgcagctagaacgtaccaggccgagctcttctctagtgctcatcacaacatttgtgtcctgtttcagggtgtttgttgttgttgttgttgttgttgttgtttttgattttttttttttttttggtgagacaagtctcactctgtcacccaggctggagtgcagtggtgctatcttggctcactgcagcctccacctcccggactcaagcgatcccacctcagcatcccagaatgctgggattacaggcataagccaacttgcctggccctgtttcaaggttttgagttttcttttctgttagagcacctcaaagacctcgtcacgtgcatcttgcacagagcaagttagcaaagttaacaaatacttgctgaatgagcagccctcaagtaaatgccatcagaaatacccactgatgacaactaacgcttatagcagatgctctcatagccatgatctcccttaatcctcccagcagcggaggggagcgctcttctgattggaggggcagggcagagagagtggccctctcaggacccctctgctccttccccagacctggccccaaacttccctgcaccactcaccaggactcacctgggcctggcacatgagaccaggttcccaacagtgctggcacccagtgaacatcttgcctgtctgtcaaggctgctgcagaattcttaaatactgtgaagagttttgtggtgtttgctcagccatgatcatctaactggagcaagaaagaaaccaaaatcgtatcttgagaatggagtgggacttttgattaaaagcttttatgtaaaatgcttatgtgattttgggggtttttttttgaggtggagtctcattctgttgcccaggctggagtacagtggcgtgatctcagctcaccccaacctccgcctcctgggttcaagggattctcctgcctcagcctcccgagtagctggaactacaggcacgcgccaccacaccgggctaatttttgtatttttagtagaggtggggtttcactatgttggccaggctggtcttgaactcctgacctcgtgatctgcccaccttggactcccaaagtgctgggattacaggcgtgagccaccatgcccggtcctgatgtgatcatttcttgaggcagacattcccttttgttttggggatgaaaaacgtcttaacatctgtagtgatggtttgctgacttggggcagttatgaaatacattttgtctcttttcctgactcagaaggtgactgtgtaagttgagttgtgtgagaaacagcacattctagcctccagccaagcaggaatgtctttttaaacagttgagcaaattcccagattagaaagtctggtgcactgatgtcactctttcctgagtaatttttgggtggttgtttactgcacactatctaccaggagcctagaaactttgaatgagtgtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtggtaagtagcagtgttaccaacttatggggtttccagcttaaagcaagtagtattttcagaagcacttgtaaatactgttgtgtttttgcttattttcctgatcagataaagcactggttaagctgaacgataggaagattgtattgagcaatttagggagattattggccagattgctaattgatcacgtaagtgctggcgtgatcacattaggtgtgaaaagaatctgtcctcagacatgtatatgcttgataaagtgctgcgtgggatttctcagaggaattctgttctgctcaagataaactttggcatgcaaacatttcatcttggcccatccttcattttctgcaacctctttttcttaccagctgtctttttcttacctatggctgtgctttaaatggacttgcccatttggaccaaggctattctagaatcatttcgtggagagttagaaacctgatccttctttcccctgtgtataggatcctttattgttatcatctactgttagccaactggtgttccttagataactcagggtggggtctagtgtgtgctaactctgggttgtcagctcccctaagacaatgtgttgtctctctagcacaatcctggaggaagagaaggctcagcaagaagagcgcatgaggatggagtccagaagacaggccacagtgtcctgggactccggagggtctgatgaagcaccgcccaaggtagctacagtccccaccccaactttggggttactcttactaactttcaagatttacagttaggcagctgttttctatgaggagaaagtcaaatatcaggttattctaagagtaatagttataacaccaactaattgtttcctttttgctcgtcttctcgtattaccctcatgtgcactcactttcctcatttgtatttcaagtaggggctctttgaagccatgagcagttggacagatgtcatcttaaaatgcttttcctatgctgccctaacttggaggaggtttttcctttgttgattgtcagagatctccctaatgatcaagtctggattaaaataccagactaggtcacagatgctttgcattttgctttatttaaaaatgcgtctgtctctacctgaccatattcctttgttttgtttgttgagaactctgcacattttttgcctttttctttcgtagctggtggctgggttgtttgttgggaaagagagcacattgcagttgcttttgtttccttaataagatcttccggcagcatccttagaccttacttgcccgcttatgttcttatcctttactggtgccctctcctgcctcggagaggtcagcccaggccttttacagttgctgggccatgccatggctgggggttttagccagagtaacacttgccctagattaataagtctttatataccattggcttttgacaggatgctattttcacacactgggttacttgccatgaatactccagttctgttctttttctcaaaagttaaaagataataggattttttgtagttagtagttattaactaccaccatttgatatttgactagttaaaaaatatattaagaaactttgacaattattttctttatgaaaagtgttcagaaacctgataagacaaagtactatttaaatataccaatttttttatcttgaaggctgaaaacttttactttcttggtcatcattttgagctctgtaacagtaaacgtacactgaaagtgaaaataagtgattaacacaattatgcagaagtttagagacagagggtgcctcagaccagccccctctacagagagaaggaccgaggcccagagaagaaacacatacctgtctgatggatgttacattgaacgaggcagtgagaacacctgtcgtttctctgtcattcccagcttaacaacaacaggaaatccttagttacccacagaaaaaactagcacgtaccccgcatcccagcatctgaggcccttcatgttctgtttacaagtttgcctatttttaaatttgtttactactgcagaatagtccagtactgagagtcgggagaatctcatcattaacttctcaggccttgaagtcaagtggattcattcacatgggggtctgctatttacattctgatgactgagcaagtcacctacctactccaaatctcacattccttatttacaaaatgactatttgtattccctacctcttgggtggggatgttaagaagataattcactgtacagcactttatttagtacacagaagtgcaaagtaacataagtatttggtaatgagcaccaaagaatgcaacacttccctaaaactcacaggattaaatcaactcttcatctacacatttttctatatcccaatctgttggatttttagtgagtttaatatgactaattttccaaattaggttcatgggcagtggtgatgaggcttcttggcttcttttttggtttcagagtacaaagactagattggcttaaatatttaaatatccttacacttttttttttaaaagatattttcaaaatatatattttgagattcttttctataagcaggttgctgcactctacacaaaggtttatttgttaaataaacagatgaggaaactatagcccactgtgtttttgttagttttattgaaacacagttttattggaacacactcatttatttgtatattatccacagctgctttcaccctacacaggcataaatgagcagttgtggcagagacagtatagcctacacaatttaaaatatttactctttgacctttaaagaaaagatttggcaacccccagattaaaagttttaatggcggccgggcatggtggctcacccctgtaatcccagcactttgggaggccgaggcgagcagatcacctgaggtcaggaattcgagaccagcctggccaacatggtgaaaccccgtctctactaatatacaaaaatcagccagccatggtggccggcacctgtaatcccagctactcaggaggctgaggcaagataattgcttgaactcaggaggcagagattgcagtgagccgagatcacgccactgcactctagtttgggcgataaagtgagactctctcaaaaaaaaaaaaaaaaaaaaaaaaaacaaaaaacggttttaatggctagaaaatcatctaaagtagcatagatatacagatgcttgatgattattaacaaatactaatatgttaattgttgaactttcatgccaatcagaatcaagtcctgtatgcagtttttaccttctcagtgtccatcgttagaatcaaattctgcttctatggtcacagtatttagcacgtctaaaatgagtctgtgatttccaagatggtaggccagtatttcctcacttcctatactttgtgaagtgagaattcagtagattctggtgagttttcataattctgcttgtgatatattagaataagtaagtcttacttagattttttttttttttttttttttttttttttttgagacagagccttgctctattgcccgggctggagtgcagtggcgcaatcttggctcattgcaacctctgcctcctgggttcaagcaattgtcctgcctcaggcccctgagtaactgggattacaggcacctgccaccatgcctggctaatttttgtatttttagtacagacagggtttcaccatgttggccaggctggtctcaaactcctgatctcaggtgatctgcccgcctcagcctcccaaagtgctggggtttcaggtgtgaaccacccacgcccggctgtcttacttagattttttttttttatttcttccttccttcctttctttcttttttttttaaataaagatggggtcttactatgttgcccaagctctcttgagctgctgggcttaaacaatccctttgcttcggcctccagagccacttagatttctgaaatttagataggatctcaggcttctgtagataaattttgtgttattaatactaatatagaaaaattttaatgtagcttaattagttttataagtgaaaagttttgtaagttttataggtgaaaagtctttctctttcccaatcaagattcaaaattaagttcacttacaggccgggtgtggtgactcacacctataattgcggtgctttgggagactgaggtagggggatcacttgagcccaggaattggagaccggcctgggcaacaggatgagactgtctttacagaaaaatttaaaaattagccaaatttagtggcgtgtgcctgtggtcctagctactcagtggactgaggcaggaggatcgtttgagcccaggaggtctaggctgcatggagagtcatgtttgcacctttgcattccagcctgggcaacagaacaaggccttgtctcaaaaaaataaatcaataatgaaattttaattttttttaaagcttacttagttaatagtaaaagcattataaccacaaagccaattattaagaatatgtatggatcacttcatcatacttaataccaattttttcatataataataatatttagagaactttccctgagacaagccctgcatgggagtgtcccattaaatgctcattttcatctgtgcctgttgctttcctgcagattcccattggatcaatagagtgcctcaggataaaagtatcctagaacagccattctcaaagtgtagtccttggacctctgtaggtccccgtgaccattccaaaggtccgtgacatcagaactcatctgataattatgttaagatattatttgcctgaggcaggtggatcacttgaggccaggagttcgagaccagcctggccaacatggcaaaaccccgtttcaactaaaaatacaaaaattagctaagcaagttggtgcctgcacttgtagtcccagctacccaggaggctgaggcacaagaatcacttgaacccaggaggcacaggttgcactgagctgagatcgcgccactgcactccagcctgggagacagagcaagactctgtctcaaaaaacaaaaggatgttatttgccttttccgctaatagagctgctgacaccttagcacaaatcagggcagtgggatgaaattgtactagtcatcactgtgttcttcacccctgtgctcacacaaaaagaaaaaaatgctgttttacagaagaatggccttgatgaagcagtgaaaaatatctgatgtgaagacatgggaagggcatgttagccctgctgctgcacacctagacacgatgtcttatcttgaggaaagcactatacagttgagttgcaaagctggactaaacactttttttcatggaagaccagctttacttgaaagaacagctggcagacatactgttcagagttgcatatttggtagacattttctcaaaagagaaagaggtgaggctgtgactttgaagaaaacaactgtttgttaccggtataaaattcgagttttcaagcaaaaattagaattttgaaaaacttattaccgtgatcttgacagctttctaaattcttagactgttatagtaagctcaggatggtattaacatgtgatattttaaaaatatatgttgtttactgaaatgtgttaacattgggaggatctctatagctcagtaaatcagtatcttccaaatgacctacacaggatgttaaaaatcacacatgagtagaagttccattgaaagtacaagataaatagtggatttttttctccttttctccccccttaattctatggattttaatgtaacagatgataccattgtaaattccacattgcaactcacctttaagaagctaccacttgcattttggtgtcaaatcaaaaaacaataccacagttgtgcccagaatctaccaaaatactcctcccttttccagttgtacagctgtatgagtttactttttttcccctcatatattgcaacaaaacagaacatcgtaagactgcagaaacagatatgagaacctgctgccttctgttaagcctaacattaaagcagatttacatcagtgtagatgtacatgtgtccttcttctcagtttggtttgtttggttttgaaaaagtaggttttttttttttagtatgtgatgagcttattcttaagtgaattaataaatactttttagtatctgttttaatttctaacagtatgagtgttggtagttatattccaaataaacaaaaactcttagagtcctcagtaatttttaagactgtaaaggggtcctgaaaatgattaaatgtttgagaataactgcctcagaacattgttcttcaaccctaatcaaacccagcacggcatttatataaaaaatgattttataatgtcccatttgctaatcctgaaataaaatacataggtaatagaatgacttagcaatttcaaaatatcaatggaggaatactagtgtttggagacctaactatacaggagaaataaaaggaaagtcattttttataacattatgcatgcatgtataaagcactcagatctgatgacattgggagacacggtggcatagccagatccttacacctgtttgtggactcaccatgaatacagcagtgacaaagcagacccccacggctataactgataggaatttcattggtcttggtgatgtcattttctagaatggtaagaaaatcttggtaaagtttaaatgaaacaaaataaaattgcccatcagtatacacagtagttgctgttctggaaagttcagtgcctcataaactatacaaaatatctatacaaactatacaaaatatataaagcagaattcattctgtgttcaagtgacagggattttattgttgctgttgttttacttacataaaattgagagaaacagcagaaagtcctgcgggggccgggcatggtggctcacgcctgtaaccccagcactttgggcagccaagatgagctgatcacttgaggccagtagttcgagaccagcctgggcaacatggcgaaaccctgtctgtactaaaaatacaaaaattagccaggtgtggtggtatgcacctataatcccagctatttgggaggctgaggcacgagaatcgcttaaactcaggaggcagaggttgcagcgagccgagatcacgccactgcactctagcctgggcgacagaacaagactccatctcaaaaaataaaaatataaaaattagctgggtgtgattgcacatgcctgtaatcccagctacttgggagtctgaggcatgagaatcactcaaactcgggaggcagaggttgcagtgagccgagatcgtgccactgcactccagcctaggcgacagagcgtgactgtctcaaaacaaaagaaagaagtcccgcgggatatgaaacaaatcctgctgttcaggcctgtccttctcattgccagaaatctcacatgctgacctctaccttaatgccaattgtgtgatcatggaaagcaccctcactaatacagttctgccttgatatctgcaagggatggagattcaaatccacagatgcataaattccttatataaaatagcacagaattgcatataacctacatacctcttccagtatacttatttttgttgttgttgttggcttgttctgttttttgagacagagtctcactctgttgcccaggctgcagtgccatggtgcgatctcggctcaccgcaacctctacctcccgggttcaagctattctcactcctcagcctcccaagtagctgggattacaggagtgtgccaccacgcctggctaatttttttgtatttttagtaaagacagggtttcaccatgttgaccaggctggtctcaaactcctgacctcaggtgatctgcccaccacggcctcccaaagtcttgaaccatcacgcccggcccatcttcccatctttcagtatactttaaattattttaaatatagatacagattttttttttttttttttgagacaaggtctcgctctgttgcccaggctggagtgcagtgatatgatctcaggtcactgcaacctccacttcctgggcttaagtgattctccagcctctgcctcctgagtagctgggactataggtgcaagccaccattgcccagctgattttcatattttttgaaatatgaaaatcttctcatatttttttcaccgtgttgcctaggctggtctcaaactcctgagctcaaagcaatctgcctgcctcagccttccaaagtgctgagattacagacatgagccactgcacccggcttacatagttattatacttatctttttgtttgtattattttttattgttgttttttgtttttttcctgtatgttttcaatctgcaattggttgaatctatggatgctgggcctttggatatggagggctgactgtaccctaaatgcttctgaaggaacagtgccatccagttgaggacctctggtttagaataccagtgtcttcctttctctccttcctcattagggagaatttcagcaaaacttccctgttccatattttgcttcattaaaatccaagtttctgtcttggaggaggaagtgtcatgaccttgctaactcatcgtacttaccagcagttgacacttttggactcatatgaaagccattttcaaagatcttgacatatattaacatatttaatcttcacggcagctccaggaggtagctgctggttattgtactccttttatcattgacaatagggagacacagagagctgaagcaccctaactgtgaacactgacagtctggctcaaagcctgccctcttgaccaccatgctaacctctgatttgtagagaacagaagtagagctattttaccaatacatttgcactctccatggctgttggttagcaacatttgattttgtgttgtcctttgtgcaaatattttgtctatcataaaacatattttcaactttttaccttttatttttattttgaaatggaaccttgtgttatcatttgctacccagttaagtctttgcatcactgtgagatattttacattggttttgccattctctgatctatttgttttgtatgttcctttttatttggtgagtcagaagtatgcttgtcatagaatagcatcatggcacagtagattttggagtcacgcagttccaccattaccacctatatgcccctatttaaattgcccaatttatttgagactgtaaaataggggttataatattgcttcatagcaatgtggtgatcaaaattatcaaattgtatgtaaagtaggtagttcagtacacacagaatacacactaaattgtaacttttttttttttttttttgcctgaatttatcaagagtacatcactgtgcaactgtcagctctgtttattgttctggtccctggctctgcctccttccattcttggactccaagagcatttgattcagaaaaccctttcccctgcaaccatcattaatgcgtatatattaacacatatctttaaaacaagtaccaaggtagccgaactcttttttttaacctcttttaattcagcacaaccactttgtagaacacactttggaaattgccaccctagcacacacagtagagaaaagcctagaatgctctctttatacccttttcctgtttggggtgtttttgggggaattcatgttgttatttagttaagtttagagtagactctatctggaacactgtttgaaacgtgacagggttaagccaaaaggaaggatttttcaccctcaggaatttaacagctcataatagcagggctagagcaagtgcaaaagtacctgcaaccgaaggtagggtgtgaaaaaggcctccttaggagagcagaggacatatgtttatgttaggctggcaaaatcacgagctgttgcgtgaaagaagtaacatctaaaagactgaaaggatcagaagtatactacagatggaaggaggagacattccaggcagaggggacagtataagcaaaactgagggggaaatgagacagattttagagaccaaaacatactccggacctaactagagcaaagcacgtgttcacccagcactgtgggagagacagacagacactaaggcgttttctttcctaagcttgttggaacttaaatctatttccttttattctgtacttaatttggctagacagtaatgggtttccaccttgttaaaccccccaagttttaaaagactttattgacttctttcagacttctgtttcagactaaattgttctttcactatgaactttgaattcatttatcccacaaacaaaatgagaatttaagacctggaagtgactttagagatcctgtagctcacccccatcttatgggtgaggaactagaagccagtcagtttcgtcacttgatcacagtcacgcaaccgggaagtagtcaaacaatagaacacaagtgccttctctccaggtcccagactactggacagagagcatttgggtccctcaggctcagaatattcagtatcccattttgttattaatgatactttaatagctttattaagatacaatttacataccatacaatttatccattgaaagtgtgcagttcggctgggcacagtggttcactcctgtagtcccagcactgtgggaggctgaggcaggcagatcacttaagaccaggagttcaagaccagcctggccaacatggcaaaaccccatctctactgtaaatacaaaaattagcctggtgaggtgccgctgcctgtaatcccagctacttgagaggctgaggcacgagaatcactcaaacccgggaggcagtggttgcagtgagccgggattataccttgcactccagcctatacggcagtctcaactcaaataaataaattgtacaattcgatgtttttttagtatattcagagttgtgcaaccatcgccacaaccagttttaggacttttgttttgtttttagtagagacggggtctcaccgtgtgatccacctcggcctcccaaagtgctgggattataggcgtgagccatagcgcccagcctataacatttttatcacccccaaaatgaaatccttcacccattagcagtcattccccatctcctcctccttccaacccctggcaaccacttatgtacttgctatctatattaatctttcctattctagatatttcattaaagaaatcatatgttctttgtgactggcttttttcacttagaatgtttcaaaaattcatccatgttgtagcatgtgtcagtattttattccctttaattacaaataatgtccctttcgtaggtatacagcattttgtttatccagttatatcagttgacggacatggactgttccccctttttatctattgtgaataatgctgttaagaacattcatgtacatgtttgtgtttacttaatttgtttttttcaaaggtacagtcttgctacgttgcccaggctggcctctaattcctcggctcaagcaactctctcactttagcctcctgagtagctgatctacatgtttttgtgtggatatatattttcatgtctctggactttacatatacctgaaagtagaattgctggatcatatactaattctttatttaatttttaaggaatagccatactgtcttccatagtgactacaccattttacattcccaacagactggcctgattggttttcaactcctggcctcaaaggatccgcccaccccagcctcccaaagtgctgggattacaggcatgagctaccatgccctgcccaagatatactcttaagttttcttctaagaatcttagtttttaacttttacatttagacctgtacctgtaattcattttgagttaatttttgtgcatgtgggaggaagaggtcagacttcagtttttcacatgtagctatccagttgccacagcatcatttgttgaaaagactgttctttccctattgaaatgtcttagcatctttttatcattcttttcaagtaagctctattaggaaaatgtctttttcgattcataaagtacaggtttgtcaaaatcaaaaggttcattcatatgatgctctcttgattttacagcccagcagaccgggttatcccagtccgaggtccagcgaaggattttatcccagcccacagcacatggtacaaaccaatcattaccaggtatgccagtcattacagatataaactgtgttattttattatttagcgcttttggggtagagcggtacattgtgcatatttttatttatgtacttatgagtatgatttggccgatagaaagctgagaaagtggttaccctaatcattgaatgatgttgtcttgacaccccacgcagaaggcgtttgtttttcactccatcttcgagtgggcaggaccagggcctgctgccattcttaggcacgttttcatccacttgctgtggtaaagggcaaggtgaagccagtgggcacacacactgcagagggagtactgaactggacagtttttatggaaggcaagaacaaaattcaaaattaacagaacccagatgaaataccatatggacaagtgtgaaaagtgttagatttatagatagatatcctgtgcaaattagaaaaaattatccttcaaagaaaaggacttgacacaaagtaaacaattcatttgtttttgagaaaaagttattaacttttactggggtataccttacaatgcacaggtctttgttccgagaggtgcataccccagtgcatcccatcctcacttcaggatatagagcgtgtctgtgaccccggcagttcctttgtgccccttcccatcaggcacctcctgccccaggagcaaccattcttctcacttctagtatcagaggtttctgcctgttctagaattttatataaatagatcatatagagtgtgctttttagggcttatctttttttactcgtaatgtctgtagaagtcagagtcctattgaaggtgtcagtacttaacctttcctacttccttcacagagttgttgaaagcgtggtttaaattaaggcctcttgggtcaaaatgggcaaaaaatcttaactattggtacttaactgtcagtaataagggagaatgtaagcactttcttattggaaaagatatgtcagtggtagtttagaacagcaaattttagcctctttatctagccgccagattctaatgtctaattctggagcccaagaatagcttattgttaacaagcagcctcagtaggttctgaggcagatgactcagacctgtgttttgggagacactgttctgagatggccacttgcctggcagagtcaagagtgaatcatttgagttttcgagggcacctgtctgttcattcagcaaggttgcactgaatgttcatctactctgcctggtactattctagggactgggaatatgaagacaaataaagtactcttttttctcatggaaggagctcacagggccctttgtcagtttggattactaccatttccataagtgaagaagccaaaaccctgacccagcacaagggtcagagcaatgggaagtacgtaggtggcctaaagaaagaaaccccacctctatgattgctgagagaccctgacctctggcagacaagcagatgggccccaggggaacagcccgagtctgtgcctggctggtatggaaagtgaactggccctgagtgggaattgaataccagcattgttttgagaaaacatgcagcacctgcttaatgagacaagctgttagcagagagacagttctctttgtgtcccagcaggcctggtctgcggcactgtcaagatttgaaactctagtacgtgtttgttagtggctgtctgtcaccagtgcagtggaagcccctgagagtggggacttgtctctaagggcttagaacggtgtgtaaaaatgagtaaatagagaattaagtaaaacattgatttttttcattgaactaatgtatgattaacctttcccaagcccaaattctcctctcttgtaaatgagaccaactatgagacatttcctgatgttacttcatttttagcctaaagtgatccttctacatggttactattatgtagaaaactgccttagaccattttaaacctccttgttgtgaaaattcctaaatgttttctggcaataatacatcccttttcaccagaaatcttgatagagcattttgcatttagtagcagtttttattattattttcattcaaataaactgtgagaactaactatatgtcttacttgaagattcattaatttcatattgtccatatgaaattttggtataaattaatgcctagagacctaataaatgcacaaaacctttgttgaaggatgtgttgatatttggaaatacggttttggctgtgctttatctcactaaaaaattaactgacaacacccaccatacaacactagcctaatgaggtgtggaaaccaatactgattctgttctctttctcttgattgagagaaggaaccatgtaaagaaacccatcttattttccctctgccttgaaatttttctctatgtccaactgaatgtcttctctctgccttagtcatcattgttagaacttaaaggtacgacttatcctaccatcagctcccaggtcattagaggacaaacatttgggggattttttgtgtatttttgttgttgttgttattcttgttgggggatagtggttgttgggcaggaaaggggatttctagagcaaagtatggcacagacatttttgtggcttcctgttgcttttgcatccaaggatggcctgccctcattattttagtaaatgtgaaattccaaagaaacaatttcttgttttctagtatatatttgcactagctctctaatgcagccataacaaatgtcctttcttgagattttagctgagagtccatttccttgccttatcagcttctacagggcacctacatgccttggctcatggtccccttactccatgttctgaaaccagaagtttttattttctttttttttttgagacggagtctctctctgtcacccaggctggagtgcaatggcccgatctcggctcactgcaagctccgcctcccgggttcattctcctgccttagcctcccaattagctgggactacaggctactcctgaccttgtgatccgcctgcctcggcctcccaaagtgctaggattacaggctagagccaccgtgcctggcccagagccagcagtactaactctctctgacccttcttcagtggtcccattgtccctccctcctcttatgcttccctcttgcacttttaaggacccttgtaattacactggactcactcagatatcccagataccctcccatcccaaggtccttgacttataaccacatctgcaaagtctcttttgccacgtaaggaaacatattcacatgttcaagggattagaacatgggtatctttggggggccataattctgcctaccacaatattctctgtaattttagtttcctttgtgtgtgaagcagaactgtgcagatgttatagttgaacattaccttgcctccttactcattcacaggtttctggctaccctggttcacatggaatcacagccatggctggcagcatctatccaggtcaggcatctcttttggaccaaacagattcatggaatcatagacctcaggagatagcaatgtggcagcccaatgtggaggtaaatcgggtgtcttgggcttcagtttgttaacttataaagcatggcaaagctgggcatggtggcttacacttgtaatcctagcacttttgggaggctgaagtaggaggattgcttgagccccagagtttgaaaccagactgggcaacatagcgagaccctgggtgactccagcctgggtgacagagagagactccgtctcaaaaaaaaaaagaaaataaaaacttctggtttcagaacatggagtaaggggaccatgagccaaggcatgtaggtgccctgtagaagctgataaggcaaggaaatggactctcagctaaaatctcaagaaaggacatttgtctctacaaatgtagagacattttgtctctacaaaaaatagaaaattagtcacgtatggtggtatgtgcctgtagtcccagctactcgggatgctggggtgagaggatcatttgagcctaggaagtcgagactgcagtgagccgagatcatgccactgcactccagcctgggcaacagagcaagagcttgtctcaaaaaaaaaaaaaaaaggtaataaataaagcatggcctaaggtaccttttatttctaaatcctaagatttattgattttaatgacttttttttttttttttttttttttggagacagagtcttactctgtctcccaggctggagtgcagtggcacgatcttggcttactgcaacctccgcctcccaggttcaagcaattctcccgcctcagcctccagagcagcttggattacaagtgcgagccaccacgcccagttaatttttgtattttttagtagagacagagtttcaccatgttggccaggctggtctcgaacttctgacttcaagtgatccacccacctcaccctcccaaagtgctggggttgcaggcttgagccaccacgcccggtcatattttaatgacttaattcaaagatcaggataccccatctactcaaatgctttcaggtttaatgaactttttttaactaaaagaacccagggagaaatactaaaatctttagtccatttatttgaaaggcaaagccctaagtggactatcgtcagcatgtacatgaggccaacgaagaaacaggaagacagagcattcagttctttggaccatgttaatttttactaaattttcttggtaaaaccaagaactactcctatagtttaaaaatttatttgacctaggtacagtaacacaacccatagttgcatctactcaggaggctgaggtgggtagataacttgagcctaggagtttgaggccagcctgggcaacatagcaagaccccatctcattaaaaagacaaaaaattacttatttgaatgaaagagcatctatagttgtctgctatttatgttcttttatttaatatttaatactctgtaatatgtattgtatttcagccttctattacttctagattgtttctacttttttactataagtaacaatgtattctttgcacatatcttgtgttatttctttaaaatagacccttacaagtgaatctgtgagctaaaggattgcatactttttaaagatgcttgatgcacattaaattgccccctacagaaaagttattcccacaagcacagtatgagagatcctgtttctcatacttgctgttttgcttatcttttcttgaaagacacataaaacaaggtaagagcataggaatagacttatgagactgaatatgctgttttcaacccttcttccaggactctacagtattggacctgcgagggattgggcaagtgttgccaacccatctgatggaagagcgtctaatccgacagcaacaggaaatggaagaagatcagcgctggctggaaaaagaggaaagatttctggtaattgtgtttctgaaaggcttctttgactttttaagccctgttagagtctactatattgcaaattattgcaaaatgttatctttcaaagcaggagagttagttttacaactacttcttaaaacttggaataggccaggcatggtggcctatttgggaggctgaggcaagcagatcacctgaggtcaggagttcgagaccagcctggccaacatggtgaaaccctgtctctactaaaaatacaaaaagtagccgggtgcatgcctgtaatcccagctacttgggaggctgaggcaggagaatcgcctgaacccaggaggtggaggttgcagtgagccgagatcatgccattgcattccagcctgggcgacgagtgaaactccatctcaaaaaaaaaaaaaaactacttgaaataatatggctggatgtggtggttaatgcctaaaatcccagtgctttgggaggccaaggcaggaggatcacttgagcccaggagttcaagaccagcctgggcaacacagcaagaccctgtctctacaaaaaataaaaaaaaaaattagccaggcattgtggctcacacctgtagtcccaaatatttgagaggctaagactgagtccaggagttctagattacggtaagctatgattgtgccactgccctctaatagatccagaatcctatatccaaaacccttaagggccatgtgtgtttcagaattcagtattttttaaatactaaaaagttagtgtagtatgctgaacattatacattatttaagactctaatagcatcccagagttaaaaccactagtgtttctgcagcagaatgcaaataatcacattaacagttaaatgaagattataagatgcttcatcggttcaggttttactaccatattagtttgtttcaaacataaaaaacacacttaacattttcagcactttttaggttttggaaatgaggatagaggaatgtggacctgtccatttattatcttcattttaacagaacaggaaatagagatctagagagaccctgggccacagagcaagactctgtctcctaaggaaaaaaaaaaaacttgcaataatgggttatttgcttttttaattatcttttagggataaatttctctaaaattttagtagtgtcattatgggctcagaaatatgagcatttgtttggtttttgcattaccacattgtttacccagaaacaactcctgcttccatgtcagcttacgtataaactattgcatcttgctactgcaggctgtataacaagacagctaagatttgccttcctggcatttatgactgatgtgaacctcctcccggatgtgtctggacatatgcatgggaaatgtcttctttcaggcaacccttattgaaaaccacttcagaagtcccttggggacagagaggaagtggtgggacagagcaatctctgtatgttacttgacacaaaggtccttttagactcctggtccctgttgccaagcagttctatgccctcagcctcagaactaaggactgtgagaacccattccccactctccttgaacccagaatagctatttcaatcttcctgtagttgcctcaatcgtattatggctgaaagaagccaggattcataattttgagccagtaactttacctggtctctcatgctttgtatcattaaacattcactgacactaactttgtgttaaatttaactaatttagaatttcgaaagcataggataaaactttccttctgaattaaagcaaatcttgagattgtaaggcagatgggaaaaaaaaattgttatttttggcctggcacggtggatcacacctgtaatccatcccagcactttgggaggccaaggtgggcagatcacttgaggccaggagttcgagaccagcctagcccacatggtgaaaccccgtctctactaaaaaaaaaaaaaaaaaaaaaaaaatacaaaaattaggcaggtgcagtggctcatgcctataatcccagcacttcgggaggctgaggcgggctgatcacttgaggtcagaagttcgagaccagcctggccaatgtggcaaaaccccatctgtactaaaaatacaaaaattagccagatgtggtgatgcatgcctgtaatcccagctattcaggaggctgaggcagaagaattacttgaacccaggaggcggaggttgcagtgagccaagatggcgcagtgtactccagcctgggtgacagagtgaaactccgtctcaaaaaaacaaaaattagccaggcatggtggcacacacctgtagtcccagctattcaggaggttgaggcatgagaattgcttgaacccaggaggtgggtggttgcagtgagccaagatggtaccactgcactccagcctgggtgacagagtcagactctgtctggaaaaaaagaaaaaatatgttattatttactaccactaatctgagtgaattaatttggatattatatctattctaagaacatatctactgttctctagtcctacattttaaacctattttttgtctagatagcctcttttaccagacagaattgatttgtgtttttaaaagtagatattataaattctccaaactagagttcttgtatttcagtcccacgtatgactgcatttggacaaagggtttgctaccaaatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtgtcactagggggacttgggggaggcaccaaagtatagatagcatttgagccaaagcttaaaggagaaattggaatttttagggcagacaggctcaggaaatacattccaggaaaagcgaagagtgcgggtaatgacatggagtcaaaaggctatattccagccaggcccagtgactataatctcagcttctcggcaggttgaggcagggagatcgcttaagtctaggagtttgagactagcctgggcttagcaagaccctgtggcaaaaaaaaaaaaaaaaaaaaaaaaaaacagtaaaccctaaagggaggaggatcaagtacccagaattcctacaatatattatctaaaatgtctaatctccaacaaaaaattacaagacatacaaaggaacagaaatatatatgaatgatagacaaaagaaaaaaagactgttctggctgggcacagtggctcatgcctgtaaccccagcactttgagaggcagaggtcaggagttcgagaccggcctggccaacatggtgaaaccccatctgtactgaaatacaaaactggcatgcctataatccaggctacttgggaggctgaggcaggagaatcgtttgaacccgggaggcggaggttgcagtaagccaagatcgtgccactgcactccagcctgggcaacagagcaagactccgtttaaaaacacacacacacacacacacacacacacacacacaaaccgtattctaagaacttcctgtagctagatgtgagcaaagcagagcatgtttgtggggaaatggaaaatacttctcactatgtggtgtttttttttttgtttgtttttgtttttaacttaataaccatgtaattggagcatcttcatttggtcctaaacctgtctgttgggtaacctctgagatagtttgcctggtgctaaacttggaggccatgatggcatcgaggcactttcccactcaagtacctttccttttttttttttttttttttttttttccggaaacagggtctcacactgtcacccagggtaaagtgcagtggcacaatcacggctcactccagccttgacctcctgggctcaatctgtcctcccacctcagcctcccaagtagctgggactacagtcacgcaccaccacgcccagctaatttttgtatttttggtagagtttcatcatgttggccaggctggaacaagtacctttcttaatgcctgtgagatggtattgtatttttctctttgcttgttttccttacttagactgagcaccccatgagtgcagagaccatggaccatgtctttcctattccccattcagtccaccatgccgagcatatggaaagctgtcagtgttgactgattaaatgaaagtttcttttttctcttttatgagtttatttttttctttttgtaaatgagtgttttttaactcatgccttttctcatgctgctgtgtctgcctggaatgctcagggaatctgcctgaggaacacctttttgtctttaaagattatttttgtgtcatctcaaggacgacacattccctacaccagggtttctcagcctgggcattgttgacctctggggctgggtaattctttgttgtaggaggctgtcctatgaatagtaggagttcttagcaacatccctggcctctacccacaaggtgccagagaaccttactgagcgccaagcgtgaagcttgaattaacttattttattatgatgtgcactactgcgttctctcccccaaccccctgcactctcacacatgctcactctcactctctttctctaataaaacgtaagttccttaagggcaacaactgtgacttaactgcctttatcctgcttcatttttcttctaatgtttctcactgtatgacaatgtctcacttgttttcctgtctcctccactaaagtgtaagcatcacaaagatgggaactttctttattcagcactctcccccagctcccatcgtaccgtttgttcagcagtaataaggctcagccagcatttattaagcgaatgaatgaatgtaccaccgtacagtgttaagcatctaaacgttagaggcccagaggaaggaggagtcccggacaggaatcatagcgttggtgtcactgtttttcatctaaatgaaaaataaaaacaagtcatacatgaaccctggggaagtagatattataattattttagaaatgaataaattaaaatttaatatacataaaagtcacaggggaccttttaaaattcagttccccaggactagagaactgcagtggatctggagaggccaaggacctagagtgataacaagcaccccagttgattgttgagacgtggtcccaaggtcactctctgattacttaggcttggcaatgcttttcaagatttgaagcagatggcatctcagaaagatcaccttagggctgggcactgtggctcatgcctgtaatcccagtactttgggaggctgaggcggatggatcatctgaggtcaggagttcaagaccaacatggccaaaccccatctctactaaaaatacaaaaattagccaggcgtggtggcactctcctgtaatcccagctactcaggaggctgcagcagcagaattgcttgaacccaagaggcagacgttgcagtgagctgagattgttccactacactccagcctgggtgacagagtgagactctgtctcaaaaaaaaaaaaaaaataggaccaccttagcgttgcttgctgactgatggctcagaaggcaagataggaaatgcagagatccaataggaagttgagtggtcattcaaataaatgacagcagggtctaagctggaagaggcaaagtgggaaggagcagagaagacggacttaaaagggacaagatttggtgaattggtataggaggtcaagaggaaggaagaatccgggacaggaatcatagcattggtgtcaccaaaaataacattgtgctaccaaatgaaataaaattcagaatgaggagtccatgtcagggaaacatgatgatgccaggtttggacatttgggatatgcaaatgggaatgcagaggaggcagctggatatagggcatagagcccagaggaggtggtctgcgctggagatgcagatttttagacagccgcatggaaagcttggtgcactgggaataacgcctggtgcggtgtagtgtgagggccaccctgaccctctgtcagttggaaggtagtgtgtgtcggttgtagaagctctcgtgacactgtcaagtggtgatggtggcagctaggtctctggttatgagcacacgtgctttatggtccttaatttggtgaagagactctaacaatggtaattatatctcgttgtggtcctttttatgctgtgtatgtgtaaaaattactgttggtttccatggtatctgctatttacaagcttgtttctgggtcttggcctttggcatgagctaggcccagagctattggtctgtgtccttgcaaccaccaggccaggccgctgcacctacttttaggttaatcaggtcattgttgaagctgtgtgtcagaagtctttctctcctgttaggccaaggaaacttccaatacagggcttctcagactgcatggaagggccagtttgtatctttctttctaaaccgttgcagaccaatactcttgtaaaataaaatttcaaaatcattgactagaaaaagacataaaaatataagccagacttttttgacagcccaaaaattactgtttcaaattgctataaaaatgtctaaagatgcttaccaggccgggtgcggtggctcacacctgtaatcccagcattttgggaggccgaggcagacggatcacgaggtcaggagatcgagaccatcctggctaacatggtgaaaccccgtctctactaaaaaatacaaaaaattagctgggcgtagtggcaggtgcctgtagtcccagctactcaggaggctaaggcaggagaatggcgtgaacccgggaggcggagcttgcagtgagccgagatcgcgccactgcactccagcctgggcgacagagcgagactccatctcaaaaaaaaaaaaaaaagaaaagaaaagaaaaaaagatgcttagcttctgttttcatcttcataaactggttcattcctagacccacccaggcctactgctctggccctgccatttacttcagtaaggtcagctgtgcaccctattagataagttctgttcttgtttgaaaaattaacttgctttgtcagtagtattacccaaattttagatgtcagaagacatctgttttgacatctgttttcagagatcacatcatcacatcattttttatggttgctactgctagtcacatctcttactttttgagtacttcagtgggtcaggagtccctcctctggatctctgcattatctcaacaaccctgcacagaatgtgttttatgatagcagcccggatgctcttgcccaaggtcacatggccccacagcagatactctgtactatacctagtgctcccttttttttttttttttttttttttaaattgagacaaagtctcactctgtggccctggctggagtgcagtggcacaatactagttcactgcatctctaacctcctgggctcaagtcatcctcctgcctcagcctccttccagagtagctgcgactacgggcatatgctaccaagcctggctaattttgttacttttttttatagagatagggtctcactttgttgtccatgctggtctcaaactcctgggctcaagcagttctcccaccatggcttcacaaaatgttgggattacaggcgtgagtcaccacgcctggccccacactcccttttcttgttcccagatcagatactgtcctttctgaaatagttctgtgcctgcaaatatactctgaaagctgtcctacaaagtgagtgccagagattgctggcaaccttagttagaacctcagttggttgaaagagctttctttcccattgggcattgcttaaaaatagagtaactttgcaacttgctttttttttttattactgcatgcacaataattttctaatgtgatactatgcttaaaacaggattttaattttaaatgagaaagccctatctatataaagcctactttgtgttttgagaaagaaatatgtgagcatttttccctcacatagcagatccagtcagtctgaatgaaagatgaatgccgagacggggaactaaagagcagtggcaagaggctgtctgtctgaagccaggctgctgtccctgcttctgctacgcagcaaggccaacagctctcctattttttccctcataccagattccagatttgaaagcaatacagtatagtgaaaggagaaaagactgagctataaaccttaaatttgaagttttctagagccatacccacatgaaagtagagactgtagctaagccgaactgtttttttttttggcttgtttgtttttgtttgttttgagacgaagtcttactcttgtcccccaggctggagtgaaatggcgcaatcttggcacactgcaacctccgcctcccgggtttaagcgattctcctgcttcagcctcccgactagctgggactgcaggtgcctgccaccatgcccggctaatttttgtatttttagtagagatggggtttcaccatgttggccaggctggtcttgaactcctgacctcaggtgatccacccacctcggcctcccatagtgctgggattacaggtgttagccactgcacctggctgagaatctattctttctgattggctgtctttggctgtattgctcttcagttcccaataggcactcatctttcattcaggaggtccgtgtatgctctatgaaaagaaaaagctcaagtatttatttcattcacagaacacaagtagattttatatggataagcctttctcattttaaaattaaaatcctgtctttaggaaaataccacattagggaattatgcattaaagaaagtcatttcatgaaatgtatatggaaataaaaatagattaattcatgtaaacacatgaaacaataccttattctataggcaaaaatatgagttgcattttttgtttaagtaaaacagtaaatatttcctgcctgtagaaggttcttattatctgttgactgattgaagcccacctccactgtttaagagctgtgttaccccaagcaactaaatctttctaagtcaagttcctcgtctataacatatctcttgtgccttggatattaattgaagcattccttcagcaaatatttactacacatctatgtgcacaatgctgccaggcacttctttcattctgataatgactgactgaggtattattctgcctattttacaggtgaggaactgggcctagagaggttatatgccttgtccaaagaggcatggacaatcagttcactagaaaaatgcacagggcattcatttcctccacctgtttgtccggtgttctagcaggtaacagagacgcagcggtgaggcagacagcttcatagcctctgtcttcatggaacttagcatctcatgataagaaacaaaaatggtcaactatttggggaaagggaggaggagaggagcaaattacaacaatatattatacagtattttctttatgaattggttgagagttttaaaatgataatacagtggtgttagggtacagtgagagaaatgctatcacatattactacatagatgaaaatcaggacagccttgagcagtttggaaacttataccaagatttttcaaatgttcaaactctttgacttagtaattcctttcttagaaatctgctccagagacaggaagatcacttgagcacaggagtttaagaccagcctggataacatagtgagaccccccccccccaaccatctctaaaagaagaagaaaagaaatctgtcccagggaaataatcagggacttagtcaaagatttgtatacaaaggtgttcatctacagcctatttatgagggattttgaaaatgaccctaatatccaacaataaaagaactatttattttaactcttgtgtggcaccaacttagtactttgcaaatattaactcatttcatcctcctaacaatcctatgtgttggttacaattactgttccattttagaaatgaagaaattgaggcccaggtcacacagcttgtaaggactggatcctcattagaacccaggccacctggtgccacagctcccacccttcactaccattgtctattttatgatgataatcatgcagtggaacgttgtgcagccttaaacattgttttgtcagtttgccctatataaatgttatgtgaaggctgtagaatcatatgttgtggttccatgtttgtaaacatacatttacaccacagtattaactaatgataattacttttacattttaattactccataataactaatgataattacttccaaatggtaaggttgagtgatttgtaattttttcatctatttttgcagtatcttaatttttctacagtaagtgcatgtttcttttgttagattattgacaaatgaggtatacaatattttaaaataaccaaaatcatgtaactattaaatgaccacatcgtaagttgggcctggtgggtcttttgttttcttagactatagctctaactgggcgtggtggcgtgcatgtatagtcccagctactccagaaactgaggcggatgattgcttgaggccaggagttcgaggctgtaatgcactatgattgtgcctgtgaatagtcgctgcactctgacctgggcggcagatcaagaccctgtctcttaaaaatagaaactgttggcctggcgcggtggctcacgcctgtaatcccagcactttgggaggccgaggcgggcagatcatgaggtcaggtgatcgagaccatcctggctaacccagtgaaaccccatctctactgaaaatacaaaaaattagccgggcgtggtggcggacgcctgtagtcccagctactcagaaggctgaggcaggagaatggcatgaacccgggaggcagagcttgcagtgagctgagatcatgccactgcactccagcctgggagacagagggagactccgtctcaaaaaaataaataaataaaaaatgaaaataaaaacttgtcctttctgctacagtagagtcaaacctaatcacctccactctctgtttagagcccttcaacagaacccctaagcagaaccagctcccagctggtccctcaagtgaatgggcagaagaggaaaggatagtttcagagttttttaaagttacaagaatggtacaaagaattcccatgttccctttacctagagtctccagttgttaacatttgacctcatttgctttgcatatttgtacataccattttttctgaaccatttggaagtaaataccagatatcctgctttttaactcttaaatagttcaatgtgaatttcctaaaaataaggatgttctcttaaataaccatagctgagttaaccaatgtcaggaaattaacaataatacaatactgttagctaatcaatggactattcatattttaccagttgtccacagaatgccctttctagaaaaaagtcctggatcatgagttatatttagttatcacatctcttgagtttcctttaagcttgaacagttcctgggtcttcccgaaatctttcctgaccttgatatttacattgagtaatgttctgtgaattgtcaacctggagtctcgtcttctcaggtactttttctcaaagtccattgtgttttggaatattttttcttaagcatatctgggatgtttgggccccacaaagctgcctcttcattcaggcagtggcagaacctcagcattccatggaataggatctgtgagttctgctacatggaataggacctccccagtgagttccccttcagttgccagttggaatcaatgtattacgtgtgtttgcttggtttcctttctgtctattcatgtctatcttacctgtcagagaagattctatcctagaagtcaggaactacctacctctgaattttctcttgagctatatttcacacccagccacagctgtctatatctaatgggatagtcctctctggtaaaaaacacagcatactttctgccatagtcgccaactgcatgcctctaggtttgacttcccctgtatgggcattagttatatatatcacatctgcagtaagaattcattttttaaattattgttccttgatattatagtacatataaacacagtacaatgttttaagttatgctcttcagagttcagaaatatttattctgaacttttctggtttactcattgagagagttctaacagagcagagtcttgcttagtcacccaggctgtagtgcagtggtacaatggtagctcactacagcctcaaactcctgggctcaaaccatcgccccacctcagcctctccagtagctgggactcaggcacacaccaccattcccagctaattgttaaaatttttttctttgtagagatgagttctcactatgttgcccaggctggtcttgatatcctggcctcaaagggtcctcccacctcagcctcccagataggtgaaattgcaggcacacaccaccacacccaacgctacatttgaggatttaggtcatttttcatctatatttaactattgcttttaaatgaatatttttacgtgaaagggaacgtgtttttttatatagtagcatggaggttaattcagtcaacactgatgtgttgagtgcgcaccaaccaggaactgtgccaggcactagggatatggggctgatatacatgagctgttttgtaattctgttgaatgaacagataagtaagttgtgacttttgccctctttgcttactgtctgctactgctgtcagggctgtctattctgtttcaggatgcctctgattattagaatgtttttccataagtgatccaaaatctgccctaaattcagggacaacacacaagtttcaccttttcccatatggaatccctgaggactgttaacaacaatcagccagagcccccttttagtgattagccatcaggagctcctttacccacttcctggtaggagctgttctcagacctcagccagctacctccaggcactgtgcctgggagggaaggaaagggggaagggaggaagaaggcaaaggacagtgcagggcccctgccctggaaagtttgtttttacctctgagccatcagaggatcactcttaccttaatggtggccgtgtccttcaccaacttcctactacaccctggcacccacgactgaccccgctttgattagagatagttaagacagagacaaaaagcctagtaggaactgatacaatgaaaagggtttgggctacagcactggaattggaattggaaaagaagggagaggtgaagctcatttctccatcccccacccaacaagtgcttgcagatggtgtgctcagtggcaggctcaggtgtgggaaataggagatacacagacgaatcagacatcaagatgctccatctctaatgagggaagtaattatgcctgataggtgccaacatagaggtatctgtaaggcacaggctaagaagcgaccagctctgcttgaagagggaaatatgctgccaagaaagggtgtctggctcagccttgaagagtgaacagaagttttccgggaagaagtatgtggccagtgttcacgggcaaaggggaggcaggagccactgtggtagaaggcccgtaacccatactgcgggagcacggggttgttttcatgaggaaaagcctttctgccctgttccttcaccataaaggcacgtagcctacttcgtttattctgatattggtgaaatttccgtactattatttacgtaaaatctagatttctctgtttggtttctatattctagatgcagtgtgggaaaacagtcttgtaattgaactcatttgctactttggcaagacagctaaatccgtataagccatattctgtcagaaagccgcaagtaatgcctgatatttttatcctggggttgcgggtatctcagtgaagaagaaagccatctgtgctacttggaatagaggtaaagtgcaggttctccagcactgggtgggccagtgcaggtaccagtctgtaaggtgtgcgtgtgtggagaggaatgcagttcttcccaaggcagccaaccttcatttatcatcactggaatttttttgaaacgggggaactttcaactcttcttattcagaggacaattgtgttaaaaaggaaggaatttaatacagaatctgtcaaaaattttcaaatcaaaaatgaaattgttttgattttgttttaatttcttcagaaacctgatgtgagactctctcgaggcagtattgacagggaggatggaagtcttcagggtccggtaagcctgagttttcagcaggatttgatttccagttctcctgtgcgtggaccatcagtgtttatgtcacaatatatccaagtttactaatatttgtaatagggaacagaatattctataaagttaacattttaagattatgaaaatctatgatgtacagcctagaatttttattcagatacagaagttttctgcactattattgataaaggctttttttttaacttttattttagtttcaggggtacatgtacagatgtgttatataaggaaatcgcatgttgcaagggtttgttatacaggtcatttggcacccaggtgataagcataatacctgataggtagtgttttgatcctcaccctcctctcaccctcctcccaccctccaccctcaagtgggccccggagtctgttgttcccttcattgtgtccgtgtgtactgagtgtttagctcccctttataagtgagaacatgtggtattggttttctgttcctgcattagttcacttaagataatgataatgacctctagctccacccatgttgctgcagaggaaatgatctcattctttttgtggctacatagtattccatagtgtatacataccacattttctttatccagtctatcattgatgggtattgaggttgattccatgaccttgttattgtgaacagtgctgtgatgaatataagcatgcatgtgtctttatggtagaaagatttatattcttttgggtgtgtacccaataaggggattgctgggtcaaatgctacttctgttttaagttctgagacatcgccaaattgctttccacagtgaccgaagtaatttacattcccaccagcagtgtcttaagtgttctatttctccacaaccttgcatctgttaattttttgactttttaataatagacattctgactggtgtgagatggcatctcattgtggttttgatttgcttttctctaatgattagtgatattgggcattttttcatatgcttgttggccatgtttatgtcatcttttgaaaagtgtctgttcatgtcctttgcccactttttaatggggctgtttggttttacttgttcatttgctttaagttccttatagatgctggatattagacctttgtcagatgcacagtttgcaaatattttctcccattctgtgagttgtttattctgctcttagttccttttgctgtaaagaagctctttagtttaattaggtcccatttgtaattttgtgtttgttgcagttgcttttggtgtcctcgtcatgaaatctttgcaagggcctatgtccagaatagtatttcctgggttttcttcaagggtttttatagttctaggttttacatttacgtctttaatccgtcttgagttgatttttgtatatggtgtaaggaagggtcccagttttattctttggcgtatggctagctggttgtctcagcaccatttattgaatagggagtcctttccccattgcttgtttttgccaacattgtcaaagatgagatggttgtaggtatgaagttttatttctaggctctgtattctgttctattggtctgtgtgtctgtttttgtaccagtaccatgatgttttggttactatagccttgtagtatagtttgaagtcatgtaatgtaaagtcctcagctttgttctttttgcttaggattgctttgactattcaggctcttttttggttccatatgaattttagaatagctttttctaattctgtaaagcatgttattggtagtttgataggtacaacattgaatctgtaaagctttgggcggtatgaccattgggcggtacgaccatactttgggcggtatgaccattataacaatatcagttcttcctatccatgagcatggaatgtttttccatttgttcgtgtcatctctgatttctttcagcagtgttttgtaattcttattgtagagatctttcacctccctggttagctatattcctgggtattttgtgtgtgtggctgttgtaaatgggattgcattcttgattcggcactcaactggatgttgttggtgtagagaaatgctactgatttttgtacattgattttgtaccctgaaactttgctgaagttgtttatcacaggagtccccatcttcctgggccgcagactggtattggtccatagtctgttaggaactgggccacacagcaggaggtgaatggcgggctagcccgcattaatgcctgagctcttcctcctgtcagatcagtggcagcattagattctcgtaggcatgtgaaccctattgtgaactgcgcatgtgagagatctagattgcacactccttatgagactctaatgcctgatgatctgagatgggacagtttcatcccaaaaccatcccccaccccatcccctgagtccgtggaaaaattgtcttccacgaaacctgtccctggtgccaaaatgattggggactgctcgtttatcagatctaggagcttttgggccaagactatggcgttttctgtgtataaaatcacatcatctacaaacacagaagtttgatctcttctcttcctatttggatgccttttatttctttgttttgcctgattgctctgcctaggacttccagcactaatgttgaatagatatgataagagtgggcatcctggtcttgtttcagttcttcaggggagtgcttccagcctttgcccattcattcaatatgatattggctgtgggtttgtcatagatggctcttattattttgagttatgttccttcattacctagttttttgagggtttttaacatgaagtgaggttgaattttattggaagctttttttttttcatctattgagataatcctgtagttttttttagttctgtttatgtgatgaatcacatttaattgattttcatatgttgaaccaaccttgcatcccaggggtgaagcctacttgtttgtggtggattagctttttgttgtgctgctgctggattcgttttgccagtattatgttgaggaattttgtatctatgttcatcagggatattggcctgaagttttctttttttgttgtttctgccaggtttgggactcagaatgattctggcctcatagaatgagttagagaggagtacctcctcctcaattttttggagtggttttagtaagagtgctaccagctcatctttgtacatctgttaaaattcaactgtgaagccatctggtcctgggcttttggtggttgataggctatctattactgattcaatttcagagctcattattggtctgttcagggattcgctttcttcctggctcagtcttgggaatgtgtatgtgtccaggaattcatccatatcttctagattttctagttcatgtgcatagaggtgttcataatgttctatgatagttctatgtatttttctgtggggttggtggtaatgtcccgtttgtcgttgctgattgtatttttttcgatcttctctctttttttaattagtctagctagtgatcagtcattcttatgtattctttcaaataaccaatttctggtttcatttatcttttgcatggtttttcatgtctcagttccatttagttcagctctgattttgggtatctcttgttttctgttagctttggggttgatttgctcttgtttttctagttactcaaggtgtgatgtcaggttattaatttgagatctttttaactttttgttgtagatgtttagcactataaactttcttcttaacactgccttagctgtgttcaagagattctagtgtgttgtatctttgtacttattagtttcaaagaatttcttgatttctgccttacccagaagtcattcaggagcaggttaatttccacgtaatcatatggttttgaacaatcttcttagtactgattctatttttattgtgctgtggtcctagagtgtggttggtgtgatttcggtttttttttttttttaattagctatagaattgttttatagccaattgtgtggtttattttagagtatgtaccatgtgcagatgagaagcatttatattctgttgtttaataaggccttttagtaataagccaaactctttgtgacctaaagaaatatgtacatcacttctcagccttttggctaagatcaagtgaagaaatatatacacatattagccgttgttaacacacgctgtcatttgctaaattttttgttgttgttgttttcgtttttgttttgagacagagtcttgctctgtcacccagagctggagtacagtggcgtgataacctccgcctcccagtttcaagcgattcttgtgcctcagcctcctgagtagctaggactacaggcacgtgccaccacgtccatctaatttttgaatttttagtaaagacagggtttcacaatgttggccaggctggtctcaaactcctgacttcaagtgatccacctggcccatttgctaaatttttatgctcttactacatggttgtaaaagtctccagaatcacagaaaatttgttcaagcaatatttttttcttctggatgtagcagggggagaatgcctgaaattctctttaaagaactagcttatgattattccaattatatttaacctatttatgcctagtgttccattattggaacgctaagcttgtgagagttatttatatcctactgcttaaggtcatcgccagtatctgatttttccacaccaaaaaatttgcaacctccagcataaataggttaaagcctgctagaaataggacttattttcacaccaattcccagtccttcctaacgttttaggaccaactgcttttttttgagacggagtctcgctctgtggcccaggctggagtgcagtggcgcgatctcggctcacggcaagctccacctcccgggttcacaccattctcctgcctcagcctcccgagtagctgcgactacaggcgcccgccaccacgcccggctaattttttgtatttttagtagagacggtgtttcactgtgttagccaggatggtctcgatctcctgacttcgtgatccccccctgcccgcctccgcctcccaaagtgctgggattccaggcgtgagccaccgcgcccggccaactgcttgttacacattagtttcttcaacataaggaagcagccagtttggggttggttggctcttgtttttccagttcctcagggcgtgatgttaggttattaatttgagtaatttgagatcttttttttttttttgagacggagtctcgcgctgtcacctaggctggagtgcagtggcaggatctcggctcactgcatcttctgcttaccgggctcaagagattctcctgcctcagcctcccaagtagctgggattacagccacctgcctaatttttgtatttttagtagagacggggtttcaccatgttggccaggctcgtcttgaactcctgacctccagtgatccactcgccttggcctcccaaagtgctgggattacaggcgtgagcaaccgcgcccagctgaatttaagatcttcttaatcttactaatttgagcaaaccaacgccaaatttccatcagcagatgtctgtttaagttaaatgcagatttccttaaacatttgctgtgcctgtcaggtagcagacttacggagttaaagttttaccctaataagggtgaaactactgagttgacttctagtcacaggtgtgtatgcaactgtcaacacttaccttaaaatcttgcaaacattttttctatataaaatagcacccagtcgggcacagtggctgacattctttagttcacgagcaagaaggttgcattatcagccatttaacattcccatacactgagctccttccttgtattgaagagacaaatgcataaaaagcagttggtcctaaattgttaagaaggagtgagaatcggtgtgaaaataagtcctattcaagatactagctatttagaacgttgctaataggaaatttgttagataaggaaaattctttgtgttccagtgtgtggcccacagaaggtactcagaaaaaaatgtaaatgtgttaatcaaacctggatagaaggattatgcagaactgctttattaataagaacttgtggccaggagcggtggatcacctgaggtcaggagttcgagaccagcctggccaacatggtaaaaccccgtctctactaaaaatacaaaaaagttagccgggcgtggtagcgggtacctgtaatcccagctactcagaaggctgaggcaggagaatcgcttgaacctgggaggcggaggttgcagtaagccgagattgtgccattggactccagcctgagccaaaagagcaaaactctgtcttagaaaaaaagaacttctaagacaatcagatgacacatgatgggcccaactaagatctcagtttgctttgtgccaggtggaggcaatagtaagagtgcttagtgctaactgaggtcctggcttagtactacaaggtactgtgtcgcatcactcttgacacatcgggtactgtcgtcatccacatttcacaaatgagtagaccaggactcagagaaaacttgcctaagtgcccccatttatgcaccggtagccagccttgctcaacagacttcactgccttcctggggactgttaacacgctatgaccatttgatttttttcccttttgtgctttcctaaagatgataatttggttttggccccattttgtgaaacactccagctttaacacttttagaaatgtgccacggcttcagggagaaccctttgactagaaagccgtgtagattataaatggatgtgaactagttagtaaacattaataactgcctagtggaaaattgatcccatcagtgtgcataaaaggtaaacttttatttagactttaatacacaggttgacagcatgttcattttgtgatgacaacctagttgtcttattaggtaagtgttattagcctcagtttacaaattgaaaaaccaaagcccctaacagctctgcagcttttccaaagtaaacagctggttccgcacagaaccatgcacgaggcctagctccacacactcatactgtcagacttctgaagcagagtctctccttttctgtacctgagtacccgagcaggttgtacgtgagcacacattggctagattactccaggatgttctgagaataggattttctagttcattaaactttcttgttacccgagtatcaaccagaaagttctttgtatttttaaaccttttaaaatgagcatggggccaggcgtggtggctcacgcctgtaatcacagtattttgggaggccgaggcgagcagatcacctgaggtcaggagttcaagaccagcctggcccacatagtgaaaccctgtctctactaaaaatacaaaaattacccaggcgtggtggtgcacacctataatcccagctacttgggaggctgaggcaggagaatcacttgaacctgggaggcagaggttgcagtgagccaagatcgcaccactgcactccagcctgggcgacagagcaagagtccgtctcaaaaagaaaaaaaaaaaaaaaaaaacatggggagcactcagctggccgtgagctggctgactggaaacaggcaccacataaatttaaaaattttttaaattaaaaaaaaaagggcatggattttattgcctgaagcagtgagtacagcacagccaatagacattgtctgttgttaaagtattggcccgtttccaccattccctgccctcacgcctctctatctgccctgaccaccttgctgttcctcacacattcggtttgccctactggactcctccctctcgaagctactcttctcccgggttgctacaaggcttccctttcagggatcactttcttagaaggcctgaccttcctacttaaaactgcagctttggtctggagtagtggctcacacctgtaatcccagcacttggggaggccaagatgggtggatcgcttgagctcaagagcttgaaaccagcctgggtaatatggcaaaaccttgtctctacaagaaatataaaaactagccaggtgtgatggcatgcacctgtggtcccagctcccagctactcaaaaggctgaggcaggagcatcacttgagcccaggaagtcgagtctacagtgaacaaagatcatgccacagcactgcagcccaggtgacagagtaataccctgtctcagaaaaataaaaataagggccaggcgcagtggctcacgcctgtaatcccaacactttgggaggcccaggtgggtggatcacttgaggtcgggagtttgagaccagcctggccaacatggtgaaaccccgtttttaccaaaaatacaaaaacatagccaggcatcgtggcgggcgtttgtaatcccagctactcaggaggctgaggcaggagaatcacttgaacctgggctgcagaggttgcagtgagccaagattgtgccactacactccagcctgggcgacagagtgagactcagtcactcacttaatcaatcaaccaataccaaaaaacgtgtagttcctctccttctatcccagccatctttctttgtgggacacagcttctcctaacagaacacagaatatactaatacatgttcattgtttattacctgtctccttccactgcattgttagctgtttgctccccaggcaggatctttgttttatacctagaacagtgctagaacaaagcggatgttcaataactgttcattgaacaaatgaatgatatgatagtgatatataaagtagaaagcactacacaaaaataagttgatatggtatcattcttcataccttcaagctctgagactttttgcaagtctttaaaatcagaggtgttaaatgacatgttgaaaacaacttgattgtgtgagggaggaacaattttaattttgtgtgctattttttatagcacttgtattgtaaagaagtggatctcttttcaatagaaagtaaagtgtcttaggttatatctattagccagttcattattttaaagtaagcaagaaaagtctttcttttcaaaagtagaaaatagttccaaaaagatttttttccaggtagttagcctcagaaagactattttaagtgcagtttcaggtatgacaacttgaaggagaactggtgttaagtgaaactttatcctgtacctgggacagaagttctgggctgtggtttggcttctctggcttggcctagaactgatggaggtataacaacaggtcctgacacacacagtgctttgggggtgatgacaatgtaggcccatgggaatctacacacccagtgctaccaagcccctttccatcatttttctggttgtacctgtttttgtgataaggatagttgggaggccaggcaggagaggatgcagacactgggaagtcctgggattttaaaccctttagaggtcaactggagacatccatataagaacatttcaaattttttttatttgtataaatttaaggtgtataagtgcagtttttttacatggatatattgcatagtggtgaagtctgggcttttagtataaccatcacacaaatagtgtacattatacccattaagtcatttttttttttttttttttgagatggagtctccctctgttgttgcccaggctgaagtgcagtgacgtgatctcggctcactgcaatttccgcccccaccaggttcaagcaattctcccgcctcaggcctcccaagtagctgggattacgggcacacaccaccacacctggctattttttttttttttttttttttttaaagtagagacggggtttcaccatgttagccaggatggtctcaacctcctgaccttgtgatccacccgcctcagcctcccaaagtgctgggattacaggcgtgagccactgcacctggcgccattaagtaatgtcttaacgctgttccccccgcccccaccgaccgcggcaactcttcgaagtccccagtgactattccacattcttacgtatgtgtatacgcattatttagctccaacttatgagaacatgcaggatttgattttctgtttgtaagttgtttcacctaagataatggcctacacattactgcatccatccccactgctgcaaaagacaggaatatatatattaattaattaattaattaattaattaattaatttttttgagacagagtcttgctctgttgcccaggctggagtgcagtagcacgatcttggctcactgcaacctctgcctcctgggttcaagctgtcctcctgcctcaacctcccaggtaactgggattacacccacgtaccaccacgcccagctaatttttgtgtttttagtagagacagggttttgccatgttggccaggctggtcttgaactcctgacctaaggttatcgcccattttgacctcccagagtgctgggattacaggcatgagccactgtgcccagccaattgtattcttttttgtggttaaatagtattccactgtatacatataccacatttttttaatccagacattcattgatggacacttaggttgattctgtatcttggatattgggagtagtgccatgataaacatagcagtgcaggtatctttttgatacaatgatttgttttcctttgggcgtatatgcagtcatgggattgctggatcgaatggtagttctattttgagttctttgataagtagttctattttgagtttttctagttcattttccatagaggttgtactaatttacattctcctcagctgtgtaagaacattttaaatgggttatgaccactgtgtttgtggttccagagtgtcccatgcttgcttctctcacagccctttccacacatgctattggcatcatttgcctatttgcctgatcccccaccccaactgagaccttatgcagaaccctgttttgttcattttgatacactagaatctagcctagaagttcaagggggtggatagacagggtgggtgagagaggtcattgcccaattgtatataccagtgcattgactgaacttttcttttcccacagattggaaaccaacatatatatcagcctgtgggtaaaccaggtaaagaagaaaagaattgggcggaaagaagttagtttaatttgatgaaagcgggttttgaatgtatatagtgtcgtagctttggaataccctcatggttaatttttcctctacagaccacagcaagtacgatgtttaccacattcagctcattactagagtattgggaaaaagaatttgttggtataatgcatcagaaatacctccttagggttgcagtgagccgagatcacgccactgcactccagcctgggtgacagagcaacactcggtctcaaaaaaaaaaaaaaagaaagaaatgcctccttagaatgcaagattagtgtcttttgtaagaacagcagtaggcatttatttagcagtggtttctttctctttcctttttttttttggatacagagtctcactctgtcacccaggctggagtgtagtggtgtgagctcactgcaacctccacctcccgggttcaagcaattctcctgcctcagcctcccgagtagctgggactatggtgcacaccaccatgcctggctaatttttttttcttttcttttcttttttttttttgaattttactagagatggggtttcatcgtgttgcccaggctggtcttgaactcctgaggtcaggcatccgcccgcctcagcctcccaaagtgctagggattacaggcgtgagccactgtgctcagccttctttctcttttttttatttttttgagacggagttttgttcttgttgcctaggctagagtgcaatggcacgatctcaactgaccgcaacctccacctcctgggttcaagcgattctcctgcctcagcctcctgagtagctgggattacaggcatgtgccaccacacccggctaattttgtatttttagtagagatggggtttctccatgttggtcaggctgatctcgaattcctgacctcaggtgatctgcccgcttcagcctcccaaagtgctgagattataggcatgagccactgcccccagcctcttaatctttcttaacgcacatgacttaatgggaatcattctctctcaccagatcctgcagctccaccaaagaaaccgcctcgccctggagctcccggtcatctgggaagccttgccagcctcagcagccctgctgacagctacaacgagggtgtcaaggtgggcatctgagcctgtgcagcaccttctgcttgcaggatttgtggtgtcccctagttctcagttgatgtgttcatgtcatagagtggagttggtgctgaaaatagaacagtgcagagtggaactgcagtgagacccaggagtcaattggtctggttctgaacccctctgagagtcagggaaaagctttatgcaaacattttcttttccattttcctctcagtgtaatagattttaggaattcagtcagattctgattttctacatacatcttcctctgatcagacagaatgttttctttagaacaaagtgccaagattgtttctggttttaaaaattaattaaaccaggatgcttggggtaagtgaggactttttgtaggagtttataagtgtggcttcatggaagacttatttattttccatttaaagttagaattgggtttgtaaaagcaatgtatgctgagtagagccatcctcaaaccaaggggagtgtttgactcaggcacaaacaaccacaagcttctgagtttggcagtcagaagtcaggtgcagcctgccccgaggggtgccagctggaactgttggcgcctgtgactctcctgggtccccaccagccctcaccgagtgctggagccactagagcagcagccctcctccctgagagatctgacggaggaggctcttcttttctagcctgtgtcctgtaaggagatgggatctttttactttccacttaaaatgacaaattacctctcaaaatagacgctatttctcaattgtcatataccttttattcacattttaatatctctaaaattgggatggtgttttggtttaattggcagcatttttttttcttagtggttcattaaaaaatggtgcatcttgagctaggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatcatgccattgcactccagcctgggcgacagagcaagattccgtctcgaggttaaaaaaaaaaaaaaggatgcatcttatagtggaagacatcttaaaatccgaaaaatgtcatatcaggttaagataaactttgctttaccaataaccaccatttattgactgtcatccctttaccaagttctgtggcagtcctttttcatgtattatcagttctcatgtgaacctcacaggactggtggtggtatcatttctcagttgaccaaggctcacagagattaagcagtttgttcaaggttacacagcctccacatagctgagctgtgcttggccgcaggcttggctgagcacatacttgactcaaaggcactcgcctccaaagctgaagcttcgttagatgtagatacattgttgtcttctcagagtcatcagaaagttagtccagggtaagaaaaaatgtcatctccaggcccagagggatagcctgcagcttagagggcacaggtttgccagtgttcattgaggaggtgaccagagggtgaatgggcagccactggcacaaactagcctgctctctgtggccaagcctgccctctgtggccatagtgaaagtaccaactgggctagggatgcctctgcccttagggttggtgcccagagttcatgccagtggcttttaagtgcctgggaatcaggaacttcctcagttcaccaggcctccaagccccaggatgcctcctgacagttctgttaaagacacactgagtcttctccaaggaaaattgaggaaggacacacccttcccaatattggcttctttcaataaatttctaaaaaggagccagacatggtggcgcacctctatgactatagtcccagctactcgggaggctgaggaaggaggatcacttcagcccagaagtttgaatctggcctgcgcaacatagtgagaccccatctctttaaaaaaagaaaaggggacagaatgagattaatgaattatttattttcataagccaaaagaacagactttcaaaatggcttgtattacaatgaaaaaccaactttacaggtagatcggtaccaccttagaattctgacatcattatgaaacatctttcacagctggaataacataatgaatacatacaattaggatagggtatgaagcaaattgaaatcttgaaaataatatgtgtacttaaaatatattaagtaaagattcccgccccccgcccccctgagacagagtctcactctgttgcccaggctggagtgcagtggtgcgatcttggctcactgcaagctccgcctcccgggttcacgccattctcctgcctcatcatcccaagtagctgggactacaggcacccgccaccaggcccatctaattttttttttttttttttttttgggtatttttagtagagacggggtttcaccgtgttagccaggatggtcttgatctcctgaccttgtgatccgcccgcctcggcctcccaaagtgctgggattacaggcatgagccaccgcacccgacctaagtagatttttaaataacatgaaatatacacctctgtttcttcattgtctgcttggtagaggtcattgaatccatcctaaaagaacagtattgttctaatactgcaatgcagctaggcacagtggctcacgcctgtaattccaacactgagaggccaaggcaagtggattgcttgagaccaagagtaccagaccagccctggccaacatggcaaaaccctgtctctactaaaaatacaaacattagctgtgcatagtagtgtgaccctataattccagctgctcagggggctgaggcacaagaatcgctggaatccaggaggcggtggttgtggtgagctgagatcacactactgcactccagcctgggcgacagagcgagattctgcctaaaaaaaactaatactaaaatatttacttttatgtataactaaaataattcatccaaataacagccaaaatcagtctcaatttttcctaggtagcactgcattttggttcttaactgagtctttaagcatcaacctaagtggttggaattggctacatctatagagggtttatcaactgcctgccaaggagcttccaagttgtcaagctccagaaaatagaaaaccattaggatgtctttccaaacagctttcccttctggaatgtcactgtgaatggtccctagaagcattatgacagtgcccctctaccacaataattgggcaaagggtaaagtagaaaggaacagaagctttaaacaggtgacaacctccctagaattacagaattgtctatttcttcttgatgaaacaccctgtggccccctcctcaagaagccctgttgatgtagtttgaactggtacatcctatgaagttaaacagaagaccacactgtgactctcagtgcagaaaataaaatacaggaagtcatctcttggaaatggtgtggttatagtaggatagcgccctggcttgagctttagagaaaacacattaaataaaactgttcagtttcaagtagtagaacctaatcataagaatcagctcaaaaaaggggtttctgttctacttttgttttttgtttttaaaataagctcccaatgtgtgtgtgtgtgtgtgtgtgtgtgtgttgttttttttttttttttttttttttttgagacacagtgtcgctctgtcacccaggctggagtacagtggcacaatctcagctcactgcaacctctgcctccgaggttcaaatgactctcctgcctcagcctcccgagtagctgggattacagggatgcactaccattaccctgctaatttttgtatttttagtagagacagggtttgaccatgttggccaggctgggcctaatatctttaaactcagccccaagtcaggaatctttatgatagcattatggctagatgatgaagtggatctcaaggatattgaggggccgggctcaggaattgaggctgctgcagtttctcctgaatctatgagaattcagatgggcacttttcagtaattaaaaccatatgtcctcctcctcctttctttttgaagagctctcattctgttgaccttgcactgctgctggattgttcctcgggctttgcatgttccctgcatttgttttgtaactgagcatggtgcatggcagacctctctatgcagtatgctggggcagtgagcaggtggcacagtagccacaccctggcaacagtgagtgagagctggtgggcaggcttggaaactagctcctttttgttctgctcatgtgtttttatgggggatttgtcttatgcctttattaatattgtttttcttttttccctttctctgataaattcctttaacttttcctcaccttccgttcgacaatagccatggagggtaagcacgtcgtgtctttgtgtgtctgtccagctctctctatcacacccggctctctgcatgtaactttggactggaaagcaggaagcccaagtgggagggcacttcggcctgctttgtcacctctcatgactgacagatgccaaaagcagtgtttatatatgcaaaagaatgagacatgtacatctttgcagtaaatgaattattcttgtgcttttctatctcatacccagacttttggaacaaccaagaattaatctgttccagattacttaggcaaaagcacccaagggttcagaaatgggaacttatatttagactgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatgttattccccatcagtactcaagttatcttagtaacatttgttgatgtctcttctgtgcccaggccctaggtagacattgttacatctttggcctcatcttccctgatcacagttgcccgggtgagagagctgaggctttataagcgtaggcccaggtgctttccagcagtcagcacagagctggctgaaaccggggtcttgagcagagaggctcctagcgacaccactgctgctttgacttcagtcacgacctgcaaacagatgctatccccttaaagtgcattcatatgtcagctttttataattgtacaaagaacatgtttccattaggcggctgagggcagctaagctgagccataccgttttcactgcagaattcaaactaagtggaaatccttatagtcttcatgtagaatgtttgactctttagccaaataggtaattttgtctaaaattcagtaaattcccagatggattattatcttgtggtaaatgattttggggtgaggggacattgaatcaggtctctgaaagaatctggggtttttagtataatatgtatgattccatctcatttcctttaactgagctcaaagttagaaagaaaatactgcctaatttgtcacttggaggaattactttactgtcattctcaatctgaactatatcccgcacacacaagaaaatcaatgaccttctgcaatctgctttgatctcttgtaaagaccctctctagcttgattgtggtgatctcacgccatctgctggagagcagaaaaatgactggcttctgtgttgtcagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggtaaaatagagtcattttgtgtactggcaaaaatgttcttgtttcctgtaagctgtggtgccagttgatagatgtctctaggtccccccgccccaccaaagtcagaactgatgctttagaagctcttcacgaaagcaccatacagtgacaatgttagtgagaactgcagttattctgaattgccgttcctatcttgttttcttctgtcagtaaacactaggatgggagtgtcttgaagcagtacactcttttaataattaccactcacacataaagtctgcagtgaaagagaaagctgcaaaagtatgcttacagtatgatgccatttatgtaaacttgaaaaacatgcaaaataatcctgtgtaagacttagggagatgtggttacgttgttggagtgcaaagacaagtagaggaatgatcattatcaaattcagatcccgcacctgtaaggaggagccagctgaagaaaggtacattgggaggatttatctgtgttgtttttcttaagctaagggttgggtatgtgggtgttcattgaattttcttttaaaaagagtaaaaataaataaaaatatcatgccagtaaactaatgttttccaaattgtgttcagtggagtgggatcctagcaggcagtgacaggtgtcctgtgtaaaaggacactaggggctgagtgtggtggctcatgcccataatcccagaactttgggaggctgaggcaggcagatcacttgaggtcagaagttcaagaccagcttggccaacatggtgaaaccccatctctttaaaaaaaaaaaaaaaagagagagagagaaagaaagaggacactaggtccaaggaaagtcagcaatggctccttttaaagagtacagactggcatgttggttgcacagaggtgtcctccagttcacagagtgtggtcgaaatttgctctaagccagtatttctgaaacatactcgaacatacttttttttcactatagtaaaatacacgtaacataaactaccatcttaaccatttttaagcatacatttcagaggcattaggtacattcacaatgttgtgccaccatcagcaccatccacttccataacccttcccttgcaaaactgaaactgtgcatttgaaacaaccctcctcttttcccctcccccagcccctggcaacctccatcctacttgctatctctatgaattgactaccctaggtaccgcttataagtggaatcatactgtatttgtctttttgtgatggatttatttcactcagcatagtatctcagagttcatccatgttgtagcatgtgtcagaattttcttcctttttagggcagagtgatattccactgtatgttcacaccacattttgtttatttactgaaccatcacagggtacttgggttgcttccacctttcagttatcatgaagaatgctgctaggaacatggatatacaaatatctttttgagaccctgctttcacttcttttgagtgtatactcagaattgctggatcactgataattctatttttaattttttgaggagccaccattctgtttttcacagcggctgcaccatcttacattccctccaacagcacacaagggttccagtttctccatattctcaccaaaacgtgttattttctggggggttattttgaagcttggggttttgtgtgtgtgttttaaaaaataattgtcatcctaatggatgtgaagtgtatctaagtgtgattttgatttgcatacaggtcttgaacatctgtttgctttttgagcgtttgtgtatcttttttggaaaaatgtcaagttttttttttcttttttggcctgttttttaaatcatactgtattttgttgttgagttatagaatcctacaattgttgttgttgggttttttgttttgttttgtttgagatggagtctcattctgtcacccaggctcccaggctggagtgcaatggcacgatcttggttcactgcaacccctgcctcccaggttcaagcaattctgctgcctcagcttcccgagtagctgggactacaggcatgcaccaccacacctggcttatttttgtatttttagtagagacggggtttcaccctgttggccaagctggtctcaaactcctgacctcaggtgatctgcctgcctcggcctcccaaagtcctgggattacaggcatgagccactgcgcctggcccctacaactgttttttagtatacctattagcaatctttgcaacagcttcttataaaccatcaatgtggaaaaagctgcttgaaagttgtaatgtttcatggaaagcacagttaatccattctggttcacttttttaaagtgtatccacataacagttttaaccaaagttcttaaggaggaacttgcatgaacccacagccaagtttaaacaactcaacagtagatgaaaccattcagaattttgtacatactaagattttatatggtgattttatagacactatttttttaaccgttttactttggccaaatgacgttctttttgtatgttgatccaattataagtaactatcattttcttactggttttattcatattacatgtaatttgatgtcttagtcattacattatttggtcctcataagtatgacagtaatgaaaatttgaagtttaaaattatttgttttaaatcatagttagaccctttttgctgcaactcggaagtggcagggaggagtgtttctgctcagtgtgcctaatagatgaagcctgagattcagaacggggtccaaagcaaggctgcccccttgcatccggggcagtggtgtcatctctggccagcctcatgaggtgtttgaaagtacctgggtgagaacacatttggtgaacacacttggggaaaggtgctactatttatcctaacctgtgttggcagggttggcagttggagccaggagggtggtataatctgcttggaagcagtagatgagaaaaaaaaaaatcctgctttccaccctcagcatctgtgtgacttttcttacatgaacttctggtcttcaactcactccttagggtattagagcaatgaacagtcagatctaaatcttttgggagaaaaaggagcctcataacttacaagatagggctaagcactgagaaaaagaaatacagaaatttgccttgaaacttgtggaaaggaaataaaaaaatatataactgaaaagcataaaaatcctttgtgtgtgttctaatattggttgtgattcttgtctgttaggaagtcggcttggccctgaggacattattggccactgtggatgagaccattcccctcctaccagccagcacccaccgagaggtagggcacaatcttccccttgcagccctctgtgacagcactgggcagggacacattcagggatgcctgtggtgctgaaggccgctcctcagtctgtggccagcagagacatcaactgccctacaagcgatgaccttccctctaacactggccccaaccaggacggggctgttcattctagggcataggggtggtgtggagcagtggccactcaaattccagatcctgggtcttcctgctgctagtccactgcagagccactatgcaaggtcctcatctgagctacaagtggctctgagcagtggatgaggaaggcacatgggaaactgctgctggtgccatgaacctaaaaggtagaagaatgctgatatgaatggggcgggcattgtgcatggtctgcttcctcgaattctccttaaaaatagttgagcttgcaaatgatcctggttttccatttcaagtagtaatataaaaaatttcttttaggccaggcatggtagctcacgcccgtaatcccaacacattgggaggccaaggcaggaggatggcttgaggcctggatttcaagacaacatagtgagaccctatctctaccaaaaaattaataaataaaattattgtcttaaaaaattccaggccaggcgcggtggctcacgcctgtaatctgagcactttgggaggctgaggcggacagatcacgaggtcaagagatcgagaccatcctggccaacatgatgaaactccatctctactaaaaatacaaaaagtagctaggcatggtggcacgcgcctatagtcccagctacttgggaggctgagacaggagaatgacttgaacccgggaggtggaggttgcagtgagccgagatcgtgccattgcactccagcctgcaacagagtgagactccatctgaaaaaaaaaatcattttaaattaatgaatgtctttaagaagcttcttaagggctgagtgtggtggctcacctctgtaatcccaacactttgggcggccgagacaagaggatggcttaaagccagtttatgaccagcctgggcaacaaagcgagactctgtctctacaaaaaatttttaaaaattagctgtgtgcagtagctactcaggaggctgaagcaggatgatcgcttgagcccaggagtttcaggctacagtgagctaggatcaagccaccatactccatcctgggtgacagagcaaaccctgtttcaaaaaaaaaagttttaaggaataaaagttgacccaaaatactgtagcccagcaacaactatcatttttgctaccttttggcaattttgtttcaattatatgactaacaaatgaaaggaagcacctgcatttgttttagtgtctttgagcctagggtgtacattctgtggttgggattgacaaacgcatgtgggatgcgtccccactacagagtccaggatctgcaggcttcagccttgctccctgctgactccagctgcctgcttttctcatttctagggaagcatgggcagttcttcatcccagcacacactttttgtttgtcctttttattttgaaatcatttcagatttatatgaaagttaaaagattaatagagagaactcccaactttcctttgagtttcacagccttttaacatgtcagcacattgtcaccttgctccattgtctatgtgtgtacacacatcacttcctgctgtcgagcagcttgagaatggctgtgtatctcatgccctcttcccctttaagatttccatttatatttctcataacaaggccattgtcctacataaccaccacacaatcaccacattctggaactttaacatgatgtaatgcactgtcccactctgcagggcacgttccagggtcgtcggttgtctctgtagcacttttccgtcgcctgtgagagccagaccaggattacactttgcacgtggtgttgctttcttcagcctcctttcatctgaaacagctcctcagcctttttttatctttcatgacattgacatttttgacaaacataggctcagtgattttatagagtattcttaaagttggattgagggatatcctataaacatttgtttcttcctgatgagattgagattttgcatctccagtcaggaatacaacataaataatgctgaatccttctcagcatcatacccagagacatacgatgtccaggggatgttccagttgaccaactggacattgacttctgaaggacggttggacacaactcctgttggtgattcctttgtaagtggcattgattcatatgcataaaccctttaacttgtttttgagaaggcctgtgactggtgctgtagtgtaacttcacatcccaaccaaatggggttctctcacttacctgcttcaccgggcctctggctttccatgacaagcctcagttttgccccaaagtggagaagttccatatactagaggcaagaaaatggtgtcctaccaagtggatattttagtgggactatttgtcaacacctactctagttgataaagtctaaagtaatcttttcatctcccctgattccaatacacaaattgctctcctgtatacagtattttttaattattaatttttttttttttgagacagggtctgtctctgtcacccaggctggaatgcagtgactccatcacagctcactataacctccaactcctgagctcaagtgatcttcctgcctccgcctcccaagtagctgggattacagttgtataccaccacgcccagctaattctttatttttttgtagagacagtgtcttactgtgttgcccaagctggtctcaaattcctgcttcaagccatcctcctacctcggtctcccaaagtgctggggttacaggcgtgagccaccacacctggccttaaatcatttttgaaaagaagaggagcctgtctttgatcctgcatctgcctttcactgtcctcatgcctcctcctgtccccattgtacttcctgaaagagcagcccatccctgatggggccacctcctcacatggcagctgcactcagcgccagctcagagcattccagtgctccagctgtttggaactctctctgctgtaacagcccttcaaggtctcctaattgccagagcccctgctttcccctcagtcctaactcccccttgagaccccctgctctggcccagagcttcctcactcactcctctcctgccaagacctctgctcaggcttttgttccctgccacccttgagtgtggtcatctcccaaagtgctacccacttgttttattaaaaaatactttttcactctggtagttcttctcattctcatagattcaagtatttgatgcctcccaaatctgtgttgattttatagaacccctccctgagctctgatctccaactgtctgccattggcaagaacggtctgctttccttgtttgcttccacagtcagtgacaacaccatgcacttgcacgtctgttcccaatcccctacacacatgcaaacaaccacacaccttccatctctcatcaggtctcaggttggtccgttcacctgcacatccaccatcacctctcctctgaagatggcctcttagatggtttatctgcctcttgtctgttcccctgcccttccattcagcctccacattgccgccaagagccatctttctagaatatctctctagattttgtcattctccttcttaaaaatctcttatccctcttgccaagtcctgccaaataaagatcaactaggtgtggctttcacagttgaagccagcctacttttacagtataggccaaattcagacaaattctctctgtgaagtctttctgaccctctctgagacagaatgcattgctgtcttatctatgtacttttctactacgtgatttattccagtgtattatagggtcctgtgtatgcttttcccattgtagactgcgggtaaaaacaggtcttcctccttgtatccaagcaccaagtgtctcgtacataataggtgctccataattgataaaagagcaaatggataagtcaccactggttgaagaaacagataagaaggatcatgagactctcccatgcaaagcattctaaccctgtaggacagcattttgtgttcattagctgcttccaccattgctgccctgacttaatgtgtgcggggggaggggcgtacataatggtctggctctgtcacccaggctggagtgcaatggcacgatcttggctcactacaacctctgtcttccaggctcaagccgtcctcccacgtcagcctcctgagtagcttggaatacaggtgcacaccaccatactcagctaactttttgtatttttttgtagagatggggtttcaccatgttgcccaggctggcctcaaacttttgagctcaagccgtcagcctgcctccgccgcccaaagtgctgaaattgtacaggagtgagccactgcgccctgccaccatccttaaaccattttttgtatagccaaggaaggtcttgaaatagagttggcatagtagaaagcataagaccagaagtcagaactgaggcttttgtcctggcttggagactaaagagctgtgtggccttcagcacatcttactgtatctcagttgtccactctaatgtgaaagtgtttggaatagatgatctctgaagttctgtcagattctgtggttctattatgaaacaaaagccctgccagtcactgagattaataaagtctaaacggcgcaaatggagacgaagttagtcatggtgtcagggaaggctttgaatggaaggaacaagatgctggatctgcatgtgtgaatcggcatgcacaaacaggcacactataatagctgaatttctaaagtaagtaaaaaaaatgtttaaatgcatgaatgtagtgtgggaagttaaaataagaaaaaaaaaatttaaagattgatttttacatcctattgctcctaaggaagatttatttacaggaaataaagttttcttctcatggaggcactgaaagaaaggctcataaaaattccctgaaaagttcattggtgcagggcttggtggcatgtgcctgtgttcccagctagtgggaaggctgaggcaggaagattccttgagcccaggagtttgaggcaagcttggacaacacagtaagaacatctctctaaaaaagaaaaaaaaaatcactgaaaacagttctcctgacctatctcttgtctttcagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgatatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagcagcttcatctttggatctgtgacagttacttcatctgaagcaaatgtcaagggaatgccatccttgtgagttttttctaatttttggcattcttgagtctcttacatttccatttcctcatgtttgaagtggtgactgtgagagtgagctaagtccagtgtaaatggtaaagtgctctacataccttgtaaggaactttgatgttggacctgtccagtgtactctcagaggtttaggagcatccgtggccttcacccactagaaaccagtagcactcccaccaagccgtgacaaccaacctgtctgcagacattgccaaaggttcccaggggaaggagggacagaaccattgcaagttgagaaccactgtttgagataagagtttacctgcagttagccgggcgtggtggctcacgcctgtaatcccagcactttg

SEQ ID NO: 13166 - DNA, 11003 bp, Human
ccagagaggaaaccaatgcccctctattctgagaagcccaataataaagttcatccatttattaaataaacattgtgaatgccaggaaattagcaagacctgattccttcaaacattttcttttcttttcttttttttttttttttgagacggagtctcactctgtcgcccaggctggggtgcaatggcgcgatctcggctcactgcaagctccgcctcccaggttcacgccattctcctgcctcagcctccccagcagctaggactacaggcacccgccaccacgcccggctaattttttgtatttttagtagagacagggtttcaccgtgttagccaggatggtctcgatctcctgacctcgtgatccgcccacctcggcctcccaaagtgctgggattacaggcgtgagccaccgcgcctggcctggcacaaacattttccatttgactattgctccagggctttcagatccagaaataagcctggaaaacctgaagtcagaagttaagcacattcaaaacattttttcaccttagtactgttttactctgctctctgactgcccaggatcacacctgaagactagggctggtcccacatctgtatttcatctcgtgcatctgagcgcagacttctttcccatgctcacccttgcaacctccagccccttctcagacttctaagaccctgcagatccaaagatatagctagaaatccagagatctagatttctccccaagtataacagcctccagccatctcctctcacccttcccccagtggcctctagctcctgccttttccagccggctgactacattagccctgttaagccccagtttcaagctcacagtcttcccagctctatgtcttccctctgtttcagttcttcccatcacctctccaccttcttaggttgtccctgacctcttcctctcctagtccccttaatccctctgatgagcctagcctggtgcttccttccatggcttccttgagcatcttctttgggctacctctggtggctagagctcctctggtctcaagttctccacctctgtcccctgggctctctgtgctcccaccaaggctgactcttgtggctccttctctcaggagtttctgcctttcctctcccccacccccaatcccctgcacctgcctcctcaggggctcccttgttgtctccctgtctgtgcccctctctctcctcccccatcctgatttctctcccccccacccccccccccacccctttcccagggcactcttctgtcctctgttcctctgccgctgttcccatctccatgacccccgatctcttctggtctggctctgtagacctctgtctccccctatctagtggtacccctcttctccccatttttgtctccactctaactctcccactagttgtcccagtcttcctccttcttggttctgtgtctcccacagacacacaatttccctctctagctaagtctctcacctctgcgtcttccccctgactcttcttttcctcctttgtctctccctctctcctcctccttttcctatctctgtctcttcccccttatctctctgattctccttggtctctctggctctgactttccctctatatccgcccccccgccccctcatatctctgtctcttcatctctctctggcccttgctccctcattccctccctctctctattcctcggctctctccggctccctctctcgcctcggatgacagcgctgcctcttttgttggctccgcagccaatcgcggccgctgacgacacgggggccggggctataaagggcctggcccgggctcgggcccccccagccgcccgccccggccgcccgcccgccccgcccgcgcgcccgccgcccccggccccccgggtcccccctcggccgggcagcccccaatcccgcgccgcccggaccccctcctcctccctccctcctccctccgccccctccccgcggggactccggcgtccccgccccccagtcctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagagtaagtgggctgcggggcgcgagcagtggggtgctggctctggccccgcgaagggcgccttctgctccaagcggggcgctccctgctgccccggcccggaagctttttctgcgaaaacttgacgaattagggagcgggggctacttcatagaagttttccgagcggtggagatgggctgcaaagttgtatgcacgcctagttcccggaggttggggcgggggaaatggggcgggtttcgagatagtgccttccacccccagtatgctaaaaagatccttgttggagtccggggaagctggggctgggcagtgactctgtcctgaaaagccgtggtggggaggctggagaacagaatcgggaggctgcaggacccccgcagccccagctggactgcagtgctctctgcttcccagtggccctggcggtaactccccactccgtgctccgttcgcaacgtgcccaacgggttgcagagaactgtgtgctttctcccaagaatagggtcccagagccctgtacacctcctggcagcccagctggcaccctttccatcctgacccctgtctcagaccgggtatcccaaggggtcggaaaagctgtgccttcttgatactgaccgagctcggagagctcaactccattgcgctgggggctaaggacactcattggctactcaaaccttagtgttccatcccttattcgcccacccctaccgcaggtggacttgagagagacgaagacctaggaaaaaagagaaagtagtagatgggggagcaggaacccaggcatccgagcccctgaccaaacggaagatgaacatataatagacatgagctgctttgaaattttatggcctggaaaatccaggcgaatactacacccccccttttccagctctccttagggtcaggtgactccttctcctcccccactgaggtctccccccctccccaactacagggaaccaggcctctcttattccctagtggtttggcaaggttccccccttcccacagccccctgcaacacacacagagtttggttttatggctgtgaacagaagacgggggagactggtttattggcagatgggtcataaaaagctgggggctgaggggagtcccagtggcccacccccatgggagaggcacaggaacccaggtgtgcatctgggaggctgagtgcctcacactgcccctggtatttctgcagacctcaattccacaagacttggtcagggctgttaaactcaaagaaccaggaaactggctgtgggggtgggaggtatggggatccggtctggggttcctcagtttcccttctattcttaagccttctgcttatggaagctagggtcagtctcagatcgactgagggcaggggtagggggtggggtttctaggaaacagagttatagaggaattcagatcaagagtttgctggaagatgaaggttacagagggaaaagatactctagtctctgtggtgtagtgtgtgtgaagatttccaggatgggtgatggggctgtggacttctccttgcccctaaatatccttagcatcccttaaccaacaggcctgagcccaccagagttagctctggtaatggggatacacgaagtgaagggaccctgccttcatgagttgggctgtgcaggtgaggcctgggtcggtgggaaggggacaccagctggtaggatcccatcaaaacttacagtcccgtgccaccccaggacttgtacaagtagggaactgggtctccggccaggtattgtacgtcccctttaagagcctagctgagctcttaagagagggagggggagtggaggggaggggagggagagaggggaaaaggaaaaagagacttttatagtctaatccccagggacccgctttaataagagacttgtgctctgctaatcgggggaggtgtttgtcagcagagatggcctccgttcccctccccctccctcccctcccccagccctcaaccctggaccccagcccccacctctcctaggctgctctgcctgccctagttccctctaccctctcaggctctcccaccaagccttcatcctgggaacccagccccctgcccttctgggagccaagcccagcccgagtttctctctcctccccacaccaagaggcccctgccctctcagcccaacctcctgcccttaggccttccagccatggttgggagtgtgtgtgtttgggggggttagggtggggggaaggggaggtggtgtgcagggagggggttgggcatttgctgaaaatagtgcagtgacctctctctcccaccagcgccgcctactaaacctgacctgctgcctgccaccagcccgatcaattcaacacagatgtggccccttttcctccccatcagagctcggcatatgtgtgctgggtactctctcgagccccgtttccctctgtggctctacctgcttctcctttgttcctcagtctgtaccctttctatcctttctctcctttaccccactaggtttagcttcctcccacctttagctttctaaccatcacccactcctttctatcactgcctctgcatcaggattctcaaactctcaaacttattctccctttgccatgattatcccctgcatctttccactctaacttctatttctctccctatatctactaatatgccttcaactcttaacagtctcttctctattatctccctcaccatctccagtctctcccctggctcttctccctgctcttttctttctccctatgttctacctccttgtagcactgactgtcccctgtccactgggacaagtatgtggaaccaaagacttagatgtagccctcatcttcaaaccctggatcagcttaggtagagggagggttatgtttagagcttagtagagaatgcgaaaatagtagtagcttctcaataaatgttggtttgtttgtttcctattttcacattctctagttaatgctcagcactcatgtgaagcaagaattattattatctgtatcacactgagaagtttggtgagtaaggttagatagtggttagtaaggaatcaggcagtgattaaacccacttcaattatagccaaagaacagaatttagatgccaggaagaactttcaggcacttgcctgtataatttaagattgggagtttagggagttcattcaccatgtatttattgagtgctgtctagcactatgggaggcactgaagctacaatggtgagcaaaacagacacagtatgaataacaacagtgtccactctcatggagattagtacctaatggcaagaaaatagacaattcttatgctgaaatttgtaaagtatgctatttgggatgttgcttgtcactccccatctcactagtagcttccctatcccagctacttctgatctctgaattctcaccccccaaaccctactccattgcaccatcactgaagctccagccagtaaaataactggactaccagggccctgggacctcagagaataatcaagaaaaaaaaaagctatagagactttgggtatcatatcctgaatatatgaagttcattaagcactttctcctcatctcccttagaaggtcctctttctcccagggtgggggtggggaagagctgacaggacaccctaagtccatcctgattttgcagaactcaagacatggggaggatacttaaaggcctagacttcctaaccctgcttatatggctctggaagctcattcctgattcttcctatctagagtcaggatagacatattctgtccaatggagacatgttgtaggacactcccaactgacttaggaaaggcagtgaagaggagctggaatggaggcagaggcagatatttattgagaatcatctattagacccaagaaggatcaatttaaggtccagagcaaggggaaatgggtcaaaatgtaaagttgggatgttcaaactttgtaaagacctactggcactagactgagaagtcaaaggaagctcaggggagaaaaaaggcattgtagttaatctggtgtatttaatattatttctggtgctttaggcaaataggaggcaacaccatggaggtaattattcctttcctcaagagctgggggcagtcatggtgatgatgatggagcagcagctgaagaaacttcttaagagagaatggggagacagatgtataggaagtgcttggatagttccattttgctgggtgttattcctaatgggagtgaggcaagaagcctagatctgaattctggtttacataatgggataaatttagctcatgctccctatctggaccctgggttatcccctctctgaggccatctgtgttattttgtgggggagggatgtgccaggctctacctgtccagcagataaatcagagcagataggggaaaggtgatggaagggcagcaggtgtgataagaggtatggcttctataaagagcttcaaagattcagaaaatgttggagccttatatgctgggaaaagttggacagtaaggatggtggtggatgaataattttgcaggttatctggtagacaggaacctatatattagggcaaatggattaggaaatggacacagatcagtaaggccttatagggccatcatcctaaagaggaagtgctgttttaggtaccggagacatggtataagataggcatgggagaagggtaaagaagaactggaaaatcaggctgagaagtccaaaattgccagtgccacccaggactactgatcccctacacaaacaccctttgctgatgctgtgcccttctctcttatcagcggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctggtgagcagggggcctgaggtggtggatatgtgtaacctggccctgaggagatagggttacattggaaaaggtagacaaggaatgtgaaggaggttggggaccagcattacttctctggggtcagcagctgattctagaggaggaggtgaggagtggggtggcaactattacttctcaaggatccaaatcagacaacagctgaaaactggatttgaaggtaaaggtgtcagttaatggaagagctgtgagaacaaaaaaactggctgttgaggcgttgggccaaggggctgacagggatcaggttgccagaagagtaagaattagagatggtgagttgaaggagagctagctagctggcaagaaaagtgggcaaaagataaattctgggggtgggagcaatggaaaagctgagaagtcagcagtctctattctgatgcccctggcaggtgggaaaggaacagggaagaggaactgttcaggaccatatcacatttctttcccctctccctgaccctcagcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagacccctagccctgcccccatccccccaagccctagagctccctccactcttcccgcgaacatcacaccgttccccgaccaagccgtgtgcaatacaacagagggaggcaggtgggaattgagggtgaggggtttgggggaaaggggaagcaggggcatagtcagggtggggagtgtttgaagtttgcagatgagaaggtttgacaaaaagacagagagatgtagagacagtgatagagacagaggaacaaaaagagcagcagtgagaaggcaaagagagaggcagaagagacagacgaggcagagacaaaacactgagaaagagactgaaatggagtaataaatgaaagccccacaccaagcctcctttcttccactggcaaggtgaggggcttggtatagtttggggagatcccctgactattcagtaggagaagaaatcaaaaatccattcttttctccttctctccctccaacagtggccaggggaaggggaagtgagggcaggggcaaaaagatttgggaatttttatttatttatttattgtgacttttcatttttttggtatttggctttactggaataggagggcccctgcccactgtgccccgtttatcccttattccccaaaccctgctctccccaacacctactcacttaagcacttgtataaagcctccagggttgggaatgggagtaaagggcaagagggcggacacatgaagtttagtttctaacccatcatcaccctaactcaaccttttctgagccaaatggcttgaattgaagccagttgtcatggaaatagtaagaggttagggtttaagagctggggatgcgggggtgggagagagaaccctcaacatccaggatctatataatgagagctactttaaaccctcaggtccaccctcatgatgctgagttatttagccagagggtgcagcctgcttatgcccaaattccctcagccaagagagagaccaaagagcctctggaatggccctgctcccagcctctatcttcaggtcaattagagagagtatagagaccccagagtcccctgggtctggaaagcgttaggagaggtcaagaaaggagcagtaaggaggctgaaggttacagggcatttgaatccaaatcactgctctgggctagggaatagagccagcagaccaaggtgggaaggattctggaagggggacattttagtctcctaaccccaaagctcagggtggaagaggggagaacaaggaagcagagtgtataattattttttccttttatttttggaatctaacagtacctggcagcagggaggggaaagtacagtggggaaaagcatctgacaaggccagttagaacagaggatgggaaggatggagactcccgggcttggaaggctaggaagcaggcagagactggttgccatttcaagtcactagctaggcccattcattcctcccacaaccctgacccattctcctctggactcactgtgcctcagtttcttcccctcaatggaatgagaaatgacagcacccgccacagccaagagatgaattctgagcacttaccacgggcactttatggacataaaatacctctcgctgtgggacagataaccagggcaccagagtagtggtgaagagatgtgaggcttaagaggagtcacaggcttcagagtacaagttcccctctgcctcccagctggacagtgcctagaagccaaggagttgagaatctcctgatccacaccctatccttacttcaccaccaggcctcttggctccaggcaagagcttagaggatgtcaggagaggtgggggtaagaatcttcagcaaaactgtcactctaagtagagccagcagttacgggtctgataaaaacagtactgaactaaagtaaagcccaagctggtgagcaaaactggatggctcattcttcccaagagcatgactctcccccttggccagttggtggaaggggcaaaggtatgtgaccacccttgagaaggtgatgttggtgagctttaacatcttattcctattcttatagtgagaaagtgaaacaagatctttcagtagaggaatgggcagggctgttaggctcttcagcttgccttcacccatatagcagctatgctaaccccaagcctctctggccctgttcttcatccttccttctgccccaatcctgaaggacaagacacacccggccatcaacaccactcacatttccttggtggaaggaaaggaacagagaagtgaagaacagatacctccctccaaggtcaaatgcctcgtgatcttggcagagtagggattgggcaataagcatcaggtatcttccctct

SEQ ID NO: 13167 - DNA, 7657 bp, Human
ggtgtggtgagccactgcgcctagcccctcctcttactttggggaacatcctactctgtctatggagcagctgttgtttcaccactttactttcttaataaacttgcttatactttgcactgcgactcgccctgaatctttcttgcatgagatccaagaaccctctcttgtggtctggattgggacccctttcctgtaacaaatgcattggctgataggagaataaagaaaaaaaaagaggaaaaactagagtaacttctctacataatcatattatatgaccgttttgttaaccatgataacagttaacaaaataattttcttatgtctaattctcagtccatgtctgtatgtcccaaaatgtctttcacagctggtttgttcaaccattcaatgaaggaccaaacattgcagttggttgttatgtatctagtctctcaatcttgatcttcagaccaccttcagcccatctcaccacatccgtcccaagccctttgagccagccaaccccaacctgccatgtactttacaaaatgctccttttttttccacagtcgactgcttctctgtccctggagctctcccctttattctccaaggtcaccttgagcacatccttctgctccgtgaaatccattctcctctccctttccctccctctgagcttaaccagctgccaccgcaggcttctgcctttcttcacagtgtggccagaactcggttctgcctgctagcagagggcagggccgctgtcttcctctccttgcagcccccaagcctagcacatgcctggcatctagtggcagcacaataaggaacctgatgaatactcctttcttctgctctccgctcctcctccacagcctgccagccatggtcaggaagagcaagatccggaatgggcttggtgtgtcccgcgggaaggccgtgatcctggaagatgcttctcagcccagcccggatctccttcctttagctctagagacttctttcattctttgtgtacacacatacactaagactcaggaagtggttcttgaggcaggaccttaagagcccaaggagtggggccgaggctggaggtgtgggggtgtgacggccggtcctactctccggcctgttcagatcagctccttctggggaccacccctggcacacaagggagggaggcagcttgatccccctagcccgcttccagccctcacctggctttgtcttctgggataagacggggaaatccagaggatgtaagcctctcctgccttcgtgtcttcccccaagccctcgctatcacagacggatgcaggagctgtctgggaggctggaagcacagaccttgtcaatcctcccccagagggcgggacccgacgcggacgtgtcttgattgactgggtagcgtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggtatagcgccagaggggggccccaggcgccccgaggtcttgcccttgcggctttccctttgcgggggtgggcgccttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggtgaggccgcggggacccggcggacttcggcgcgggctgggagagaccacccgcagtcccttcctccagggctcgccccaggcccgcggagactcgtccggcgctctccagccgccctggagcaactttgcttcgaagttccctgggcccgggcagggtgtggcgggggtgctggctgcactttttttttttttggtgggcggggaggtcagagcccaggggaaaggggctggggcgggggtcggggttgggctgaagaccgtttctccaggctgggtgttgggtggggaaagggtgtttgacgcccggagactggcgggccgagggtcggcgtcaggctcaagcccctgccggcgcccttggatctgtcctgggccccagaggcggcggggcggggtccgggcttcgcggccgtcgcccccacccctctcctgcgggtaaagagggggctgggagacgtggatccgaccgcgggtttccgggtgggaggggccgggaatcggggccgtgaagggaagccctcgagggccggccgggagcccggaaaccgaggtcccccttcggccagttttaatccccccgccctcccctctgccccaggcccggcagccatggcggtggaaggaggaatgaaatgtgtgaagttcttgctctacgtcctcctgctggccttttgcgtgagtggcgaggggtcctggggggcgcgccggcagggtgcggggagacctggctccacagtggtgagggctgagggaatgagaattaaggcagctggagaccagatgtggaaagaaagccagggaaagacagcgcagccactccctcctccagttttcctggacacctgaggcttgtttccaccgagaatggccatcctgggtgtgcagcaacccctacccccatccctcctggcccttcctgtctggtgacccaaccacttgtgatatggggcagtggggcaaccagccaaccgcctgatgctatcgccatggggcttcccttcgctctcccttctcccctctctccctccccaaccctctcatccctgtccagcccctctccccctttccctcctcccagcgcttgggggtgaggaagggctctgcccacttcaatttgctcctgccctgggctcctggcttgagaggctactgtttgtctagggagggacacatcactcttgctcccttttcctcttcccttctcctggcctaactggccagaggaaccttagtcacagctgatgcgcgcgtgggatgtgcactggaggatagtgagggggcagttctgggagagaattgagctgggagccctggaggcctgtagaaagcattattctaggtcagaaatacgtgtcttgaggtcaaggctttctgggaggtttttgaatttggtcatgtccctgattaaagagccgggaggggatcaggggaggtaggggcaggcaaggatgggtcatccccctaccccacagccaaagaaattccctagaggtgtgagaatctctcttccggatggggtcaagtctgtgtcctaggtgtaccccctgccctccaccatggagggccactgtgttgtggatatggcctaatcctcacctgattttctcttaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacggtgagttgggggcgggaccaacatgggcggtctgggactgccagagcagcttggttcgggctcaggaaggtgggtgaggtgggtgggtgaggaagacctttgtgagtgtccagggaccggctgtgccaaaacgggcccctgtaatgcatagactccaaacttgacttctgtcctttgctcctgcagtttgccatctttctgtctcttatcatgttggtggaggtggccgcagccattgctggctatgtgtttagagataaggtaagcagggaataatgggaagggcctgcctcagccgggtctgggaccctggtgcttgaattctgactgcaacagtgctcctccgtactctcaggtgatgtcagagtttaataacaacttccggcagcagatggagaattacccgaaaaacaaccacactgcttcgatcctggacaggatgcaggcagatgtgagtggggttgctgggagcaggggtggtgggaatagagaattctcatctccaaggctgggtgtggtgactcacgcctgtaatctcagcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaattctcatctccatattgaaggtgaaggttcacttaacaaccttcttctccatatttcttccctcccccagtttaagtgctgtggggctgctaactacacagattgggagaaaatcccttccatgtcgaagaaccgagtccccgactcctgctgcattaatgttactgtgggctgtgggattaatttcaacgagaaggcgatccataaggaggtagggaggagactgtgtatgggacttgggaaacctgggaaatgttttagaatgcaagagacccaggatggaggtggacagggtcagggatggggaggggatctggaaatgctaagggtggggtgaaaggtacaggggcagggaagagactgatggaccaagggagggggttggggtgggaagtttctgatggtgcttttgtcctttgtgcctgccaccttcagggctgtgtggagaagattgggggctggctgaggaaaaatgtgctggtggtagctgcagcagcccttggaattgcttttgtcgaggtaagagataaccctgagcaggggctgggactctgtccagggtgcctggagggaaggggctgaggggaggagggtgctgaacaggaggtactggcctgggagtgtgtgtttggagtctcttgcatgggtctgaggtagctagcccttctgactcctctccacccctgtccccatctttccttctaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttgctggaaggctggattcagtagactgcttgggcaggcttgggaaggacccaggtgagcacagcatccaccaggctggctggcaggtaggaggcaggcagccagagcagcttggcatcccaacctgggctgtagcgggttcgggggtgtcgagcagtcagggcatgctccaggcatcggctcaccttggttaggtccgggtcacagatcaggttcatgatgcgctgttgcattttcaggtctgcagccccataggtggttgcaatcagtttcccttcctcactccagcccatcttaggtactgtcttctggggccctgggcttgtcaccctcagtcccctcctcagtgtggggagtgggcaggttccacatggcctgggcactcttgtaacatcctgttcaccctcaaccctgccctgggtgccccacccacctcctagcaggcttatgcaggactggcctttctggtacttgtttcccttcatgtgcccctgtgtgggcctggctactcacacttggtgaggaaggcccccccatagtgggcctgtgtggcaggaggcagccgtgcccagcaggcctgcagggttttctccagactctccaggttggtcacaggggttcggaagaagccaggctccacgatggagactcgtatcccaaaatgagctacatcccgcctagagtcggggcagagcgaagttgctgggttcttgccctatagggaggggactttgagggacatgggttggggagctgagaaagttaccacagaccagggacaagagttttgacggagatgcctactgccccgggacaagggtcaagtggggtagagggaggaaagtatttttgaggtttgttttctttgatctagagcaggggtcagcacgtttttttcttaaagggccagagagttaatattttaagcatggcaggccaagaaacaaaattaatgatattatcaggtacttatataacagtttacaatgtaaccatttaaaaataaaaaaaaccattatcagcttgtaggcagctggccagatctggcttgagtactgagtttgccgattcctgacctagaggaaccccattcccttgctcccaaaacacatggt

SEQ ID NO: 13168 - DNA, 8271 bp, Human
cagcccataccttgattgaaaagaaaaactagtgcctaaggcagaagggagggagagcatgtgtgtgtgtgtgtgtgtgtgtttgtgtgtgttccttgatctgtgtgggcaaaagcgaaggcttgggagagcaactgagagccgagaagaaacccctgggataccctcttttgacccagggttcctggggagggggtttgtactcccatcctaacccggcttcagggaggggcccaatttccctctccaacttcttgcatagatccctaggcttccaatcactgccagatgtgttcctcctgctggattttcccagtttttccatgcccctttttccctcccagctttttcctcagggatatcaccccaggttttccctcccttcccccactcagctgcaggaactcctttttggggtttggagctggtatgtttctagtcagctccgagcttggctctcctgggaatcctgggagtgaaaggaaggagctgggtttatttgcatgtactggtagtcatttgcatcacatccaaaaatggccaaaattatgagccctgattcttggctgaactcccactgctgcaatggaatattagtcccggagaccacccccaactagctggagctgatctcctccctcctccaaccccccagtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttaggttaaggaggaagtagggtggtcccagaaaccccatctatagccccagtgtcagaaaaggtagagaaagaaagaaaagcagttggtgggtccaagtaaagccttttccaggagatgaataaaacgtattccccagactggaagccatactctacccattctgattcctgggctcccacctcctctcccccttcccaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtttctctgtggtgtgtttcagagagctactagctccagtgtcgggggtgggagtggaaggttcaaaggtggtttccctgagggacaggtaccttttggggagagggtggaactagcttcctcttactatcccaactctcttctcctccatggcccttgtgcaggtgtctgttaggcaagcagagggtgggagttcccatccctcctgagagaaggtcctagtagccctgccccaagcttcctaattcaggacttgtttcctacagaagagaaacaaggcaaggtacaggcctggtccccagctctggctttctgcctctccacgtgctcatggcctctcccaggctaactctaagcagtgtcatgagtctgagccaggtgggagattaattcctgggggcacttcagggctgagaagggggaggaatgacaggtccagtaaccgttaccaacagagcagtgcagctgccatccttgacagctccctcctccttggagaccatgacatagatggtcaggaacccaggctgagaaagacagccaaggggtggggggagcctaggcaaatctggcctctgccaagtcctggcttcagccaggcaagctccagcctccctggctcctcctcctcctcagtcctatccccaccctgtcacacatacacttaatacgcctggcatccaagtccacccactccggactttggccttagcagtagttagtgtgggaggctgggaagactgggagcagtctcttaaacaaaagcaaaagaataagcttcgggcgctgtagtacctgccagctttcgccacaggaggtaagtggatactgggagctgggggaactgagaagactagccagatattacatgtattgccaactcaaaactttcagcttttaacatgcttcctcacacattatcccctttgatcctccacaactctgaggtggacctggtgggtcttagccccacttggtagatgagaaaataggttgagagagacagtgagatgctcagtatcacacagcaaacctcttggccctatacatcattccaaacacaagacccaggttgcatatagaaggttcagtgtccctggtttagaaggagaggtggtgtgaggcaagcaagaagatgcctctgctgcactccagcctgggcgacagagtgagactccatctcaaaaaaaaaaaaaaaaaaaaaaagatgcctctgctccatacagcaggtctgtacacaggatctggctcatgtggttttagttaagttagccacaaatacagggtctgcccacatctttgctttgaacagatgagccatggttggccaattatctgccaaccagataatttctcaatatgctcacaccagatgcttccagctagggagggtattaggggaaagggcttgagggccacagtaaactggacaagtttttctgcccagcctaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcaggtaagtatggtagaccaccaggaatatggtgtggggtgtcctgatccccacagtcaccccaggagtcacctgcaagggctgtggtaagctaaagggacaatttgaggagaagcagttttcagatgctcccaggaagaagagggagctgtgggagtgcctcacctacccccagcatccttttcatctccccacagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggtgaggggtacagggctctgggttccaggactaacagcagcccactcaacaaacgtgggccagcagaggtggttaagatacagcacattggaatagttaagaagagacagtttagggctagacttcatgggttcaatgaagtctacccttatgtaagctttgtgaccataagtagattacttctctttacccatttttaacgtgtttgttttttgttttttgagatggagtcttgctctgtcgccaggctggagtgcagtggcgcgatcttggctcaccacaatttccacccccggggttcaagcgattctcctgcctcagcctcccgagtagctgggactacaggcatgcgccaccatgcctggctaatttttgtatttttagtagagacagggtttcactatgttggccaggttggtctcaaactcctgacctcgtgatccgcccacctcagcctcccaaagtgctgggattacaggtgtgagccaccacgcccggccttgcctctcgtctttaaacaataaggttcaaagttccgtgggagcacaaaggagacatgatgaggacaacgggagtagggcctgagtttttttttgtttttttttttttaagcgttttgctcttgttgcctaggctggagtgcaatggcgagatctcagctcactgcaacccctgcctctcaggttcatgtgattctcctgcctcagcctcccgattagctgggcttacaggcacgtgccaccactcccagctaatttttttgtatttttagtagagatggagttataccatgttggccaggctggttttgaactcctgacctcaggtgatccacccgacccggcctcccaaagtgctgggattacaggcatgagccaccacacacggcccaaggcctgagttcttagcaggagtataaggcgcctaagcttagtctaccttctaaggaagcctgcgtttgtcaccatcactcagcaaataacctgaatgtctcctgtctctcagccttaatttttcaggcagcatcatgggacacatacttttagttttgagacaaggccttgctctcacccagggtggagtgcagtggtgcagtcacggcccactgaacttcaaactcctaggctcaagcagctcaagcgatatccgcctcagcctcctgagtagctgagaccacaggcgcgtgccagcatgcctggctagtatttttttacagatggggtcttgctgtggtgaccagacttgtctccaactcccggcctcaagcgatgcttccgcctgggcctcccaaagtgttgggattataggtgtgagccactgcatactggaacacatactttatacttgaatttttttttatccccttccctcctgctccttacctatacttggatttctacatctgtgccagggcagtgggatgtatccccactttccccatcagcttaccctccagcaaatacgagactatacccttcaatatccagcactcagggctcaaccatgtgttttgggagcaagggaatggggttcctctaggtcaggaatcggcaaactcagtactcaagccagatctggccagctgcctacaagctgataatggttttttttatttttaaatggttacattgtaaactgttatataagtacctgataatatcattaattttgtttcttggcctgccatgcttaaaatattaactctctggccctttaagaaaaaaacgtgctgacccctgctctagatcaaagaaaacaaacctcaaaaatactttcctccctctaccccacttgacccttgtcccggggcagtaggcatctccgtcaaaactcttgtccctggtctgtggtaactttctcagctccccaacccatgtccctcaaagtcccctccctatagggcaagaacccagcaacttcgctctgccccgactctaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtgtgagtagccaggcccacacaggggcacatgaagggaaacaagtaccagaaaggccagtcctgcataagcctgctaggaggtgggtggggcacccagggcagggttgagggtgaacaggatgttacaagagtgcccaggccatgtggaacctgcccactccccacactgaggaggggactgagggtgacaagcccagggccccagaagacagtacctaagatgggctggagtgaggaagggaaactgattgcaaccacctatggggctgcagacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaaggctgaccccatttaagtgccaactactccaaaccgacatgctcacggtctctggcctgttcagtccctgcaaaacagctagcacccacagtggggcgccagggaactgcctcacatctacagctgcacgtcggggagtggccatcaaagggcactttaatacatttcccttattttctgaaggggagtaaggttgcaattcagtgtctgtactgggaatggtcttcatatttcttgggggagaagagcaggtgatgagggttctgggccaggctgggtggcttccatggaagaaaaggcaatattcacataaattctcctgctaaggacactgaccacacaggtgtcaaggcaacttatcatacttcgaaaggagctggatcccttgaggattggccaggaagggaggtgctgggcccttagcggtgcacagaaggccaggaagatgtccaaggcagatgggggctgggctctcgcaggtgggacctttctggggagctgctttgacttatgcagcagatggcttcatgaatgttcatagtgagcctggcagcataagactagggggcagaaagcaccacagtctctggatcctcacttctcccactgcctgcccaaccaacaccttcgcaaagtcctcctttcccaaacaccccccaaaatagacctcgaagtacacatgcattaaggtcccagaggacagggaacatcagtaaggaaaggaaggaatcaagcatcactctaagacaaactcagaccatctcttttcggtctgaaaaaataatccgtttaattgaaaaacctggaggatactattccactcccccagatgaggaggctgaggagaccagacccctacatcacctcgtagccacttctgatactcttcacgaggcagcaggcaaagacaattcccaaaacctagaaggaaagatggggacaggggtggagaggagtcagaagggctagctacctcagacccatgcaagagactccaaacacacactcccaggccagtacctcctgttcagcaccctcctcccctcagccccttccctccaggcaccctggacagagtcccagcccctgctcagggttatctcttacctcgacaaaagcaattccaagggctgctgcagctaccaccagcacatttttcctcagccagcccccaatcttctccacacagccctgaaggtggcaggcacaaaggacaaaagcaccatcagaaacttcccaccccaaccccctcccttggtccatcagtctcttccctgcccctgtacctttcaccccacccttagcatttccagatcccctccccatccctgaccctgtccacctccatcctgggtctcttgcattctaaaacatttcccaggtttcccaagtcccatacacagtctcctccctacctccttatggatcgccttctcgttgaaattaatcccacagcccacagtaacattaatgcagcaggagtcggggactcggttcttcgacatggaagggattttctcccaatctgtgtagttagcagccccacagcacttaaactgggggagggaagaaatatggagaagaaggttgttaagtgaaccttcaccttcaatatggagatgagaattctttttttttttttttttttttttttgagacagagacttgctctgttgcccagacaagtgcccagcggtggctcaatctcggctcactgcaacctccgcctcccgggttcaagcgattctcctgcctcaccctcctgagtaggtgggattacaggcactcaccaccacacctggctaatttttgtatttttagtagagacagggtttcaccacgttggccaggctagtcttgaacttctgacctcaggtgatctgcccacctcggccttcaaaagtgctgagattacaggcgtgagtcaccacacccagccttggagatgagaattctctattcccaccacccctgctcccagcaaccccactcacatctgcc

SEQ ID NO: 13169 - DNA, 5975 bp, Human
  misc_feature (1)...(5975): n = A,T,C or G
ggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcaagaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgcccnnnnnnnnnnnnnnnnnnnngccacggtggcctgcgcgccccaggtactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaacttggtgtctgactgagtataaatggactgggtgggagaggcccctcacccagtaggggctgttttgctgaccccctgaatatcccttgagcaccctgtcagtgccaggcctatgctgcagccgtgatctcgtgtcatctgcacaatactcatatgaaggacatgctgtttgccctcactgtctggataaagaaactgagactcagcgagtttaagtgacttgcccaaagtcacatggctattacgggaattaggactcaagcccagatccttcctccctctcctgctccgctttcatatgagagcttcggagtgagtggcaaggtgactcataacacacaactgtagcttgagggggtgatttgggaggaaagataccccgaggaaggcccaaaagaaacaggcagggtatacataggagggagcgagaagagcggaaccaaatcaacaggcgtgggcctcttctgtcttctgaaaacatcactgggctcacttaatgcattctccttaataccaatccacatgtgacacttgacttggcaaaggagctaagaaggctctagtaagagaaggagggagaatgtatgaggtagcaaaaccacccccctttcctttgctcttccccttacttccagccaaggaaagatatcctcagtccctgctgaaagttctcagggacactgctgaaagttctctcaccaaacccaccaaccacgtgggtagggccaagtctaaggctcctggctccagat

SEQ ID NO: 13170 - DNA, 17616 bp, Human
gaaagcggaaggttgataatgataaagccccaggcagaagagaatgggaaactctaatgataacatgaactgatatttaatgaatgtttaccctgggccaggtgttccaattgcttttgagcccacaggaaggaaaggttaatcttttcctttgagattagaaccaagaaattattttatttatttatttatttattttttaggtggagtcttgctcttgtcgcccaggctggagtacagtggcctgatctcagctaacagcaacctctgcctcccgggttcaagtgattctcctgcctcagcctcctgagtagctgggattacaggcgcccacaagcacgcctgactaatttttgtatttttagtagagacgaggtttcaccatgctggccaggctggttttgaactcctgacctcaaatgatccgcccgcctcagtctcccaaagtgctgggattacaggcatgagccatcgcgcccagcccagagcaaagattcttaacctcagtttcctgaaattatatcctaaatttgttgggtaagtgcattttttaaagtacaagagaaggcccataagttacatcagattttaaaaagggtgtttgagcccccctcttccaaagatagaagaatcaaggaagaaagggtaaaacatacatacatatatatatatatatatattttttttttttttttttttttttgagacggattctcacactctgttgcccaggctggagcgtagtcgtgcagtcttggcctactgcaacctctgcctcctgggctcaagtgatcttcccgcctcagcctcccaagcagcttgagagaacagacatgtgctacctcgcccggctaatttttgtatttttagtagagacggagttttactacattgagcaggctggtctcgaactcctgacctcaagtgatccgcccacctcggcctcccaaagtgctgggcgtgagccaccgcgcccggccgaaagattggttttaaaaacgagtattttgagatgatgagaaaacgagagggtttctgccagttgtcctttctcccagtgaaacaggattagagattctctttaatgacagtaaaatttggtgattgtgacatttccaagttctgttgattgattcatcatcttccctccatcatacacgtctaagggcagagtgaacttccatcctgaaggctccgcgcttagttttcgcagattaatagctcaccaagaatttatcatcttttctttccactaactcgaaaccaatctaaattctttccaaacatcttctcaacgtagtctcctttgatgaaatttactgtttcggattctagacttggctcttaccaacttaactttcggttaatagcttaatacctctgattcaggtttttgcatttgtcaactaccattgaatgataatttcaatgagttcgttcttatgaggatcaaatgaaataacatctgtgaaaacctcttacaaagtttaagcaaatagtgctaagcaatcaccaagcgttaactactaattttcagtgttaggtaatttttaaaagctttccggagaattggcgtcctgcacaccagtctcgttccaaaataatgcaggcgggggctggggtgggggcgctcctctcggactgaggctatgtctttcgctccttttgtcttttccaggcattagaactgtcatggcgccttcaagaagaggtaggaggccctctctgcgtccagcagaaccatctggggcacctggaccgggcggtggggtggacagagagacgagccccagctgggaccgaaaacatcgacccctccgagaggtctcggccggaccggcgcaaggggaggagagcgggtggaagcccaccccagcgaacgcccgagggccgggccccgcccacccagaacgtcacccaatggaaacctgccggcggtgcggcaccgcccatcgttggtccgggcgccgcgagggcggggcccgcagttcggttgcgctgcggagcgcagctgtgagggagtcgctgtgatccggggccccggaacccgagctggagctgaagcgcaggctgcggggcgcggagtcgggaggtgagcgcccagggaaaagagggcccgggagggaggggttcgcgagaggacggaaggatcggcctccgaggcccgggacggtgggacccgccagtcgggtgctgaaggcggccctgctcactcagtagcccaggcccgatcgggccctgcctgctggagccgaggggccgcttcggccccgcagtcgctgcttagccctccctggcgtctctggcttggcggcggcgccccgggattctgcgggcgcgggtcgggaggccctggcgttcgcttggaactccggctgcgagaggcggggcccggccgggtgggggcggggccgggggcgtcggtcgcggcccggcggcctgcggaagctcggcggcctggcctggcctgctcgcggggaggtgcgcagactgcgcgggggcgtggcctgcgcccctgactgcgctgtcggtccggcctttgatgaggtggccgccgctggctccctgggccccagcctggttcccgcgcgggccgcggctgccttccagacgcagggcatgcgacctgttggagtgtgaaattctaggggccgggttcctccccagagcggttttatttccgactggactgtgctgcgggtctcagaggccctctggtccgttcagggtgaggacagctgagaggcctgggcccgtgagctcttgcagaggagttgacacgcagaggggctgctgtccaataaacgaaagtgtcggggaaaaactttgcagggcgatctgcattactccaaagtgaacacactgcatgtctcagggtggctggaggcggcgagaatccccttatgggagtatatgagcttttccatgtgttatctctttaaaacctctcagcggctccgagacaaaactcccagtgtcgcagaggtttcttcatcaataggagtagtgctggagaatcttgggcactgccctcattttgcctgcgaaggaaaaattaggaagggataaaaagtcacaaaaattaggaaggtgggggggataagcaaattccaagggcatctatctctgatgaagggttggtgtctcctgtggtgccctactgtggattagttatttgtgtcctcggtccagaagtttctctggagcccattggctacagctttcctgtattagaattctactgttatttcctactgtagtctggctgggaattttatttagttgttcagattttagatgcattcagtgaatgcagctgctcaaggaagtaactaatagtgtcttaccattttcttagctacttttcagaagaaggaacatgatctctaacagaagttttctggtagattactaaaacaggcagatagtagctttcctggctggctgagttaaatccctctccagcgatcctcccacttcagcctcctaagtagctgggattacaggcatgagccagcgcgcctggcaaatctctctagaataagtcaggatctagaaaataacatagggaaagaatatcttgccagatttcctctgtactgcctattgctctttggtatttactagactgtcttctaataaaaatctcctgagttgagttaaacgtagtgtagattgggggcagagatgggcacaaatgggcatcagagagttctaaaaataaatgtgggcttttcaaaagattggtgtgttgactggagacttctgaacttagaggagcacatttagtttccagggtatcagtttctttttcttttctttctttttttctttttttttttttttttgagtcatagtctcactctgtcacccaggctggagtgcagtggcgccatctgggctcactgcaacctccgcctcctgagttcaagtgattctcgtgcttcagcctcttgaataagctggaattatagacgtgcgccaccacaccctgctaatttttgtatatttttgtatttttttgttgcccaggctggtctcgaactcttgagctcaagcaatctgcctgccaccatctcccaaagtgctgggattacaggcgtgggccagcttgcctggcccagggtatctctttcatactgtagagaactctcttgagctgagcacacacaggttccaactccttcacagtctttattcttagagatatgaaataacattaagtggttgtcttgtgactttttgtacaagttaatggcatttagctctcaataattctttttcttcaagtacccatgaccctgaaaatgttatgctgtataatactttttcctataaaagttgtaccttgagttatttatacttgtaagaaataacctaggctgggtgtggtggctcacgcctgtaatcccagcactttgggaggctgaggcgggcggatcatgaagtcaggagattgaaaccatcctggctaacacggtgaaaccccatctctactaaaaatacaaaaaattagctgggtgtggtggcacgtgcccgtagtcccagctactcgggaggctgaggcaggagaatcgcttgaacctgggaggcggaggttgcagtgagccgagattgcaccacggcactccagcctgggtgacagagtgagactccatcccctctgccaaaaaataaataacctatatcagatctagtcccccagagaatggaaacttcagagcctttgagcaatgtgaatgaaatgaaagctggaagcttaaagtcttagctctggcttgaatttgtggctgcttgaatgtgggcatttattttgtttgttattgtatctcaaggacttagcccagtgcttggcccacaataaatgcttaataaaacatctgttaaatgagtgaatgaaaaaaaaaatgttgttaaccaatacccatttgtcacactcacatcacaggaaaggtgaggtcatcagggatgaagtcactaacaactgccagtcatgtgccccaagggtagcctcaccatggactagtgggcttgttctgtgtagagaagggatggatagtgaatgccaaggttagttctagctggataaattagccaagggtttcagctggataagttggctgagggtgctacaggtctagccttaaggctgtctcactgaaacattttggagtctggagtcatctgttctgaatagcgcccacatagtttatatttttttattttttgagacagagtctcactctgttgcccaagctggagtgcagtggcacgatctcagctcactgcaacctctgcctcccgggttcaagtgattctcctgcctcagcctcctgagtagctgggactacaggtgcgtgccaccacacccagctaatttttttatttttagtagagacagggttttgccatgttggtcaggctggtctcgaactcctgacctcaggtaatccacctacctcggcctcccaaagtgttgggattaaaggcgtgagccactgtgcccgtccacacatagcttaattcttgagcacagtaaaaatagggtgtacttggggattcaaagggaagcctattggatgagtatttgccaagaaggaatggagcacctgattttgctggtgatttgaaccttactctaagtgggattagactgccataaatcttgtgtttgtcattcctgggagggtcatcttcaactaagatagctccccttttctagactagagttaggagaatagttaatgtttcagtatttaggactgattctgattttggatttaaaggaaacaaaggtggtgtgtgttttctatttttaatttttaaaagttttgtgtagagactggggtctttttatgttgtccaggctggtctcaaatgcctggcctgttttattttcttttgaatttgcagataagtattaggattattaaatctttttttttgtttgtttgttttttgttgagacagggtctccctctgttgcctagccaatggcatgatcatagctcactgcagcctcaaactcctgggcaatcaagtgattctcccatcagcctctcgggtagctgggactatagctgtgtaccaccttgccctgctaatttttaaatttttttgtaaagatggggtctcactttgttgcccaggctggtctcaaacacctggcctcaaatgaacctcttgcctcggcttctcaaagtgctgggattacagaggtgagccactgtgctcagctggattactaaatttttttttgagatggggtcttgctctgtcacccaggctggagtgcagtggcgtgatctcagctcactgcaacctccacctccctggttcaaaaaaattctcctgccttagtctcctgagtagctaggactacaggcacgcgtcaccacacccagctaattttgtatttttagtagagatggggtttcaccatgttgatcaggctggtcttgaactcctgacctcaggtgatctgcccacctcagcctcccaaagtgctgggattacaggcatgagccaccacgtccagcctggattactaaatctttacagatgtatcctgactttctctgccttttccctctgtatttgccccaaccagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtaaggttatggtacagttactcttgggtgagtgaattctggaaaggtgagaactggaagagcaaagtcttaaaagaggccaaccaaacttcaataggttgggggctaggaggagatgatcatatggagtgttaaaatggaggatttgtgagataagtttaattctctttcatatgaatttcttctcaggtgaatcaacggaatgtaccaggtattgacagtgcatacctggccatggatacagaggaaggtgtagaggttgtgtggaatgaggtacagttctctgaacgcaagaactacaagctgcaggaggtaggtgatgctgaaaaggtgaagcctggggaatgttggaacactgatgttagagaggaattggtgttgggaagctgcccgtgaggagagtatgttggggttagatcgtttctggggagggatagggaatggcttctcaggattattacagtgatttgtgactctgttattccactgtctcccttgctttcaggaaaaggttcgtgctgtgtttgataatctgattcaattggagcatcttaacattgttaagtttcacaaatattgggctgacattaaagagaacaaggccagggtaagaattttttccccatatttcctgaacttattgcaaagagactagctacatttattattgttccttttacactcagagattaaaacaaggtagttttgaaacagaactggaatcagctgcaatggcgataagagtagggcttcagttgtcacctatgccttttgtgtggctatagattgggcagaaaatgagtgaacttttgcttctttcttcccataactttcattgcttgttttcattgccctatttagtctaagtaagtaaagctaagaacaaaaggagagaaattttaacaaaccttcaaatttaaaatatgttaacaagggaagggatcatttctactataaggccttttagtaagtgctttgcctccccaggtcatttttatcacagaatacatgtcatctgggagtctgaagcaatttctgaagaagaccaaaaagaaccacaagacgatgaatgaaaaggtatagaaggagagcagacaaagtttgaggctggtttttgggggtggttttaaaaaggactctgttaataatgaagctgatcaggaagggacggaaggagctagtgggagagagttaagagagggaattactgctgacccttggatccaactttgttccaggcatggaagcgttggtgcacacaaatcctctctgccctaaggtaagtagtacctggttagtttcttacccatatttcctgatgtagttactccaaacagatttcagggcactactcttctgttctattctgcctctccccactttctttgaatcatatactgtcaagattagggcccctacgggtcttttaaagggtgcgtcctaatgccctaaccacgacacttatctcctacctctttctcctagtgcttatccagctatttaaatcatcaggcataatggagattcagagtgtggggattatctttatggtgaccagcaggagacctggcccttgctcctcttaacccttgggttccccctgcccttaatttcccagtggcccctctaacagcccagtgcccccacagctacctgcactcctgtgacccccccatcatccatgggaacctgacctgtgacaccatcttcatccagcacaacggactcatcaagattggctctggtgaggggagggagaggttctgggcaggggagcctcgggaatttgggaaccatgggggtaagatgaaaggaatgggggataacagagcaaaattctgaggtgtgggctggtgagaagagaaaggaccttgctaggagtaattaataggagaggccagttaattagtggagagggggtaggatatataatcttacacctttttgaagggaaaattggggttaatacagagatactgataagaggctgggaaagggcaagagataggtttgaggtttgatttgagtcctggggccagaccctgccagaggaggttccaggctgttcctgctgtgagtgctttcgtttgctgtgtattgtatgcagtgtacaacatttctgtgtgctgtgtctgtgtggtatttgtgtgtccatttgtctggggcttggctgctccatcgctcacaacttttctctgttttcctccctcccgcttacgggctgctctgttcccaacagtctttcataggatttttgctaatggtgagagctccctctgccccacttggggctctgtttgtgctccctctgctcccttggcggctgcccagtgcatgcagtcgtgggagcaaaccctcttcccctatcttccctgcctaattatgcctgcttagcttctgccctgccagccctccgcctgcttgccccttcataacctgcttgtttcctgtggattctgcctggctggccacttacctcctggattcatgttctccctcatcatcaggctagttcccagatcatactgtgctcccagattctctgtgacttgtagtcattgtttatgatctgagtgagtccaaattgggcctggtcctggttcctcgttcagctctgtggcagacagtgttgaggaataagggggtagaacaggagtctaaaatgttttggtggattaaaagtggaacagattcaagggtattagctcaattctgagctgttttgagtttcactcagcaaaggtgggtaagaaggaggctacctcctgagctgtatgttaatacttcttatccttatttatccaagttcctgaggtctccaattgtcccagattaggaagggctgcctgtgtttttatgttatttgcagggtggatgaaaaaactaaaaccaaatattttcatgtgagcagggattagaggtacctgggatttagggaaggtgaacgcagtacaagtgaaaatttttccttaaacttcattgcttctagaccagcctgaagcccctgtgtatctgttaatttagtctggtgcttttgttgctcctgatttagggacattagatgagaagcagtaggcctaagaaaggggaggtaggtggcatccatgtgtggtctgtagttcaggacaggaaagggaatatgtttgtgcctgttgagggtcatcagaaaggagacttcaggagagaatttggcttttggggcctctctctggagtgagactattcttcattgatgatggtcagattgtgggtgtctcccctactcccagtggctcctgacactatcaacaatcatgtgaagacttgtcgagaagagcagaagaatctacacttctttgcaccagagtatggaggtgagccttcctgctttctctgccctgtcctcatccccctgcttttgcaccttataacttgaggtacagaggcaatataactgaaacttctaggccttctctaccagcatacaaaatatttttcttttcttttttttttttcctaaggcattcctgccaaccctagcccccaatcctctgattaaccaaagccttctctgttttccctagaagtcactaatgtgacaacagcagtggacatctactcctttggcatgtgtgcactggaggtgaggggactggaggggaggggggaaaggggtcagatgagaagatggaattgggaatggagggaagacaagtaaggcgctggcttggagggagtgattgtgggagcactgaagttcttaggtgtctacttttttttttattcttcctcactgaagatggcagtgctggagattcagggcaatggagagtcctcatatgtgccacaggaagccatcagcagtgccatccagcttctagaagacccattacagagggtaaggatcttcaggatcactccctcctcaactgaccttcaaatgtcttctggtttttcttcctttgtacccactgggtatatgctcctaagagctagggaacataacagaaaggacacgaaaaatctataaacattttcttaggaggtgcctaccatgtttttgcatagaaacacacaggtaagggggttaagatggatgatgctggggttaaaagttgtgtgttggaagccgggcatggtggctcacgcctgtaatcccagcactttgggaggccgaggcgggcggatcacgaggtcaggggatcgagaccatcctggctaacatggtgaaaccctgtctctactaaaaatacaaaaaaaattagccaggcttggtggcgggagcctgtagtcccagctactcaggaggctgaggcaggagaatggcatgaacccgggaggcaaagcttgcagtgagctgagatcgcgccactgcactccagcctgggcgacacaggtagactccgtctcagaaaaaaagaaaaaaaaaaaagttgtgtgttggctgggtgcagtggctcacacctgtaatcccagcactttgagaggctgaggcgggtggatcacttgaggtcaggagtttgagaccagcctggccaacatggtgaaaccctgtctctactaaaaatacaaaaattagctgggcatggtggtgtgtgcctgtagtctcacctactcgggaggctgaggcaagcttgaacccgggaggcggagattgcagtgagctgagattgggccactgcactccagctggggcaagagagcgagactgtctcaaaaaaaaaaaaaaagtatgttaatttgaatgtgtctacatggaggtaaattaatttgatggttacttcaggccattgctgtatactctcagacagccatttttatatttttaagcacatcagtcaatttaaattaaaccagttgtttgggattttatatttatacagttttagttagggacggtggcctgaaataatgagctaagatttaaaagacataaggttatgaatcagttgatagactatagtaagcagagcctgggcaggaaggtccaaacaagaacagtttgtaactcattagataagtatagtagggaacaggagagaaaagaagactagtgggaagtcaggaggatagtgtggagtaagtttctacttcaacattgaggtggagtattcaagtgaaagattaggtatgtgaccttgttagccttcaaggttaaaagcaggaaagcaggttaattgtcatgggacatgcaggaggtagaaaaggaggcggtggtggaacatggtggctcatacttttaatcccagcacttttggaggctgaggtgggaggatcacttgagctcaggagttcgagactagcctgggcaacgtggtaaaaccctatctctatgaaaaaataaaaattatctgggtatggtggcacatgcctgtggtcccagctactctggaagctgaagtgggaggattgcttgagcccaggaggttgaggcagcagtgagctgtgattgtgccactgtactccagcctggttggcacagcaagaccctgtctcagaaaaaagaaagaaagaaaataaggcagaatcgttagaggaatcctgggaaattcggtgaattcagtgattgtgggcaaaggaaattgtgatactaggcttgtgaaataaaaaaatggtgaatattgatcacattgggtaagtttgggaagagagaagctaaatttggcaagatttagaaaagaagataggcagtgagttgactaataaagcagagaggtagaaactaaggaaaaagaaagtgtggggccgggcgcggtgtctcatgcctgtaataccggcactttgggaggctgaggcgggtggatcacgaggtcaggagattgagaccatcctggctaacatggtgaaaccgtctctactgaaaatacaaaaaattagccgggcatggtggtgggcacctgtagtcccagctactcgggaggctgaggcaggagaatggcgtgaacccggtaggcagaggttgcagtgagctgagattgcgccactgcactccagcctgggcgacagagcgagactccgtctcaaaaaaaaaaaaaaaaaaaattgtgaacattaaaaaagaaagcttgtggttggagagcagaaaaataattaaaaccagaaaggcagtggatggtatctttcatataatatcttacagtttttgaagccctttcaggtgcatttttcaatatattgttttctcagcaagtgctgagcacctactatgtacaaagccttgtgctaagtagaatgagagctataaagatgaacacactgggggcttgccagatgcctgctccagttccttgtttccttttctaggagttcattcaaaagtgcctgcagtctgagcctgctcgcagaccaacagccagagaacttctgttccacccagcattgtttgaagtgccctcgctcaaactccttgcggcccactgcattgtgggacaccaacgtgagtcgtcttggccctatggggaatagtcttccaatctggagccctgtaactatcactggcatgcttgttttcctctttatttccaaagggattctttttttttttttttttttttttttttttttttttgagacagagtctcactctctctcaggctggagtgcaatggcttgatctcagctcattgcaacctccagctcccaggctcaagcgattcttgtgccttagcctcccgaagagctgggattacaggcatgtgccaccatgcctgggtaatttttgtacttttagtagagatggggtttcgccatgttggccaggctggtcttgaactggcgtcaagtgatctgtccgcctcggcttcccaaagtgctgggattacaggcatgagccactgtgccaggcctccaaagggattctttacccctttgcctgcatgccttctttgacatttaatctgactatcccttcataatatcccactccatcatgccctccagacatgatcccagagaacgctctagaggagatcaccaaaaacatggatactagtgccgtactggctgaaatccctgcaggaccaggaagagaaccagttcagactttgtgagtaactgagagggtctgaaaggggcagattggtcacgaccactcttgaggctctgtaaactgtccattctctgggaatgcttgaatttgctattttgcttgtttctttccttccatctcctttctcttttctcgtccaggtactctcagtcaccagctctggaattagataaattccttgaagatgtcaggtgagagcagagtgagaagcaggctttcttgaggaagcaggcggggttgggtatcctaaggcgttcacagagcccatgtgacctgtcttcatctccctccaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtgggggctgtgtgggtgtggattgtctccatggttgtggtggaagggagagaggacatctcaaataaggctctatcctttagagaaaatgctccctagcagccatgccctatgggctcgaaagacgtctaggtattgggttttttatggacaggtctctagagtgaccctctcttccctccctaggtggtgctgatgcagtgcaacattgagtcggtggaggagggagtcaaacaccacgtaaggctcagggctagggttgcgcagggctagtagccagagggtagggaagaaaagtctcattttctgactgtcctattctccagctgacacttctgctgaagttggaggacaaactgaaccggcacctgagctgtgacctgatgccaagtgagtctctcctttccctcagaggatggagagtctatgagccttatcttttagggacatattcaggggtgggggaggtgacaaggcagtaacacattgactcacatagaatgactatcttagaccctaaagcagtgggtggatctgactgacagtttagccctagtggggctgtctgaagggccccaggtccctcagtcccgtactgtactcaccccctcctgtttctttgtcagatgagaatatccccgagttggcggctgagctggtgcagctgggcttcattagtgaggtgaggtttctgccttcatctgccctggctgcccccatgccttctcttctctcagcccccatcttactgagctcttctcccccaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaagcgtcgtgtgttcgcgcctttcccgccagggggagcgggcccggggcggaggcggggcccaggtgggagggggacccgggacggaggcggggcccaggttggggcggggccggcccaggtacagcggccctgcggctggcgcggcggacgggatgaggcgctgcagtctctgcgctttcggtaacttccgggccctggcgtctcgtctccttaccctggggctacccttgccccgtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctggtgagcgcggcaggcgacccgggcgggggccgggctcccggagagcccagcaggccaaaggctttgtgtcttccacagagcgtttccgtgggacttgtggccctcctggcgtccaggaaccttcttcgccctccactggtgagagggacttccctggagcttttaacgagtaggcttgagtcagggaaatgggggctgactgagcttggtctttcaatagattggaggagcctcagagaaactgggtgtctagtcactgggagagttagccaggcccaggctgctcaccctgatctcctgtccctgccagcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgtgagcacattctcttccttcttgtggtctacaaagccttggtcctgcccttttaatttcccctatttgctgcacttgccctactccctcctactccccatccttcttgcttttcaggatacagccttggctctctggatcccttctttgctcatgtctgcaggggaggctgctctatctggttactgctgtgtggctgcactcactctacgtggagttgggccctgcaggaaggacggacttcaggggcaggtaaggaaggcaaacaggaagggttcattccacagagactggctgtgttgaaaagatgctgaccggccgggtgcggaggctcacacctgtaatcccagcactttgggaggctgaggcaggcggatcacttgaggtcaggagtttgagaccagcttggacaacatggtgaaacctcgtctctactaaaaatacaaaaaattaggtggggtggtgggcgcctgtaatcccagctacttggaaggctgaggcaggagaatcgcttgaacccggaaggcggaggttgcagtgaaccgagatcacgccactgcactccagcctgggcaacagagtgaggctccgtcacaaaaaacaaaacaaaaaaaagatgctgacctatcattcagggcgagggtgtctaactctatcttcttctgcagctagaggaaatgacagagcttgaatctcctaaatgtaaaaggcaggaaaatgagcagctactggatcaaaatcaagaaatccgggcatcacagagaagttgggtttaggacaggtaatgggccttgaaggtggtggcccgggtaagagcggggacaaggaagtgctcttagaactgggtctaggtcttgccatgctgctttcccctctgacctgggttggttctcccctctgtccagcaggtgctgttccgagactcagtcctaaagggttttttttcccactaagcaaggggccctgacctcgggat

SEQ ID NO: 13171 - DNA, 7407 bp, Human
aagtgggggccatccatttcgggcagaggagacaaatgaaagccgaccccgctgggatcacgtaggttcgtggctgcagcaaaagttgggtttcacaaagttgaaaaacagccggtttctcaaacaattgtgatttggaaggtttcgctgggtttgcccagatgtttacgaataaataagaaatgcagttttaaaaaaaagtgtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggacacgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcggcgcactaaattgtgccgcgctcgcccccgccagaccatgtcctcctggggaaaaagtttccctagtccccccagcagcgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaaggtaaaggggggcggagcatttgcttttcaaaaagtctttttcttttgccttaagaaagaacccccaaaagtttgggtcttggaaggcaatggggaaagtggtgcagcgagatgattcttttctcctccggcatttctcccaagtttgaaggaatttggccccgtccttcccaccctttgagtttcaacagttgctggcggggattacatgtgaatctggaggccagggttttgaggggcgaagtttgcctggcagggcagcccgggggcttcggggggagggctgggattgggacaagttttgggcgatcctgttttacgtaacgtgctgctggatcccaggtttgctggtctgatcgggttcccagtctgcgccctaggtctgtccagcggcattacccacccgtggggttgggagtgggaggtccctcggggaagtgagtctcgggacaatgttttcctccactctttggggggagctggggatatgcgaggaagaaaggccaagttgtgattcaaaaagatgttgcagaacaagtttgcagtggggcttgagtccgccctagctccgttgggcttcttcccgcgatagccgatcgtgcagcaaactttggggtgaaagaggcattcaggttgacccgcttacctgtgttgccgaggcattgcggctcatcgattgcgggcggggttggggggggaggtggcgacaaaatgctggcttgaactcgagagtcccgcgagtaaggatttaatggggggctccttaaaacatgttgcttgtcagccagtgttgaaaaagcaagttttaaactcggaatgttccaggactgcggtttaaatgtacatagcaaaagtctatggatgttgttaaatttctttccaacctccccctcccaatttgaaagggtgaagctgctgggctactttttaattgctgaagtgttttgccttctcttaacacgtcgggtcatgttgctctgttttcccagcttgctgctcctgttggtgcagctgccaacgccccagggctgcagggttggggtgcagggacgccgaggagctgaagagtagcatttaaaaagtttgaatttttcagcttccttccctccctgcacattcccaaactccacttgccagcccggctgccagcgctccccaacatttcttccttcttttctcgactctcccgctctttgatctatttctttctttggcccccctcccccctcacgactttttaaatgaacctcattgttgggaaccagctctcgactgggttcctgtaatcctctcggtggggtggttgcagttacagattcccggtccccccctgctgatcctaagggaccaacattagaatttgcacaatgacacccacatgggctgggaactaactcctaggtccctgacctgcaccatttccaaatcttgggtacaatttgggcaggtgaccagggtcctattggaacagaaacctgccattggtggctctgcccccatccccaccacccccaatccgctattgactaggaggtgggtaggggggttggtgctttccttttcctttccatctgcagctttgcgttaaagattaaacactggagctcttatccaagcttgctcttgcagccaaaagactaattgcaaaggcatcttctcagtgaagggggcggggtgggctagggctgagtggaaatggtgagagagattattgtagaaaatatctcttccgggaacttagggcaaagagttttattttcaggaatcacatccctgtctcccccaacctcagaccaggcccccaatctcctccccacaagaaaaagcaaaggcagtctgaaaacctgttgccaaaggaagggaacacttctgaaggaggaagttgagagtcttaggccaggtcttgaaggagggggtatcaattaagcagagactgattggaaggggacctaacgtagcctatgatagactcctttctgaggtttacctgtttttgtcgcgggcggtggcgggggcggggtgcggtaatctagagaggtctgggttgtgtgagatattttgagttgaagaatctatttgactagtaaaaaagttgaactttaaagtggtagctttggggacagaggacatgggggttgcattgcaggagtcagcatggagcagggtgcttgtcacacagtttggatcttgtggtttcttacgcatggggccaaaataaacccaggtgaatggcctatgggagggagagagggaagggagcttgctagagccgaggtagagatgagttctttgagaaagagcgggcgtttgtgattgtgtagggggctgcccatagtggacatcctggtggatgtcctctgtccttaccatcctttctcttctctctccagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccacccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaacattgatggtggagctggttttacttggttttggtttgactttgccagtaaggttctccccttgtataccttgcaagtcctggggagggggaggcggagagagagggctgtggctgtgggtggcggcatct

SEQ ID NO: 13172 - DNA, 35725 bp, Human
acctgcctcggcctcccaaaatgctggttttacaggtgtgagccaccgcgcccagcggaagcaagaggtttttgcagtagcacaggaagccctgaggcaacctgtgccagtatcaacttcagaaaacatttagtaaagggggaaaaaaattgaatgtagtgatgggcaagaaatacaaaagtatcaacataatttcaatgaactgaacaagtatgacagtatctgtgactgtgaatccctgaccacgcccccacccattcctggagggcttgttaaaacataggttaccggtgccctacccctagagttactgattctgtaaattcgcgagtggggcccaagaatttgcacttctaacaagtatctggtgacccatagcaggtgctcaagaagcaagaagtttcttgctgctttttatttttatttttttgagatagggtctcactctgtcactcaggctgagatgcagtggtgtgatcatggctcactgaagcctcgacttcctgggctcaagagattctcccactttagcctcccaagtagctggggccataggcacatgccaccacatccagctatttttttttttttaaatttctggtagagtcagcgtctcactatgctgcccaggctggtctcaaactcctgggctcaggagatcctcctgccttggcctcccaaagtgttggaattacaggtgtgagtcaccatgtgcagccagtttcttcttgatgctgtatccaggtgatgctgatgctgctggtctgggaccacactttcagaaccactgccttacagtggttattttgctaaggcctcaaagacatcattgttaaaccagcagggggagacaatatacaacagagcctctaaaaataaaatgtcttagggtactaaaactcctttggagttatggtgttgccatggagacctctgaactgttttggagagcagtgtgtaaattgacatgaggtgaaataaatttcaggagtttatgtaaaaaattaatttggtagaaataatgtctagattcttgcatgccatggtgtcttggttaagaacttggaatgtggagtcagctctgccacttacaagctatgtggctctgggaaaattacttatgtctttgatcttttcttcgctttaaaaagtaacctgtggtatagaattggaggggtaaagttcttggaatgctgagattattaaattattattcgttattaaaactctagttacttagcacttacagctctttagcttagaaatagtctaaatacgttgctatatttgcttttttaataaccagcgctcccgttattcaggtaaagaattaaaaacatctaaaaggtaattgctttgtaaatcctaacctctttcattcaaaatacctaaggtagatggctctttataaacgtgcccggctcagagagctctcatctatattatatctccgaatccaaatttcactgatgcccagtctaagagtgtttcctgggctttgagctttgagatagaacgaagcaggtggatcctggctttgactaggcagggccagaccaggcccgacccagccagcccatccgtagagtcagcatcagccgggcgtgaagattggtgtcggctcctgcgttccgccaagttcaggaacctggcatgggccggccgcctcccgcgaagggacacacctgttggtcaccgcgctcttactggccagacccggatattggccttctggcgtcagcggcaggggcatgtccctggccggagagcacaggccagagtggggtgacgtcatcgaaggcacgtcccagccttgcagagcggtgggcggggcctgcgaagaaggtgtgccgggggctggttggaggcgcgggcggcggggccaatgtggcggtgacgtcacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcaggtgagaactggcacctggaaccgccgggcaggatcctccgccccctagaacctggagacagcggcggtagggtgcgggggaccgggaggcgaggagaggatggggagaaatggcgaggggaagagctggccggttcccgctactgggcaccgtgggagcatgtgggatatcctccgacagagaatggagagggagggagggaggggtggagggcaccctgtttgggatgagggtgtgtttctgcggcctccccagaaagaccgagaaaacggtggatgcagcttggggtaatggaggggagagaatgaggaagaggattccttggaggggctggaggaggcgaaactggtcagaatccccagtggagaatcgatggaggaggttaaaaggagcgaccgaggatttaagtcttctggatccattcactcagaatgagcattaactgggagggaaattggagctggcctctccagcgcgggaggtggggaggagctgttttgttctcttcaatgaaggaaacctgcagtcgggagcgctcagtcatctcgaagcccagaagcccagtctctggcccgagccagccccacacacgcctagctcctggatcctaacctggctcagcctctcccgtcttggcttgggcagctgatgtgattccaacaatggagttggaaggacagtcattgatggaagggctgatgctgtcacaggttttcagaggaacctgctgggaactaaatgtaccaaatgggtttttttccgacaccttctctacctctaattgtgtaatttgtgtgactgacagaaaagaaaaggagtggagcatggtcccgctgccataagagaagctggcttgatgaaaaggctctccagtttgggtaagtggttagatttttagatattagtgcaggactagtaatagaccacttcagagtcttttctctgacatccagggactacacagctttgtgtttgggaacagtctgccacatcccgcatcctcctttggattccgtctgcggcttaagatcaaggagtcatcagggaaagtcttcttgcaataaagagtgtgttggaaggcaaggaggtagagtgaggcaaggtctgaacagctgtcagggaatgcaagtgatgctaagaacactagctccagcttcaactgcacagtcaacctttccccttaaaattccattttcctaactccatcttgagatgcttatgatttatcagtctcgccagttttctgtcttcaaattatttcctctctagggttaatatctttattactggaagcagtaatataggtcttataggctcactgatcttatatagaactaataggcttagatctatattttccgtgttctttttttttttctttttttgagatggagtcttattccatcacccaggctggagtgcagtgatgcaatattggctcattgcaacctccaccttctgggttcaagcaattctcctcccaagtagctggaattacaggtgcgtgccaccacacctggctaattttgtatttttagtagacacggggtttcaccatgttggtcaggctggtcttgaactcctgacctcaggtgatccgcccacctcagcttcccaaagtgctgagattataggtgtgagccactgtgcccagctataaatgccatttccatagtaagggagaacccttctcttagtaacagcaccaaatttgaatacctttataagcagggtgcggtggctcatgcctgtaatcccagcactttgggaggccaaggtgggtggatcacctgaggtcaggagttcgagaccagcctgaccaatatggcgaaatcccttctctactaaaaatacaaaaattagtcaggcatagtggcatgcacctgtagtcccagctactcaggagcctgagacagaagaattgcttgaacctgggaggcaaaggttgcagtgattgtgccactgcactccagcctgggtgacagaatgagactccatctcaaataaataaataaatacctttatggcaggaaggttcttctttatatccaatctaaatgtttctagactctgttcaaggccatttgctctgttcatgtttggatcattcacatatcttttctggtgacataagtgcaaaatgtgaggcagcacggagattatggagataataacacataatctaagttaactccccactgttgctctgaactcttctctgctggtcataagtccattccaagtgaagtcatctccttccaaaagccagaggaataatgaagtcactgaaacagccttgagttgaggtgtccttcatatacctccacctacatatggatatggtgacatggattcaatattcgaaccttgtttattaaataattgcagtttcttctttactaaggcctctcttagtcattttaataactctccaagttcaccactgaagattaaagacaaactgctaagatttagtcttcttttaatgtgtggcaagttaactaatgggaggaagtttttattcccgcccataaatgagcatactgtctcttaaaatagcttgtacacactgcctttttaaaagaatcattttacactgaagacgacaatctctggttatcactgtttttaaatcctggagacatctctgcagtccatctgaactcggccaagcattgctcaaattgctctaccgtctgtaggttctgccttaagagattcctgacaagaagcggtttcagcctcttctggaggagacctctataacaatcagctgaggctgctgaatgagggggaagggcacatttgtagcagcttctcttactcatgctttgtagacttcctttcctgtcacagctcttggtatttttccactccaacccaggggaagccattctcctgtaaatattactccctctttaaactccaacctaaagtgatggtgaggcttcagtttatatggccttccctttgactttttttctcaaatatatttaattgtacaattatatccttactgtgtagctgactggtagctcagtatcaccagcagtctgaaatagaatctcatagcctattaaataaaactgtggctctcagcagatttctagcatgtggttttggctaatctcctggaatatattggagaaaagtaccaagagacatttcagttgctctgttcctaaacagtaccaaaataacttgagtgttttgaacactttcaaataaacagcatggatcaaatttcaaaggagagactcatggaaaggtaactttcacaatccctttgttccttgcctttgctctgatgtcacaggctgccggtgttaccatagcatgagttaaatttcctgttttctctcgaatgaatgtatttgacttagtgtctgggcttgttttatttccttgggcttagtaaggacactcaacagtactctcaggtaacctttttttttttttttttttttttttttgagacggagtctcgctctgtcaccaggctggagtacagtgatgcgatcttggctcactgcaacctccgcctcccgggttcaagcaattctcctgcctcaacctccaaagtagctgggattacaggtgcctgccactgcgcctgactaatttttgtatttttagtagagatggggtttcaccatgttggccaggctgatctcgaactcctgacctcaggtgatctgcccatctaggcctcccaaagtgctgggattacaagagtgagccactgctcccagccaccttttatttttctttgagagagggtctcactctgtcactcaggctggagtgcagtggcatagtcacagcctactgcaatctcaacctcctggactcaagcgatcctcccactttagcctcttgagtagctgggactacagacacatgccagtatgcctggataatttttttttcttttgtagagccggggtctcactatgttgcccaggctggtcccgaactcctgggcttaagagggcctaagagaaatgaaaaggcattgctctggcaaggctgaggagcagtatatctgcactcgattttggttagctctgagaaccatggtaatttgtgaattctagccacctgttaccatgtgagaaggagtgggccttgtactcttttctccagtttttcaagaaaagccagaaatttgcactttaatgggaaatctgtgttgttttaaaatactgtatagtgacaccattgaaaatggtggcataggacctccaaaaaaggaatgagaactgtattagtctgttcttgtacttttgtaaagacatacctgagactgggtaatttaaaaagaaaagaggtttaattgactcatggttctgcaggacatacaggcttctgcttctggggaggccccaggagaattataatcatggcggaaggtgaaggggaagcaagcacgtcttatatggcaggagcaggaggaagacagcgaagagggaggtgatacacacttttaaccggatctcatgagaactctatcatgagacagcactagggagatggtgctgaaccattaggaacaacccccatgatccaatcacctcccaccaggccagacctccaacattggggattaaaattcaacatgagatttggatgggaacacagagccaaaccatatcaagaacattggcaaaaatgatcagaatcagctttttcagaactctggaaattaaccaaaggcttgcagcaatctggggagcatttattcaagaaaaacattgaatctcagtaagaacattaagaattgtggcattttaacttgccctgttcccatgctgccttttcccagatcagctgtagcctggacaaccgatagcctgcaatcacagtgaaaccaggaggctggcagttactgcaaaagggagaacagaggtgatactcctcatagaccatccccagaaaattgtcatttgactggtctgatggtttcctaaaattgtccattcacaaggctgtctttatttgaccaacacaagtcagtaaggaaagaatagtcttcagtaaatggtgctgggataactggatatccacattaaaaaaaaaaaaatccctatctcacaccatatatgaaaattaactcaaaatggaccaaagtcctaaatgtaatgctgaaaccatataactgttagagaacataggactggatttttgcgaccttgggttaggtattggtttcttagctatcccatcaaaatcataagtgacaaaaattaaacttgacttagctaaattaaatacatctatgtttcaaagagcactattaagaaagtgggggccaggcacggtggctcacgcctgtaatcccagcactttgggaggctgaggcaggcggatcacctgaggtcaggagttcgagaccagcctcaacatggagaaaccccatctctactaaaaatacaaaaaaaaattagccgggcatggtggtgcatgcctgtaatcccaactactcgggaggctgaggcaggagaattgcttgaacctgggaggcggaggttgtgatgagccgagattgtgccattgcagtccagcctgggcaacgagagcaaaactccatctcaaaaaaaaaaaaaaaaaaaagaaactggaaagacttcatcaatgtaatgaaaaaccaaaaaaaaaaaagagaaaaggtaaaaagactgcccatagaattggcaaaatatttgcaaatcatatacctgataagattctagtgttcggcaaacataaataaaataacaaccgtaaaaagacaaccaaatttaaaaattagcaatagatttaattagccacttctccaaagaagttatacaaatgggcagtaaacacattagtcattacggaaatgcaaatttaaaactacaatggccgggtgtggcggcttacacctgtaatcccagtactttgggaggctgaggcgggcagatcatttcaggtcaggagttcaaaccagcctgatcaacatggtgaaactccgtctctactaaaaaatacaaaaattagccggatgtggtggcacactcctgtagtcccagctactcaggaggctgaggtgggagaatcacttgaacctaggaggtggaggttgcagtgagcagagattgtaccactgcactccagcctgggcaacagagtgagactctgtctcaggggaaaaaaaaaaccacaaaactacaatgaaataccatttcacacccactaggatggctatgataaaaaagatagacaataccaagtattggtgagggtgtaaaaagattcgacctgtcatacactactggtgtgaatgtaaaactgcagccactttggaaaacagtttggcagatcctcaaagttaaatgtatagttactgtgtcctcaagcaaatccattcctatgtatatacctaacagaattcaaaacatatattcacacaaacttttttttttagacagtctcgctctttcacccaggctggagtgcagtggtgcaatctcggcctcagccttctgagtacctgggaccacaggcaagcaccaccatgcccagctaacttttgtatggttaattttgccatgttggccaggttggtctcgaactcctagcctcaagtgatccacctgcctcagcctcccaaagtgctaggattataggcatgagccattgcacctggccacacacaaacttatatacaaatattcatagcattattcataatggtcaacatgtggaaactcaaatgtacattaattgaataggggaggaaaatttgacatatccatataatggagtattattcagtcataaatggaatgaagtactaatttatgctacaacatggatgaacctagaaaacatgctaagtcaaagaaggcagacacagaaggccacatgttatatgattccatttatatgaactgtctagaacaggcaaagccataaagacagaaaggagattagtggttcccaggagctgggaatgactgctaaagggcatgggtttctttccgaagggtgatgggactgttgtagaattaggtagtgtcgatggctgcacaacttcttgaatatattagaaagcactgaattataaattctaaaaggatgaattttatggtatgtgaattatatctcaataattaaaaaactaggcaattgtgatcagtaaggagatatatatatatatatatatatatatctgaaacttctgaattgctaatattgatctgttttgtgacttgggtagtaattatagggtgtttacaactatctgttatacttatgtaagttttatgtgtttatattttatgaaatatacagtaaagacacattacaaatcatgtctgttgatagatatccatcttttcaagctctagttttgggcattgaaaagagatgaaactggcatctctgaggtgccttttgaacagtgtcatatctttgggacaagaattggttgctaggttgactcaacagcaaatatcagtgatgtttctgaagagactgtaaggctgtatgatccaccaaaccttctgcctctgccattcacactcttctattaaacacttagcaaggcatagtggctcatgcctgtcagcccagcacttagggaggccaaggtgggaagattgcttgaggccaggagtttaagatcagcctggacaatgtagcaagaccccatctctacattttttaagagtctatttccacagcaaggaagaaatgaaagtacagcacctgtcccatttcccacaaaaaagtctttgcctagggtctgcatatgtgactggaagctaaattattggaatgagcttgtttgtttaaggttattaaagttctgggttctttgacttctaaagtcactctgatatgtatttggaagagtaaatgtctagcaaattggctttatatttcctttagagatctagcaaagaccaaacctgctttggacctcatctgtgccacagtgcccttgggggatgggccacctgtagcagaggaataggagctgaggcatgagctgataagtggcatcactttagggccctctccaatctcacctggaatgtcactaatagtgacctatttctttgggttcaagcttttcattttctgggcctcctttatattgcagattcttttattttatagataggtctcactatgttgcccaggctggagtgtgggggctattcacagacataatcatagtacactactgcctcaaacttctgggctcaagcaagcctcctgcctcagccttcaggatagctgggattacagatgtgcaccactgtgctcggctgcagattccttttaggaggtgaatacataatcagtaatttgctaatgccttagtaaaaacttagtgatgtgcctgcatagagggaaatctataatagacactattgggatttggcaaatttcaatgtagccgtatatttcccatttatgacagcaaagattttaacttaatacctcttatttaacttaatacctcttatcaaaagttttttgatacttaacatttaccatcttctagacactgtgctaggcatttgctattatcccattttcataatttgtaaaaagcaaattttgaccacctcagccattaggatggctactatcaaaacagaaaataagaagtgttgatgaagatgtggagaaattgaaactcttttacactgttggtaggaacataaaatggagctgctatggaaaacggtatggcaactcctctaaaaattaaaaatagaattactatatgatttagcaattccacttctgggtatgtacccaaaaggactgaaagcaggatcttgaagtagttgcgtacccatgttcacagcagtattaacaatagccaaaaggtggaagcaacccaagtgtccattgatggatgaatggacaaccaaaatgtggtacatacatataatggactatcattcattcttcaaaaagcagggctgggtggggtggctcatgcctgtaatcccagcactttgggaggctgaagcaggaggattgcttgagtccaggagtttgagaccagcctgggcaacttagcgagtcccaatctccacagtggggggaaaaaaattagccaggtgtggtggtgcatgcacatagtcctagctattcaggaggctgaggcaggagtattgcttgagcccaggaggttgaggctgcagtgagctatgatcataccactgcattccagtctggcagcatggacaacagaataaagcctcatctgtttaagaaacaaaacaaagaaacctgacatatgctgcaatatgggtgaactttgaggacattatgctaagtgaaataagccagtgacaaaaggacaaatacagcatgattccatttatatgaagtttttagagaagtccaatttataaaaacaaagtggaatatcagttactaggacttggtgggagaaggaaatggggagttaattattgcttaatgggtacagagtttgttttgcaagatgagttctggagatggatgatggtagtgatggtagtgtccaatcaacttctcagtcttctcggctcttactacaaaggaagaaactgtactacccagatttcttttttaatagaaatgttatttatagttaataacgaatgcactgcataaaaactttatagtttcattattgtgaaatgtgttcaagatcctacagtaaaagtgaaacattcccaaggacttgcgttagtgaagactacacagaaaacctttctaaggatttgtgtggatccgatagatacttggcaaatttttgagttgtacattcttacagaaagtccacttaaaagtgatcatttgtaagacaaaaatataaatagtttcaaaaatctttaaaaaatcatcctaaatgcatgatcttcacctccagcttctgaagagccctcgttctcagtgtcttccttcccacatttcccaccacagccatctcatgatcctcaagctcatgcttttccagttcgggtagggactctctcaactttctccctgtcatcccccacatcagttgtattgacaaagaacgtcagaggatgaaggtctagttctgtattaggtttgtgcaaaagtaattgcggtttttgctgttgaaatgggtatcatagataacagtgcccatggtaagggttcaaaattaacagtggaaagaaaaatagttcatttcactctcaagtaaacaatttggaaagtagtccagagctggtttagtggttctcttcctttaagttcagacctagattcttatctggtgctactggcaaggcctctgcctaatggtgccagatggttgtagcctcagcagcaggatggaagaatgaacaaagaaaggggcaaaggcagttctcttcccttcccaagaagttgctgcgggacacggttctgcttatcctattgtccagaactagttcatgtgaccacatccagttacaagcgaggttagtaaatatagtttttatgtttatttatttatttattttagatggagtctcgctctgtcgcccaggctggagtgcagtggcgcgatcttggctcactgcaacctccgcctcccaggttcaagcaattctctgcctcagcctccatagtagctgggattacaggcagctgccactgtgcccagctaattttttgtatttttagtagagatggagtttcaccatcttggccaggctggtctggtctggaactcctgaccttgtgatccacctgccttggcctcccaaagtgctgggattacaggtgtgagccaccgtgccccgcccatgtagcatgtagaatgtagtcttttctaagaggttaatgctcccagctaaaaaccttttctttccggaaaaagggaagaatgaatgttgggtaactaacactcggcagtgccctctccctatgctctagaccccctcccctctgacagtccctgctccagcattatccctcccctcacctcgtgtcatggctcttctctcctaacctgtcctttcggtaattaattgtgcaacccttaccctccaccatcccccttgaccttaggtagccctctagctgttgtccagttattttgtttttcttcagagccaacttcctggctttctcattgccctttcacatttcagcttgttataatgtggcttcgtaggccatcattgcaataaacctagtattgctgcagtatctgacctactttctaatacaatgaacagatgaacagtgtaacattcaccttatttacaccactaatctttctttattgaaaccaacactattctctcttggcttcaactcttcaaattcctctagtaaatcctttctttctttctttttttttttttttttttgagacagggtctcactctgtcatccaggctggagtacagtggtacgatctcagctcactacagcctccacctcccaggttcaaacgatcctcctactttagcctcccaagtagctggaactacagggacatgccaccacaccagttaacttatttatttttagatacagggtctcactatgttgcccaggctggtgtttaactcctggcctcatgtgatcctcctgccttggccttccaaagtgttgggattacaggtgtgagccactgcatctggcctacatcctctttttctagctacttcttacatgtcagtgttctcaggattctgtccttgattctcctgctttatcctgtcttggttggcagtctgcttccatggctttactgtcacctgtatgctgatgccacccaaagctctatttttttaaaaattttttgagacagggtcttgctctgtcacccaggccagagtgcagtggtgtaatcttggctcactacaacctctacctcatgggctcaagtgattcttccacctcagtgtcccaagtagcttggaccacaggcttgtgccaccatgcctagctaattttgtttatttttttctttttgttttagagatgaggtctcactatgctgccccaggttggtctcaaactcctagactcaagcaattttcccacctcagcctctcaaagtgttgggattacaggcatgagccactatgcccagcaaaaactttatctctaatacttatttttcctcctaactgcaaacctgtatacagatgtcttccatgtatcttatctttttaactttttgttatggaagtattcaaacataatgaaagtagagatggtaacataactgacttgatatatccataagccagcatcatcaccaatacgtggcaatgttttttacaccacctccagaccattttggagtaaatcagacatcttgtttcatggactggacagcacctttgatcacacacagtgtatcctaactttattatggccacccagaggggaaacagacttctcatatcttaacacaggaggtggttttgcaaattggagcaaggtgcccaccatttgtacccaggggagttaggctcttacccttctgtaggaactgagaggttgaggcactatctccctaaatgtttgcatctccaggagatggcttcctgggtccttgaagaagcattcctgggttgtgagacttgtgagaggcctatttagtcattatgaagattcacataaatttgaaaagcacacaaatattatgaaatagaaggaaggaagggaggtctctttctttattttcaacagggagaattaagcctcttaatttttttttttttttttttttttttttttgaggcagagtctcgctctatcgctcaggctggagtgcagtggcgtgatctcggctcactgcaagctccgcctcccgggttcacaccattctcctgcctcagcctcctgagtagctgggactacaggcgcccgccaccacgcccggctaatttttcgtatttttagtagagacagtgtttcaccatgttagccaggatggtctcgatctcctgacctcgtgatccgcccgcctcggcctccgaaagtgctgggattacaggcgtgagccactgcgcccggccaagcctcttaatttttaattagtattgttcacattgcctgattaagttacactttttaggtttattttgttgttttttgtttttaagtttgagttgaattcaaatgaggtccacattgctttatactttaagacctttgtaggttctctctttttttttcttctttgcagtttatttatagaagaatctaggtcatttgtctgcagaatttctctgtttagatccctgtggtgtcctatgacatattctatggcgatgtatacttcatcagaggtgacatttcagcgatactgtcagccattgacgattgcctagaattatccattaacttgtctccatgtgctttcaacaggatagtctctaacacatcaatgtcaacatatcccaaactgaccttatcatcttctccctcccttcccatgcccctctattgctggacactctgttccctctcatttatttctttagcttcctgtggcactctgcttctccagaccattttctacactgctgtctgagcactagatccaaaatgcagatttgatttgtcttcctggcttagaaaccacggttgttccccaccacatttaggacctgggccttgccccggctcctgccgcatctctttgcagtcctctaggtgcactctgggttcggaggaattgtgcattgttctatagggctgaaggcattctctcctcctcagtaagcatttcttcctcctctcttattcctggctaatgtcttccagactcagatattgctgcttctgagaagttctcctgacccttctcttcctgggtctctgttcccgccacaccctttgtacatctggttcatagcaattagcactgggctgggctgccactttctctgcctgacatcctaccagcctgtgacctccttgaagtctgcaccataccttatttctgcattcctaggatttagtggagtgctaggcacagagtatacttttgttgaaggaaaaaaggaagcaaagcatcttagctttctcctgtaacttcattcacatcacaacccttgatgagttttcccaaaccagtattttgtttctctgaaaatgatctgctacttagaagccacctggtctcccagatttttaaaacgtatgactcaaaggataactgccatatatcaaactttaactcttgcaagctaaatgttagtaggggctgggtgcgatggctcacacctgtaaccccagcactttgggaggccaaggtggatggatcacttaagcccaggagttcaagaccagcctgggtagcatggcaaaactctatctctaccaaaaaaaaaaaaaaaaaaaatttagctaggtgtggcttctgtagtcccagctacttgggaggctgaggtaggaagatggcttgagcctgggagatggaggctgcagtgagctgagatcacaccactgcactccatcttgggcaacagaaccagaccgtgtctccaaaaaaaaaaaaaaaagctagtaggtagtaatgatgatgagttattgctcccttttttgaaatacatttttaaaccaggacatcagtagataatgactgctttcttcaagtaaggctgacctctaattactttagacagatggtgcattgttattttaatatccaaaatagtacaattcagaggcagaacctaagagattacagtggttggcttaaataatttaacctttgaataaatttacttatccctctctattaatgaccaaaccttggaggaaggagatgttacaagggctggttggagctgtctcctctgaaactctgaagaaatgaactgggacagatatctcaagacacatggttctttggctgggcgcacggtggctcacgcctgtaatccagcactttgggaggctgaagagggtggatcgcctgaggccaggggtttgagaccagcctcggtaaaatggcgaaatcttgtctctacaaaaaaatataaattagccaggtatggtggcgcatgcctgtagtcccagctactctggaggctgatatgtgagaattgcttgagcctgagaggttgaggctgcagtgagccatgtttgtgccactgcactccagcctgagtgacagagtaagaccatctcaaaaaaaagagaaaaggttcttaaggttgtacagtctttgggagttaaatgcaccaaataaaattcagatctctgcattttattggtagtaaccaaatgagtttacctaaataacagtctcttcaaaggttattacccaaattacattttatggataagagaaattctacttacttcaaatggcctgaattaaccctggcatcccccattccccaccctccagtttagacttctagtaacattgcaactttatttttaataagctagtatttcaagtacaagcttgttctaagaattagcagtcacatccctttaaaattccaggaattcggccgggcacggcggctcacacctgtattcctagcactttgggaggccaaggtgggtggatcacctgaggtcaggagttccagaccagtctggccaacatggtgaaacctgtctctactgaaaatgcaaaaattagccgggcgtggtggcaggcacctgtaataccagctactcgggaagctgaggcaggagaattgcttgatccggtgggtggaggttgcagtgagccaagatcacgccacttcactccagcgtgggtgaaagagcaaaacttcatctaaaaaaaattttttttaaattttaaattaatttccaagaattccttttgcatggggctaaatctgccatgtaaaatatttgagtctgtaactttaaaagccattagtaccctctcagcaccaagtgaggatgcagagtctttgtttttctcctgatttcactgacttgttattcctgacaagtcacaaacatttctatcctattcatatttagaaacaatttggaaaaactgcacactaagaggcccctagcttttctccatgtctgttattctaccaatgggttgcctgtggctcagcagaccctcctgtgtgtcagcccactttgaaacccatctctcttgacttgctatgagccctggtagcaacaggggtcacagcagtagggagaatgggatagtcttatgctgtcaaaaaaaaaaacccaaaaaacaaaaaaacaaaaccttactcatcatgtaatcatatatgagctctaaccaaagagtaattcagttgctgttaaacagttggagctattcagccttgctgaaattcttcctctgcaatgtgtggatagtgacaccagcagaggatgtgagaatgagcacgtatctgtagagcgtgtagcacagtgtggtgtgtagaggcagacaattattatccatttcctgtctctggcttctttcagggatttactcactagccctgaaatagaagtgctgttcacagatattgctaaggtcaggtaaggctgttttgatttcttccttaccgcctggttgcatcattctgttgatgcacttgtgttcttgttccactctgatagagcctggagaggtttatcaaggccaaaggtaacatctgggcctgaaagatcagagtagtactcggtgtattttattaccagcactcaggagagaagcaacaaggctgtgccagtgtataaacagcaagtgaaaaatgagaccctttcacattgttccaaatctatttgacatgagaacttccttgaaatttcaggctcctcttgtcctacaatgtcctcttagaagaaagagcagcaatgaaacactaggtctcatctgacctggacttacagatgaattgacctgatgcacagttagagaaagggaaagttcccacaggcataacagccagacacatattccttacacattacaatgtctgcatttttcatcattaccctaagcttcttgaaaaattagtgagaccgtttcttatgacctatgaaccagaagaacttgccacagcactctgataaagaaatagctttaaggctgggcatggtggctcacacctgtaatcctagcgctttgggaggctgaagtgggaggatcacttgaggtcaggagttcgagaccagcctgaccaacatggcgaaacctcgtctctactaaaactacaaaaattagctgggcatggtagtgcatgcctgtaatcccagctacttggggaggctgaggcagcagagccccttgaaccagggaggtggaggttgcagtgagccgagatcatgccattgcactccagcctgagcgacagagcaagactctgtctcaaaaaaaaaaaaaaaaaaaaagaactttaatattactcagttcatcctgctgttacaaaaagttaacttcccatcagcctcctcactcctcttaaaaaaaaactgtagcagatgggttacaattcatgttttctacaacaacatactagaaccagggttcagataatcctagaactagggttctgttctaccagtcctttgggtattggtagtacccaatactattggcacagtgggcattagaggagaaagctcttaagaggtgacatcaggctggcatcatgtatttgttgattcagttatgtaattaactagaatagtttaacataaatttgtaatcctagagcaactttcatattttgttcttaaaggttatggcagtagaataaaaaagtactcacggtggcatacattgctagctgtccaccaaaatccattcgcattctgttctggacataagctagacctgcatttgctggccagtgccaaaagtgagcaggagtaatgtgccactttcaggccagagtcttgaaaagaggaggtgtgctttctcaatgctttcttcctctcccgctgccttgaacctggggagacctagacttagccacacagatggcaaagtcctaggcatgagagccacaagccaggtctctgaattactgcataaaggaaagcctcctgctgacctggaatatctaccctggatgctaaacaaacaagaaataaacttgtttgagccatattttgggctcaaacatattttgctatgacagttaatttactctaataaccttacttaaaataatattatgtattatgcctataactagcccaggcatggtggctcacatctgtaatcctagcactttagaaggccatgatgggagcattacttgagcccaggagttggagaccagcctggaaaacacagtgagaccctgtctctacaaataatccaaaaaaaaagaaaaaaaatgattaaagtctgaaaggatacagtagtaaaacccgggcagtaggtttgggacctctgatatacacgttatccaattttacagagaatttcaaaacaaaacagtgcaagtacaaactatttgtcataggagttcttctttgacgcccctgatcctcagtgaacttcccctgactcctttaggactcattgtcccaagtccttacctggcactgaaactgtgcaaattatagagttgagttcgttcttcctgaatattctagggggaaaaaagaaaaaacagagttgggagcaggaaggtaggccactcaggcagggcctctcaaggtataaatccctttagaggaggctggcccttagctttgtggatgcagaaacacaaggttgctgagtgcatagctcatcaggctttcagacccagactcatgctaaccatgctggatcaaccaaaatgcccgtgcataattatgttaagcagtagtccttccagtgtccactgtctagaagcttttgcccatattaaggcatgtgggaaaccaactgaatagccagaatgctgtttggtgagatggcatcggagtaaatggagttggacaatgtggacagaatccactacccaggttgggaattaatctgatgaacccccgacagaagttagtaacccttctagcacctgtaatgagagcagagtggtggcctgaattagcgactgaaatccttctatgaaattcagtctctcttcctgggaacgttactgtaagattgccaaattctctttaggttcctttttaggctttgtgcagcttttttctaatacaagtgagtactgttttctgtcacgtttatctgagtctacatcctggtttgcatgattggacttgggtagtcccaaagttctgtgacttatccactggattgagcactttaatttccctgtatttcttcttggtcctatgaggattgaatgaaagtgcttggcaaatagttctgaaacgttagttaatattatttaactccagtttggggccttttatatgactattccttagagtgcaattaccaaaatataaatttataaagattataaatcttttataattgtacacctaatattataaaacaccaggcataccctggtgtcttacatctagtaagaacctaatggttgatgtgatttaaggagagtgctgagataaacatggaggtgaaagtagaaacatccaggaattgtccattcaagatctgtacagtacactgggtgcagtggctcatgcctgtaatcccagcactttgggaggccgaggcaggtggatcacttgcggtcaggagttcgagaccagcctagccaacatggcgaaaccctgtctctactaaaaatacaaaaacaaattcaccagacgtggtggcgcacacctgtaatcccagctacttgggaggctgaggtaggagaattgcttgaatccaggaagtggaggttgcagtgagccgagattgtgccactgcactccagcctgcatgatagcgcaagaccctgtctcaaaaaaaaaaaaaaaaaaaaaaaaagtctgtgcagtccaggattgtgttgtcaacagacagaggaaagacttgatattgacttgaaggttaattaaagctttcattctcttaagtctaaagtatcctctccatattttgagatttggtgaagtccataatgactttactcaaacctttttgtctttttttaaaaaaataaaagatttttatagatgttttatttggttcacatttttatcttggttcacaatgtctttggcctgttgtcatatttttctcctcctacccctgctctgctacctttttatctggttgtctggatcttctccaggttggggccttttatatgactatttcttaaagtgtaatgaccaaaagataaatacagaattcttgctgtaggtgtatctcacctttaagaataggtctgggtgacacaagggctggggaggaaaaaaagaataggacaaagttttctgtcttgtttccaatatctcttgcggtggcaattccttggttggcctcatggctttttgttatggtcactgctcctcaaatttttatatttcttcagaattttggctttggattgagtttgggttcaagaggtagagctcaaaattataatttaaattcatgatgagtccatgctgctcttaatccgaacctttaacacaaatctctgcaaatattaagatacgccacgtcttatcttgttactgcccctttcccaccaataccaggaccctaagaatataatctatgtcaatgttctgttctctgatagttcagatccctttttgatacagtcagattatttagtcctcatcctaaatgtagcatccaacttaggtggggaaatattcaaagctgtgagaatatagcactagttcttaaagtgttggactcatgaggaattccttaggagacaaactgcatagtaaaggatagaggttgagcgtccctaatccagaaatccaaaatcggaaatgttccaaaatctgaaactttttgagcaccaatatgacattacaagttaccctgaacacactgtattaatggtatgtcatattttctgcttttaagtacttatgtgtgaaaaagtaagaaaataactgcctatcagtagcatataaattcagagtcaggaagatggtgatgccaaacaatcatattgtccacatgggtggctgtgatagtgacacctttgttttctgatggtttaatgcacacaaactttgtttcatgcacaagatgatttaaaatattatataaaattaccttcaggctatgtgtataaagtgtgtatgaaacacaagttttgtgtttagacttgagttccatccctaagatatctcaatatatatataatgcaaatattccaaaatctgaaaaaaataaaaaatctaaaacacttctggtcccaagcctttggataatgggtactcaacctgtacaaactttggagccagatggcctagatttggatcctgattctggcacttaatagctgtgtaacttgggcggttacttctctttgcttcagtttcctcatccaccaaataggcacattttagttgcctcacacaactgttttgagtcttaaataagaatttatgttaagcagctagaacaatgcctgggatcttgtaaataatcaataaatattagatatttcttttaggatgtttcagattggctatttataaaagtttataatatgtgaatttcttggccaggcaggtggctcatgcccataatcccagcactttgggaggatgaggcgggaggatcagttgaggtcagaagtttgagaccagctggggcaacatagcaagaccccatttctacaaaaagaaagtttaaaaaaatgagactctctttgtgtatttttttgctaaattaatagtacttaatttcctttaaaattgttggttcttaattttctttaagattgttggttctttttgatattttatttctactctatcactccaggatatctgaggtctaatggttaaccatttttttattgttgggttaagtcaatcgatatctcttagtttcagtttccaacatctgcaaaactgttcataataggatcgagataatcttcccacaatcatttgacattttaaattttactgtgacaaaatgattatgatgtgtactttgtcacgtattatcattgtggcccaggctagttaagagttggagatagcacagaaaattcatcttgtcatccctcatttgcttccaggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacaggtaagctgggagccaggcgtggtgaggggatggattacatggtgcttggggctcataacttagcttctttatctgtttcttcatctggagaaaaataccctacagaatttttagggtagatattaaaatgaacagcaagcatttaaatgtctaagatcctgagctgctcaaggggcactgtggttttctttgtatgacacattgcacagtaagaatatgtacattcagacacagcaagttcagaggtatactaggcaaggttcctaggcactgtgttaacatgcttgtctcctggaaagctttcttgagacttatcttatgactttggagaattagaaagatccattgataggctgaatgtgcaagtttttgttagcatttctgctaatagacctgttagaaatcccctttggcatgttactacattttctttttttttttttttttttttttttttgagatagggtctggctctgttgcccaggctggagtacagtggcatgatctcagctcactgcaacctctgcctcctaggctcaagccatcttcctacctcagcctcccaagtagctgggactacaggtgcatgccaccatgcctggctcatttttgtatttcttgtagagacagggtttggccatgttgcccagactggtctcgaactcctgagctcaagcgatccttctgccaaggcctcccaaagtgctgggattacaggcatgagccactgtgcccagctgtggatacattttctgcctccacaatatggaccctagtgactcatgcaatcagtcctttgatcctgtctcctcctgaatcagcatgtactttattgagcactgttctgatattttctcagcagtgctagagattgcaggaaatttgtgatatattaaggcctagatgaaataaatatacatggaataaacaaaaatattgaattctacagaatttcaaaggaggaagagatcagtctggactaaaatagatttcacaagggaatgtgatttgaaataagcaatgaaggtcttcagtaggaagaaggcactgaagtactaggagtattgagcactccatacatattctcagttaattctgctaacaatgctaggtggtagatatggttttatcatttactgctggaagcatgtagggacagatatataagaacttatccaaggtgggcacagtggtgcatgcctgcaggcccagctactcaggaggccaaggtgggaggattgcttgagcccaggagtttgaggccagtctgggcaacacagtgagatcaggtctcttaaaaataaataaataagaaagaaaatataacttatccaaggactagaaccaggaaatagagctgggattcaaatccagtgtgactcttctggtgattattttccctgaggtgctgagaaagcttttcagatcactgaacagaaatgaaatctttgttacatctggagaagcaggtagattcctccttgggagtaaaaaaaaaaaaaaaatactcaggttgaagaaaacggtcacacccaggttccctactgagatgactaggccattcaattaaatcaaccagagggcaagtctcctgcctcctttctcagtgtagtctctggaaatttattaagtctgtctgctgttctgagttctggtcaagtctcactgtttggggaccactgatcaatgtgattaccacagatcttgttttcttttcctgtggctatctatattgcagccatgttactgcttaccagctcaatgttaaagcttaggcaatctgaaattctagagaggaagagataagtgcataacttgaatagctgttgaacattttcaagaagagccatttttaggtcactgctccttttatgtagtttaacatatattactactttaatcatcaaagcaactctgatttacacaggccaagtattattattatccctatctcacagaaaaggaaactgaaatctaaagaaattagatggtttgtcttcagtcacacagctcttccaggactaaaactctagtattctgacttaatccactgccttttcactagaccatgctattcctcaaaagacccaaccagtgtgggacatggcacctagaatagctgtctcatgctatattgaccaagaaggatggttgcagtcctaagatgcttaagctgcatttcccatctatgtcaaattccttggttactgggaagctttccaacatttatttcatcaggtgtattcttagaattgagacagaacagttggctaatgtaagcagagcccaaggacaaggaaaggcaaaaacagaaatacactttaagatcttatatttgaggctgggcatagtggctcacgcctgtaatcctagcactttgggaggctgagccaggtggatcacttgaggtcgagttcaagaccagcctggccaacatgttgaaaccccatctctactaaaaatacaaaaaattagccaggcatggtggcatgtgcctgtaatcccaattactcgggaggctgaggcaggaaaatagcttgaacccaggaggcggacgttgtagtgagctgagattgcgccactgcactccagcctgggaaacagagcgagactccgtcttaaaaaaaaaaaaaaaaaattaaatgccatgctaatatatataaggtaacatgcaatacatctttttactcagtggtctaaattaggtctttaatggtttaccctgttaatgtctccaagagcttttcttacagattttggtgagtcgttacctatagactgtaccatttacctagatttcttttttttttttcatttttggagacagggtgtcactattttgcccaggctggtcttgaacccctgggctcatgtgatcctctcacctcagtcctctgagtagccaggattacaggtgtacaccatcttgtctggcttaacttgatttcattcattgaacaaatatttgaggttcttttctgagcagggctaatggataaaattatacggatttggggacaggacagcagtgacatctgtcacactgcagggtagcaagtcaccagcttcgaatctctagggctttatcactcaagattaatttttgagaactacaactacaggtcttgcctcacccaaacccagtctccatctaggccctggctttgcactgtggagagagtataagttgttttggctgaggacgtttgttatcggtcatgtttgccaagcagagggccttcaagattatacttgttctttgcagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtcagtgggccaaaacgaaaagaaaggtgaatggcttgcagggttttgctggagttggtctagttcagttaagattttggtgaagggtgggttgagtgtggattaccactccttcatttgttcatcactattatggaccaggcagtctgccagatgctaggggtataaagactagacatagtctctgttctttgtaagaaagcaaggagggggtagtaacaatagcgactgatatacccacagcctgaggacttcttggttagaggctcccaggccatactctcagacacactgatctagaagacaaataaaaccatgacctctgggtaatattttcctgagcagttcagaatatatgggagtccatgttaggcacagactagaatctgtatatccctcccctcagtgagggaccaagtcaaaccaggacactacaaagattattcattgggcggaagtcctgtgtcggctgttggcaacttgagatggcaaccaggttatgcttcaagaaccaatctgtaaacaagtcagtaatgtgcaatgggatagaaaagggctaatcagcagtattcctgctactaggtaagttaatgagaaaccaagacaaccttagagattttattcgtcttgagaaagcaatactgtgttcctcagctgcccttctgaaacatttccaccttgtgtcacttctccttcccagatcaagtgtgtcctgtgttgctctaaacttaccctgtgggtggcagaagaaagcagattgcatacccacggacgcacatgataatgatcttggtgagaacaagaattcttgattaatcctgtccatttctccctttcataggtaccacaactcccaggattttcctggatcaaaccttgtatctcttctgcaagtattgtgtatattggtctgagagacgtggaccctcctgaacagtaagttgatgcatttggctgaagtttagggcctgtcctagccaattatgttctatttgaaaggctgatgcttaacttggtctattgcaggtcactacaacaaacccaccctctcccccaaatacatatttgttaaaaatgctctttaaactaaggactcctccctttatatctcatcacagttttattttaaagaactatgatatccagtatttttccatgagagatattgatcgacttggtatccagaaggtcatggaacgaacatttgatctgctgattggcaagtaagtaactataactgatgtcagggcaaacccccaatgggcaacacacttttagcctgtttcttgaggacagcagctttacttttaaaatacaaagcaaaaacatacacataattttaaatagttcagaaaggcaaaatttgaaacacaggtcatattcttcctctggggtttttgggaggaggtttcctctaaatcattgcctagatcttctgtctcatgaatttttctttatctccatctttaatgcttatcttctgagatgacaagcatttattgtttcaactgtcccattcttcccagcctcacgattgtttcatctgagttttatattaagcaaatcttggcagtgtagaaagatggcagatgaatactaatcaaatggtaattttaagagcattttcccaataccaagtctttacttctgggtgattaatgtcagaattgttatctggtagtatgtcatttcataagctgttaagaaacttagttgttagcttcagcctttggacactggggctataatgaagttagaaatggaagatgttaaaactgcagacctaaaattagagttcacttcagctgctgttacgttcagagaataagagcaaccataacttacatcaagccaatttaaattagactaatttaaattgtctaattaaattgtctctagatgagagcccaatctcatctagaagtgaagaaatctctctattgacagttattagtataagaggttctaatacccagtgtaaggcagaaatatacattggagttagtctgtctgaggtatgcagaacaaatggcagtatcatgaagtggtatgtaggaagttaatattgccaatctcagtaacttccaagaataggaagcctggaaatgtattaacagctttattaacaaagtactaggactaatagcaacaaaatcaaggagttgcaaccataagaaggatgagtgtccaaggacaaccagttaagtattattttaagtattattttatcctcttcctttttaggagacaaagaccaatccatttgagttttgatattgatgcatttgaccctacactggctccagccacaggaactcctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatggccatgctaataaaaaggatatagtcctttagagtcatgcttggacatggctcttaccaaattacactaaggtaataatgagtaaaaaattgtatatttaaacaattaaatacaagaataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagactggctacttttccaaaattcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtctaattctcagatctgcaatcttagatgttgccagtggtccttaggttattggccagagaacttgggggttcaattctctgctttgcttcctaaaaacaccacttagagcaggggttaataacctctagcacttatatatggcatggcttgtctctttgttcctatgctacaatattttactccaaaagacactcatggggctaggcacagtggttcatacctataatcccagtactctgggaggccaaggcaagaggattacttgaccccaggggttcaagaccagcgtgggcaacatagtgtgaccccgtttctacaaaaaataattagccaggtgtcccaactacttgggaggttgaggctgcagtgagccatgattgtgccactgcactgttataatgctgtcaactagatacataaagcagtttgcttaatttatagggtggcaatagtctggaaacataagtcatgtatatatttctaatagtgcaaactttgatgaccacttctgggatatgctaaaggtgcaggtttagtcagtggaaatcagagacaaatcaggaacacaggtccatgtgcaggaaatgatggaaatgctacagtaatacacctgttggttgcagtttggcactgtacactcaactatgcattgctaataagggaagatgctgaacggacatgatggcattcagcacatcatgtactatagtgtaatatcaataaaccattaggtacatttgcctgtgtttccagactttatggccaccctaaatattcttagatacttgtattcctgaatactagcttgttcagatcacccttcatccagaataaccaactaaaaagttaaattctatagagaagtgaggcatttagaggggtgagcatagtagcaggtctggataggttcttctggtttaagcttcccttccacttgctccaggccaaaggaacactaccgagaactttgacacaagttctcaaaccttaacagaaggtaactgaagtccagataaaataattaacatatggctgaattttctcttgatcaagtacaagacactgggtcagtctgctgggagacaaaaagatgttgttagatgtggaacctgcctccagagctcaggcctgcaggggtgagaatgaagtttgcagtaataactacatttcagggcatatggtgtggtgctctaacagatacagataacacattagagttcaaaagtgggaatgcagtttggctagtgcaagtggcagatttcctctgccttcatacttgattcatttccaggcaggcatctggaaggttcctagtcatactggaggtggcatacattttgccaacaagcaggatgaaaacctcccccacccaacaccaagccttttccttttccagaacgcctgacaattatgcctgttatgttagttgaacagggatggtttatttcattatcttaaaaggtttcttttaatctactatagcacaacagtgttttaacttaaattcatggccaagaggatgaggtgcaaggggcttcctaaaaataggtattttctactataaaatggactcttgtttttactttggcttgttctccctgtcccagtgggatgaccctcactgagagtagcagcaagggaacctgaggttttgtcacactttgttcttccagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaatgttgttcaaatagtagttacttcctttaaaaatagcttttctagaaagaagggttagctagaaaaagtaatcaaatagacatccagctcaggatgggtcctgccctaggataagtaactagaagcctgggtaatacctttcaatcccttgtaaacttcttccctctgccctatttttccctttgctctcctatcaacccaaatgggtatgttataaaggtagtataggagcttaaaaattttcctatctgttgtttacataaagaatccaacctctggttctcatgttcactctaggtttctccctagtccacaaggaatttatcactgtaggaaaatcccacccctcctgctagttccatgagtgggttgtagttttgtttcatgctaggccacctgtgcccaaggtcacgtacaataccctcttacccccaacttcaacctcagtggcagtatttctgccctggatttgttgctgttagcactcgaggattttgttttttatttttggtaaagactactgtattggtggcagttagtacaattcaaatattgtcttcaaagaaggacttatttattctctatggactaggagtccatacagagctgaatgaaactgaatcaagtcactgctgtgatgactgaagtcaatcccatttcttgggaaatgaaaccacagccagctgatgcatggcatatgctgtttcactaactgagaaccatggtggctctatacaggaggtcatcagctctaccaccctttagatgcactggaattccattcttctcctgaaacagcttgtgttttctggacctttattttcaaaatgcctgcatgaagcaatgctcatggtcctctgggcaacctgacagtgccagcagattctgcagcatcttgactcagttactgcccaagaaccctgacaactccacaagggttttatttttaaaagtctacttcttccctacaatatagaacttccagaaaaggagctgactcccatgaagggcaagcagagccaaaagcaagtactatgcaagtgaaaactactttctaatcaagattttacaaatatatttcttttttttttgagacggagtctcgctttgtcccccaggctagagtgcagtggtgccatctcggctcactgcaacctccaccccccaggttcaagcaattctgtctcagcctcctgagtagctgggattacagtgcccgccactacgcctggctaatttttttgtatttttagtagagacgggtttcaccatttgagccagactggtcttgaactcctgaccttgtgatctgcccgcttcagcctcccaaggtgctgggattacaggcatgagccaccgcatggggctgagattatataaatatatttcaaggaataggaagctgttattcccatgtgttgccttctctaaagaacatcagctgtgattaaatgtcctttcagtggagaaatttttcactgctccaagtcaaagcagtatatacttttaacaaatgattttatcctgagttatttaattatccaagaccatattccttagcgtctttattctggtctgctgggtggtactgagtatacagggactatgcgtcaactgctgaggtgctttatgaggacctttgtaagtcactattttaagctttttggttgaaagccactgagttaagagaaatttcatgactttaataaaacttactttctggacattgaacggagaatcttccgacttttgctcaagttttcacttgtgtttaccagctgagaagagaaaatagtgattatttccctctttaaaaagtatactctgtacaattgaatatccctagattaacagtaggcattaagggatatatgttgaaaaattccaagaaatcaagccaatttaaatgatggcctttgagtgtaagtagaagaacctggaaaggacaagatattttagtactcatcaagtaggcttaagaat

SEQ ID NO: 13173 - DNA, 360470 bp, Human
tgcacccaaggatgagaaccattacttgactattagctctttgaaatctgagtcagtgttcctcttatttttaacttttaacacttaatacatggtaggtacttcataaatgtttacttagtcaacagatgaattatgttataaggaagtattatctgaggcaaaacaggagcattcttcagtataaagggaccatttttactatgtttattagcatcttaaaatttgaaaagtttgaataccctcttaatgttaatactgaaagttggtatttgatatagataaacattttggtgttgagatattttgttgatgcaacttggatttcatatcactttttatcaagatttgatataaatggattgtgatcagaggtgagaaaactgtggcacaggcatttcactaccgtaatggaagtacttaaaggaatgttacaaagagatctaaggtgttctaggatacatcagtcggaaaacaaagatggttaatctacacattgctgagttgtggtatcaaccgtggttttgttttttgtttattgttttcttgagacagagtctcattctgtcacccaggctggagtgcagtggcgcgatctcagctcactgcaacctctgcctcccaggttcaagtgattctcttgcctcaatctcctgagtagctgggactacaagcgcgctccaccatgcttggccaatttttgtacttttagtagagatggagttttgccatgttggccaggctgttctcaagctcctgaccttacgtgatccacccgcctcggcctcccaaagtgctgggattacaagcatgagccactcacccagctggtttttttatataccagaaagaatagagagctatttataagagtgagtatttaagcttttctgctttttaaaatgaagcacagacaattgaagttttaacttcggtttatgaaaccactttataagcacctgtattataataatcattgatttttgaggggctttcctcagaacaaaattataactatatctgggatcaaagttctttagatgggctctcagttatctacaatttatgtttttaaaaatagtttgttgccattaattaatcattgcacagaaaagttcccttcatttggagctctgagctctgcatttctgtgataccagaataaaacacaaactgaaaaaaaagggaaaaaatcattttttaggtcttggatttattctaaataatcatcctacattttgtgtcactgatgaatttgagaattgtggggaccgtattgtacatctcggtatcagcctgctatttgtatttcacaacagttatcggcaattaaatgatgaaattctatttttaaattttgactctgaattataaaaacgtaatgaaacaatgtaataccaatgcaagtatatgattataatttaatgagcacttaattgccctttttagcaaatagctaaaatgtagaatgggttgatagaattagcaagaataagaaaagtcagcagatggagatcctagtttcactttgttataaactaggtgtgtaattttgtaaattatttaagcacattgtacttcagttgtctctttagaaaataaagaggcaaatctgctaaagacccttctagctccaaaattttatgacatgtaattctaatctctataactgtcatagtagtgcattttgaatggctgaaaagaacttcagataagccattaattataaactctttatttacggttttcttatgttttatttactttcaagaatttgatacttgcatcctcattttctataattaataaaataagtactcaaaatttcagtgccttttgatcaagagtgaaactgttccatgaattgtgcttagaaattttcttactgactgttgaaaagaatctgtgtttcctcgttgaatacaaagtgtcctaggactgggatgttttgagcaagcaggcaaatttttctgcacatgactatactattgttttctttcaggaaaccctgatagattggtgtgatgaaaaggaacttaatttgatattaacaactggaggaacaggatttgcaccacgagatgtcactccagaggtgagatagtacatgccttttcatattcaaggattaaactaatcatggtttttttaatcctttttactatatttatattatttttataactttgctaggcataacaaatgacttgtagttctaataatgtgaaaattttgctgtggatgaattgtgaaaaatgtttcctgactttttttctttgggcttaaactagaagtgatagaatatgaggaagattaaactggtccagaggtaatctgtcattttcttgatgtcagcctaatttcaggcacatttccaaaggaagtgatagcagaattctgatggttagcatggcatctggtctgatgtgctttgtcaatacaattcttttcttgaggtacccttttcatttgtctaaaattacagtaagatgactgcaatagaatatactgattttacagtacttttgttgaaaagggatatattttccacaattctaaatgtgaacagcatttaaatgcagaatttaatgagcccaaaagtagaattaatatctaggcttaagaccacaggaagcatcttcaactattttatatataggaagaaaaattagggaaagaatgaagaataagcactattaactaatatggggggggatgtattttttctttaaggaagccataaaccacagatgtcacctcagagctatacataaaattacatcaccacttgtgacattgtttcctttacctacccaaccccccaaaagtgtttcttggatcagtttcaacttaatatttactatgtctttctatttcaaatcagtacactattgtatctactaccttattaacattccacaaggtacttttgctctgcatctattaaataattactggccttcttataatagtacaatggttttcaaacgttagcctgcatcagaatcaatcagaggacttattaaaacacaaattgcttgaccccccacccctagagtttctgatttagtaaagctgcaatgggtcttgagaatctgtatttctaacaaggccccaggtgatgcagatgttgtcgttgttgttggaccatagaccatattttcactatatgaaaatgcaattttaagaattattttttttctattcctctatataaaaaccgtggtacataaacttttgatattattataattagggttttaaataaaatagttttggcttttaaagcaatcaaaatcgagtcgtattgagaggttaacttcaactgcataaagtcatccttacacaatttatttagcttctggcttctatagttagtggttctttggcaaagttttacatttcttttatgctatgactgactgaaaaagtacaattgggaaggaagccatctcctgcagaggtgtgcttgtgttttgtttctttgtaagaacattgactacttatgttaagatatggatttttggagtttgggtgctgtcttaagtgttttagtaaatcactttgcgtttatgtatgcctattttttgtgtgatggtttgatattttcatattttttcataacagaaaaatagaaaaaatttcaccagaaaattaattcataaccaaataacagtattatttttaattccttggataattgatcgtggggaaataatttacatcacaaaatgttttgtatcctactgggctttcagttaatacaaaatgctaggctgaaaattcaaacctttgaattctggctctgctacttatcaacaaggtgaccatagacggagtgcttttactcacacttctgatgctaaatgtgggtttttttactcgaaccagccagttcttcaactctccagatatcaaatgtccttctttttatttcaattaaattctgacactacctaccaggaattagtactagactctgcagatttaagggctgtgtccacaagattgccttcacgtcacatgccagtggcaagtaccagatccccaggctagtcaaaattctgtcctacttgactacaaagtcagttggttcccaaaccgcgtcccccaccccactctgcattttcagattcactaatttgctagaataggtccaaaacctcctggaaacactttacttatgcttaccagtttactataaaggatacaatttaggaatagccaaatgcaggagatgcacagggcaaggtataggggcaaggaggttccatcccctctcagtatttagcgcccctccggcaccttgatgtgttcatcactctggaagctctctgaatcccattgttccaagatattttatggagctcagtctccaacctcacccctcagtgagtggaactgaaaattccaatgctcataataacttagtctttccaatgaccagaccagccccatcctgaggctatctaggcacccaccctaagtcgtctcattagcataaactcaggtgtgatctgaagaggtttgggcctggcatggtggctcacacctgtaatcccagcactttgagaggcccaggcgggtggatcagttgaggcaaggagttcaagacaagcctggccaacaaagtgagaccatgtctttactaaaaatacaaagaattagctgggcatggtggcacacgcctgtaatcccagctacttgggtagctgaggcatgagaatcacttgaacctgagagtagaggtttcggcgagcagagatcacaacattgcactccagcctgggtgacagagggagaccctgtctcaaaaaaaaaaaggcggggtgaggggggtgcagaggtttgttaggaataacaaaaggcactctgtactgctatcactcaggaaattcccaagggttttatgagttctataataagtcaggaaccaagaagaaagaccaaatgtatttttatcttataccttaatagactagtcatttaaccactctgtgccttagttttctataaagcgagggaaataaaagcacctatttaccaaggtggctgtgaccgttcagtgagaactattcctggtattttatgtaagagttaatttataagagttaattttttttatttgttgctatgtaacttatgtaactaccaaatggacacatttgatagtttttcttttttgcatgtaataccagatagacaactatagccttttacttgttttgaagtatgtccatgaagtctttagaatcttgttaaattatttcttaattttggtagggtaagcttcatatttgatctcttccatctctatattatataaatcagaaatcttgaatttctgctattctagtatctaggttttgtttcttttcttttttggcactactagttgacaagtgtctgtttccatggcattgtatatttcattattcagaaattgagcagtattttattcttaaagtttttcagttatttgaaaactattgaggtgctcttatattcatatatacctatagcagctacatagttaaaattatattagaggtttcttaaatggatttaaaatatacataaatatgtcttctctaatacctgtttttgaaaagaagcaatttacctgattgtgaataacttgatctttaataggttcacttcatattttatatgtatatataaatacatatgatatgaatatctatggcaaaagtttgtagcagtcgtgggctattaaataatactaataaaataaataataaataagcaaacataaaatcaatataggcccactaaaaagtaattctactaatttcccttttactttacatcgtagagtagttgcagttcttataatatctaacgtataatattgatgtgtcagaaaggaatttagaaatataatcctcgctgaattatatactgatttgtctgttttgatagttgtatctaaagagaagaagctgtttctagacacatttacctatattatatacatcaggattgccaatatttttaaatgaggtcagaagttattggtagaaagcacaaatactaatttgataaaagtaaaacaatgtaaaacttctcccttaaaatcctaataatgctttatagtcgatgattgtcagtaattagcttaatctgtaaagcacaaagcaaaattgtttgtggatgtgtgtgttgtaagaaaaaaaatgaaggatgaaaatgatgaataggatgaatgaaaaaaaacaatccaaagattttgtcaatgggtatgagctctagataaaatgaaaaatttaatcaacagatttctctccaggtctattaaaaatgagaatagaatatcaagtatagtaaagtttatcttctttattatatattttataggaatagggctatcagaattgattttcctaaattatgaatttgtttatatttttaggccctgcatcatagaatatggttcatctgatacttgcatgccttctagccttctccctgcctctaaatatgagatgctatcaaaacttacatatgaaagcatgataattctcactcatcaactttttagaattttgtcttgataataaaaactggtttttaataatagattgcttgcctttttttttttttttttttttttgagacagagtctcactctgtaacctaggctggagtgcagtggcatgatctcagctcactgcaacctccaccttccacgttcaagcaattcctgtgcctcagcctcctgagtagctggaattacaggcgtgcaccaccaagcccagctaatttttatatttttagtagagacagggtttcgccacattggccaggatggtctcaaactgctgacctcaagtgatctgcctgcttcggcctcccaaagtgctgagattacaggcatgaaccactgtgcctggccagatttcatttttttctggtccgataaaggttggataattcattggcactagtgaaatattagtaattataaagttccacagattatgaaactcatttctatacaaagtattttccctttatgtcccattattacttcaaagcaatgtatgtccaaaaaaggtattattacataaaggatctgtgtttgataatatagtaaattagaaaatgttaaactgttaaatatttaaaagacacaaaataactttcagtacttttagagcactaagctgtattgaattaagggttgtatgctaatatattattttgatcataagtaaaatagttgagtaaaagcctagcatacctgtatgtctcatccacttggtcatttgtgaagcttttgtttttaatcctcaatatgtgttcagtgccatgcttggtactgaagttaaaaaatgagtgagactttcacaggggtaagcaatgtagcccacaagccaaatccagcctgtcaccttttttttgcatgtccagggagctaagaatatattttacatttttaaatggctgaaaaaatcaaaaggagagtaatatttgtgaggtgaaaattatttggaatttgaattttagggtctataaatgaagttttattggaacaaagctacacttatttatgtattgtctatggctaaaacagcagagttcagaagttgtaaacaagaccgcatagcctataaagcctgacgtatttatcatctgatgctttgcaaaaaaagtttgtccacccatggccttttggatgacaacaagtcatctttactcacatttttttattttctcacttttacctttggttctttagtaatccgaataatgttaggtttccttccttatatttttaattttagatggagcaaagaaaaaatgcttttttgccatattgaagtgtattgcctcattgtttcaatagacaatatagcctaataaaaataaaatatcccttattctaaataatatatagaattctgcactttaaaaattaatacaatgaatttgttgtacattaagtaaaatctcactgttaaaaataattttaaactgagaaaaagtaatttgaaactgacattcttaggaatgcctcataacaaaagtatgctgatataattgatgattatactcaaacaaaagaagaaatagcaaaaataccaggaaactgtaaatttgacataaggaatatttatttaaaagagttcttataactgtttcattatggaagtgaagaggcatcagacaaaatgacctctttcaagagggaaaatactacaaaatggtaccaaagaaacctgacttaggaaaagactctgaattttagaaggtatattctgtttatagactacttttaggttgctttggggcagattaatatctaagcttttctacaaatttttttcacttaggttattagatttttttcatgaaaatgtcagttttctagtacaaattaaagaaagttacaaaaattgttttataatcaatttgttgaaatatatgtatttcataattttaagtgtgtgtttactataagacaggtattattttatgtagtcattagtcatttttctttcttatattgtaatgcttcaaaaataagaacactgtataagccctgggaagaagaaaaaattgacctaagttactaacaacatgttaatgattttcagtttgttactcttgtgaaagagagtgagaatttacatttaataactcacctaaaagttaatattggccattttcacaatcagaaaacactctcctacattttaacagaagcatagcaaaaaataccatatttaatcatttgtttttgatagaaaatttgattttgttttgagtaaaataaaatacctgttatacatggtaaggctaaaattagtcatattgaactaggattttgactatcttaaaattgttctatgcaaataggataatttaacaatattaaattgcttacaaagcagaatactagaaacccttatacctgaagtatttaaaactaaatttaataaaatgttccatccctctacagtcagatttgatggttatatttgatggcattttaaggagctcatcctaattttatgaaatagttcccatgtcatatctttgtctaaacacgttggcatgcaatatggtatagtggaaaaagcttacactatagagtcagattcctaaatttaaatattagtgctactacttactaactatgaaacttaaggcaagttgacctgttcaaatctgttttctcatctgctaaattagctaatttttctcatctgctaaattagctgatgcctacctacatctcaaaattgttgattctaataataaaaatagtcaataataacaactaacacttacatatagcaattactgtgtgcaaataactcttttaagcatatgttaactcatttattcttcaaaacaaccatatgaggccaggtgtggtggctcatgcctgtaatcccagccctttgggaggccgaggtgggtggatcacttgaggtcaggattttgagaccagcctggccaacatggtgaaacccatgtctactaaaatacaaaaaaattagccaggcatgttgttgcatggctgtggtcccagctactcaggaggccgaatcacgagaatcacttgaacccaggaggcggaagttgcagtgagcaaagatggggccactgcattccaacctgggtgacagagtgagaccctgttttaaaaaataaataaataagatatgtataaggaaggtactatttattgttatctctgccttaaagatggagaaactgtgacacagattgattcattgacttgcccaagacttttcaagtagtaaatggcaataaatgcatgtaaaaggatctaacataatgcctgtaatctttgtagatgctcagtatttgttctttttcttcctcatttaattaacagtactacctgttatctctaattagatatggtagctccaaatacttttgctactaaccattgtgcttctgatagctattgttaactacaaacataattggtggatatgtcttaaaaataaggacttgtcttgaaacagccagatatgtgaaaaaataactttttagtaatagcccactttatatctgggttttataattatttttgtattgtccactgaaagcagaatttttttttttgtatcataggcacacttaagacctttctgtttggtaagaacagcattcattttctttgttcaatgtaacaaatatttatgaagcaccttggactttatcaaacctaaagctaaagtacatatactcctaaaatagtcatatgacaattcaagacagtttaaacctggtaccagaaatatttagccaattcaggcaaaaagatttattcaaagagaaagattaaaagagagcttgagtaatgagtgaaatttttataaaattcaggctaaaattgaatgggatttaggttttgaaaaaggaagaccttaaaggtaggagtaaagaagaaggaaaatatatgagcaaggcacagagaaatacaaacataaaatctttctggctaaaacagagaattcactttacgtagaaggatggatacactagacctacattattttatttctttcagactggctagagaggtaccaaatacagaaatgagagatttactgtattagtctgttctcacatcgctaataaagacgtacacaagtctgggtaatttgtaaaagaaagaggcttaattgactcacagttcagcagggtgtggtaggccttaggaaacttacaatcatggtggaagttgaagcaaacacatccttcttcacatggcggcagcaagtagaagtacagagcaacagggggaaaagccccttataaaaacatcagatctcaggagaactcactatcatgagaaccatgagaaaagcatgagggtaactgccccatgattaaattattagtacctcccaccaagtccctcccattacacatagagattatgggaattacaattcaagaccagatttgggtgggacacagccaaaccatatcactgccgttattcagagattccttggaaacgagaattcatgagtctcctatcagccagtatagacagtaaaatcatgctttcaggactttcttagactcttttttgaatcagcatttattcgaatgcacatgaatacattcctcagtaggactaactttattctctttggaggttgtttttatgccctggttaaaaaaaaaaaaaaagttctgatgtaatctgcaaacctagtaactatccatttatttacttattaaatttaaactgctgagaggcacacaattccaattttgttgatttgttgtctggaaaccttttcagtcaatatttcccttagaatcaagaatcaagacaatcggaatatgtaatcatagatttgtcagtgctatatcttaattagcttagcatttgtataaaattacaaactttataatagtggagaaatcatagtatctcagagtttgaagagaacaaagaccttcatgttcaaagccctagcatgcccttttcatcattccagcctgaacatttcaaccatcacttcttctatcgaagagttcattgtttagacaactctacttgtttgaaagtctaaatatatcaaactgaaatctgtcaccttataatttctacccacttgtcctaattttgctcttggctgtgctcaaaagaaggttaattcctcctctgcatgacatttctgatatttgaaaagaaatgttatgtttctccttaagtccacttacttatggattatttttgcatttaatttttctaccaggcacagacttacccaaaacatacatcctctattttttatgcatgaaaaaagaaaagctccatagtaaaatggtgccagtataaaaattacaggtacaaaattagaccatttagataaataattagagcaataactgactttgcatttaagactgttaagttttgaaatatgtcccatcaatacctaatttattgagagtttttaatatgaaagttgttgaattttctcaaaggccttttctgcatgtattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagggtattggtctaaaattctcttttatggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtagtgatatcccctttttcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgtgagggtgtcaattttggatctttcctgctttctcttgtgggcatttagtgctataaatttccctctacacactgctttgaatattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccgtgtctgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacagagagccaaatcgtgagtgaactcccattcacaattgcttcaaacagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacaataaccaaaacagcgtggtactggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccgtatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagcactaatatccagaatctacaatgaactcaaacaaatttacaagaaaaaaacaaacaaccccatcaaaaagagggcgaaggacatgaacagacacttctcaaaagaagacatttatgcagccagaaaacacatgaaaaaatgctcaccgtcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattacggcattattcacaatagcaaagacttggaaccaacccaaatgtccaacaatgatagactggattaagaaaatgtggcatatgtacaccatggaatactatgcagccataaaaaatgatgagttcatgtcctttgtagggacatggatgaaattgggaaccatcattctcagtaaactatcgcaagaacaaaaaaccaaacaccgcatgttctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataaaaataaataaataaataaaaataaataaataaataaataaataaataaataaataaataaaaagactgttaagttgaaagggtcctattccacacagtagcactaaagagggaagagtacattgttccttgaggtcagaatttttgcaattttgagaataaggcaaaaacaaaaatttcctatatgaagaacccacaaataaaaattatatattcaatttcctttaaatatatatcctaattgtatacctactctatgtcagaatatgtgctcagcttttatggggccctatggatacgagagatcatatgttaaataaacatacaagcaagtgtagatgcaagtgatggtaagttctgtttctaattacagttctaactagaaaaatagtgttgcccatataaccttttatggagtagcataacatactgcttaattctgctctgtaatggggcataaaattaataataataaaaataacatagtggttaagagcacagactatttgggtttgaatcttagatccacctgttattagtgtgcaaccccatgcaatttacttaactttaaaaacctgttttcttatgtgtaaaatgatagtaagagtacttgcctcatagggtacttacgttatgtaaataatataagcaaggcactaaaaacaatatttccttgctatataaatctttgctattgttatctacaatatgtttagaaagagctttagctttaaaaataagtagatgatggtggaataaatattataagaattattctctgaaagaaaaatcaaacaagatagaacttaaagtacacaatagtatagttgcagaaaaggaaaaagaaatatcaaagaagacatgttaaatccttgttttagcttgaatttatcagtgatgatatcttgaaatcacctttccagttcacccttccaaatctactcttgtaaaatgaaaagaggctagcataccagaatactttggttttgcaaaatatgtgctaagaaattaacaacaaaatataaataaatattttgcagatatattagtaaaatgctaaaagtatatttatctagagacatagtctaaggaatgaagatttcaggatattcctttctttactactgtctggaatcaggaatatggatttctctctctgtgtattaggtatccatctatgaaatggacttactgttgcctttcacataaaatgtaataagatgacaacaaatgagtactttatatctgtcaagtactatgaacttctcagaataatatcactgaattagaagggcagaatatttgtaactttgttgttactgcctgccataaaaggcatctgatagggattcagaaagtagattgaggcaacaaagtaaacaatttgaataattctaataattttaccagtattattttcttatattgaaacttggaactgctactaaaatatgaaggacaaatgtccactggaggtagtaaccattttagatatttattaatggcacatagatgagaattagcagaaaggatccaagttccttcaaaagatgctgagaagaaagaagcagtaaacctctcttgtatgtacagtttgaaaatgatggttgtcagtttcactgaatgaacgagaccgaaggccaaaggcaacaatgtggaagaagcagtccatcatgctggaaggactaattgatatacaaagaaataaattatacttctctatgaagaatgaagataacattatagccatgagtgccactgggataatttaagtgtcttacccctcagcttcttcactcctttctataggttgtattgcagcaaataacataatatccttacgtggaataatcctcaggctaaacctttatggaaagaaaagctaggtcagttttgattaggaggtgcttctgaatgcagttttacaaaattttttaaatactctttttttacaaaatggaggtatttgaaccagagagaatataattgttagttttgaatattgtataactataatggagtcttattataatgtgtcaattgtctgctgtgattcaagattacattgtataggcaaacccattataatgaggtcactttaatacccccattgatgagattcaaaagaaattcatatcatgctaatttctgactattgttagggtatgtatttagaagtttagttaattgtgtgatactttgatataagtttccatttatgggccctatttacttcctctttcattctctcccattttgccattttcaagacttactggtattgtactttgtccttcgagatggcgctgctctgtggggtagatagatgaatgaatatcaccctctttaataaataatatttagaggaatgagaggttacttgtatataatattgaaagcaggccagttgtggtagctcatgcctgtaatcccagcactttgggaggtcaaggtgggcagatcacctgaggtcaggagttcgagaccagcctggccaacacggtgaaaccccgtctctactaaaaatagaaaaaatagccaggcatgatgacatgcccctgtaatcccatctactcgggaggctgaggcaggagaatcatttgtacccagtaggtggaggttgcaatgagccaagattgcgccactgcactccagcctgggtaacagagcgagacactgtctcaaaaataaaaaataaaactaataataatattgaaagcaaatcctagtataagtatacattcccccaaacatttaccatggacaatagtagcagcaatattaacagtaaattctagtctatctttgctcaaattttagttattgctctttgccttctaaatataaaatactataggacaggggtcagcaaacctatttaaaagggccagatggtaaattttttagattttgtaggcatatggtctctgtcaaaactacccaactctgccagaccggtagcacagaggcagccacagatgatgtaaatgaatgagcctggctgtgctctaataaaactttattacggccactgaatttggatttcatatatttctacgtgtcatgaaatattattcttcttttgattatctcttgaatcattaaaaaatacaaagatcacttatagagtgcaggccatacaaaaaaaaaaaaaaaaaacaggaaatgggcaggatttggcccttgggctgtagtttgccaacccctgttttagaacattcctattctatagtacactggcgtctgctctgttaatcttaaagctcatagtatgtgagctttcagaagaatactctgaaaaattgagattgagagaggaagccccataagaagttaatgcttcatggactcaaatatgtacttaaagcctactagatagatatagatatagatatagatatagatatagatatagatatagatataggtatagatatagatatatacatgccaggcactgtttaagatgttgagatagagcaatgagttaagaagtcacaagtccctacctttatggaatttacattttagtgagaggatacaagctattaaaaaacaagtaaactctatagaactggagatggtaagcgctatgtttaaaaattaaccagggagggaggataggtagcccaggtaggaaagagggttataattttaaatagggtcatccattaaggaaggcctcattgataagatgacatttgaacaaagacctaaaggaggagagagaggaagccatggatcatgtggaacctgtatgccacccttagtgtaacagagtagaggcatggcatgaactgacatattttaatgggaaaacaagttaggagactattaaaataatccaggtggaaaatgacagtggcttagaccaatgatagaggtggaggtagtgagaagtagattactgatatattttgaagggagaggtaaacagatgcaataagataaagagagaagtcaggtataagacccaagatttgccttgggaattagaagaatgtagtttccatttactgaaatggagaagactatgggaaaagtaggtttgagggggaagatcaggaattttactttggttatggaaacctgaacttcctttagatatccaagtggagatactgaattgcaattagatattaagtatatgaggccgggcatggtgactcacacctgtaatcccagcactttgggaggttgaggtgggtggatcacataaagtcaggagttcaagaccagcctggacaaccgggtgaaaccctgtctctagtaaaaaagaaaagaaaagaaaagaaaaaagccagacctggtggtgcacgcctgtaatcccagctactcgggaggctgaggcaggcgaattgcttgaacccaagaggcaaggtttgcagtgagctgagattgcaccactgcactccagcctgggtgacagagtaagactccttccccccgcccccgccccaacccccccagccccgcccaaaaaaagtagatattaggtatatgtatctagacttcagtaggaaaatctgggctagaaatattatttttggagtcatcaacatataaatggaattaaaatccatcacaattgatgagatcaccaagatatttactggtattactatttgttgattgatattactgcccctgattctttctcatccactttcaaagaggtaggtagtttctagtaatctgtcccctctgctcattcacaaagagtggaagggatcccactgaattagaaacccgacctacacaggaagtaccattagttgaccatcttcccattttgccgtggtgtaaacatatgagtgaatttttccaagtacctccttgctggaaactgtttgcactggaggtaagtgtgaaaggggaggttgtggggaatgatggggtgagggctgcctaaacttttcccataactcagaaatggtttcattctgaggaagggagaaggttcaggctggttcttatttccctgaaccagtttgtacagccctaaatttgacctgctttcctcaaactgggagtcagaaatcccttttctcttctgtttttctgctgcagaaattcccaacattcccattttgtgggctccagaaaggggtaagcgaagacttcaatcccagccaatcattttcagattaataatttttagtgttttggtttcttttatcatcataaaaaatgcttggatccatttttcacatctgtttaatttccttgtggattgttatgtatctatgttctagggtcattctgtatccctgggcaatagagttcagatccatctgctatttccatttgtgtgctgttctcttgtggattctcatttgcagtttattgattactgtatcctagatggaagacacccaattcaggggactgcctcactctcaatctcatcttttcctgaatggtgttttattcctctgctgagagcttgctattacactacccaactgcttctgatgatctgtcattgtttctctactgttctgtcttcctgcttgattgcctttggtttttgtctctcctttttgcctcacttcactcatctgctgaatgatttgcattcttcactcactggtgctttgtccgtcagcaaatggcctggtactgccatatccatctgctattttagcattttagactgcccagcattatctatctgctcccctacaattcccctatactatggcctaacaagtgctatgccatctgcctgcctgatcttgccctgcccaatctatgcctgtaacactgtaagtaggtgagattgtttagcatttctgctatcatctacacttgccttgtgccactgagttagactgctgactgagttagactgctgactgagtttgcttgactgttgcctcctctacctatttgctacctatggctgccccattaatttatttgagatattgaaatcatctcctttgtacttgcaacttgctgattggcctgtgttgcctcctttacagtttgctgcatttaaaaaatcactggcattgctcctctgttgtcttgtaaccctgatcatattttatttccaataaaagttttgcctacatatcgtccaaacatcttagaaataggaaaatgctttgctatctaacagcccagtccagtttgctcctaaactgactttttaaactaccacctgtcctttctgcttttttatacagctccatattcttctctttatgtaagaatatatttttttataaataatcatctttgcttaagttttcctttcacatcatatattatgtacatttatttcttgtgtatgggatcttttaataattttccatatactaaaattatttcttaatttattattcctaaattttccagggttttataaggataagttactcctattaattttatcctttttaataagaccagaagatttttttgcaactttaaaagcatcatctctaaaaataaatttaattatcttataattctttgtagtttagattaaagtagctttctgctctgctctattttttcctttgagaatatcatttctcagcttcctcatagtttacgtaataccagttctttagagatcctttagatgtatttatcttccttccttttaaactcttttcttgtatgttgggtaaacctttgaaattgatattttctcattattgtatttgcaaagtacttggcatctaaaaataacttgcaacataacattatctgcactgtaaaacttacagtcttatttgcttatatttaaatgaaagctcaaatacaagaaccaaagaagaattttggtgaaatttgcaagagtctaaggaggagatgtaaagtggggtgtgtatgtgtgcatgcatatgtgtatatagagatttgaagtgttttatgtgtgtatctacaatgtcattgtgctcgaagtgtggaaaatgctgagtatccatattaaattttatttttacaaaaaaatctaaagaggtgatagatttagggatacggaaaaagtatggatgggtttttattttcttttaataatatagataaaatttgtcagtgtgaagaaaaaggatgctctagggaagttaaaatcatttcagtagctttttaaaattttggtaaaatataaacataaaatttaccattttaaccaattttaagtgtacaattcagtgatattagcacattcacagttttgtgcaaccgtcaccactgtttctagaacttttatcatcccatttagaaactctgtacccattaaacaaaaactccccattcctccctcccccaacccctggtaaactataatctactttctgtctttataaatttgcctgttctagatacctcatataagtggaatcataccagttttgtctttcagtgtctagcttatttcacttagcaaaatgttttcagggttcatttatattatatcatgtattagaatttcatccctttttaactctgaccattattccactgtatgtatataccacaacttttttatcagttcacctgttggtggacactgggttgttttcagcttttagcttttacaaataatgctcctacaaacattggcatgcaagtatctgtttttcttttggttatataactagaaatggattcaatagcatttaatactttagtccaagaagaaattaaattaatagcaaagagatcagggaaaccacataattaatatgaaagattaataagtccaagatatgatattaggagcagaagaaattataaacttttagaaaggctacagaaggccaaatgataaaatttagaagactattctatgaataaaagggagaatgaagttaaaatgacacagatcttggatgattgtaagaaaacaaaaatgattctgaagaaagttaaattttaaaaaaataaccaacttaaggacagtatgatggcacatctttgaaatggaataatgtgggcttttatagaggagagaggtaggcatttgaaaggcaaggtttaaatgaagatgactaagatgagggaaccaggtcatgtttagaggaaccagcaatgggaacaggaattcatttcaatccagagatccttcatcctgtatactcagccttctaccactcatagacatttttctaaaaagattgctaggctcgaaccccagagattctgattcagtaggtttggaattcggtttaggtaatgtgcacatacatgcctctgtgtgtgtgtgtgtgtgtgtgtgtgtgtgtgtgtgtgtgtctgtgtgcgtgcgcacacgtgaacgtgtgtctgtgtgtgtgttttaatccactgatgaaacacaatatgagttaaattgaactctgtaccgtagtggcctagaccttataagaatttaaaaagttaaagagaattgacccttgtcttcaagcagtttaaaactgcagtagttaaaaaatgatggacttaggaaagcagtttaaaactgcagtagttaaaataatgatggacttaggaaagaagactttcaatctgttaggtgataagttctcatttgttaattcaacaattttagggggggtgatttttatacactctatccatcccttctcaattgaggttccccatctaaactatcaaacacagaaaattgtttgactgtcttctcaattctcctaagggtggcacaccagctagtaccattctatatgtgtgagagataagttaattcactagatacaaaaattctctcagaaccttttaagaaaggttgggtaatctgtagtctgctaggaatatgtgacacaaagacataaaacgtggctcttaaggtgctcacattccaagagaggggaaaagacatttaacaaaaaaaatgcatttctaatatcaaccacacaattttgttcttttcatctaatggtttgaggaaaatgttcaaagtcacagtggctgtatataaggaaatcctttcacctcttctaagcattatttattcaggaagaagaatgtaataagaatgataaagtctgtattacaacttatcacagctgaaggatgctggcagtaacttaaatgtcgataggaatctctttaattttaaagcctagagcattcagtgacaggttagtgatttcattggtagctattaataaataacagtaactaaaactaggcttattagtttcatagtaaagagtagaaaatgggtataggtaagtagataactaatgtccaataggctgttcttgaatgtaattgcaagcacagtgagagatttttgcccccgaagtacaactcttataccaataatgaaaatgttcaggaatttaatttattctcactatcaattaaaactcactaaaattcctgctgtcagaaggtttagtcatattcattagtttttcttacggatttgattatttctgaactataaatttatttgtgctccctatactgatttgtgcatttaaacttgagagcagttagctttcattcctattactcagtacttcacactgattcctttaggataaactttactaacacatttttccttcttccttccaatttcttaccaaactttattttaacagcacagctatggaaagatcaaggttgtcatgttgagaaaagcacaacaatagaaattacgaccagatttagcttgttttcttagcaataatgaacaattttaaaagattttgctttgcctgcattcattctgaaaaacattttaaagcagaaaaagcagattatgccgatattttaataaggtggaataaaggaaaatataagagtaacataattttattaaactcattttattaataataaatatactttttcttatcttatgatctctgaactcctattttattttgaggaagctgaatttaaaatagagtgctataacgtgtttcctttgtgtgaaagttaatctgagaaggcaaaaggtctatctcattcttactaggcttcaagtcctttatatctaataacaagaaaattctctaaattaggcaactactccctaacaaatcatctattttttcttttagttttttattttctccactgaatgacagcagaatgtattcaagaccttgcaaaggatatggctgaagatgtagcttccttatataaacattttgtggaggtttccataaaatgaagtgaaacttttgtgaagtttcactttttttattttgaatatagataataacagtagcaggcactaataatcagtctcctagtttcttaatctctcttctccccctatttgccctcctaccatcaaatacttcactgttgctggcagaaactaactcatggcacaagagatcaggtgggtgagaaagagatcactgggggaaagtaaattgccccagaaagactgtttggtgcaaagatccttttttcacatgtaacaatctttaattttatgaacatcaaaatcaatacctgaaaagtgcactagttagatatttggaatttttcaaatacaaaccaccaccagactttttgtatttgacttagaatgctttttagatttcttataatatttagtacttatgaagaaatttagtgttttttacttatatcagcaacataaaaactgctcaaatttgattcctcagatgttcaggaatcaaattttctttggtttattcatagccgtagtagtacatgtatatttgcattgtaatcaaaggtggtaatcgccctacagagttcttaagcagaggtcctcaaagaaaatactgtatctcttataagttaaattattttctcatccaatgctttctgatcaaaattaagatagactctgtcagagggataaaatatgaagtctgtttagatatcctgcttctcatgaaggttagtaactacatggtaaggctaaaggccatctgtagaaagcttctcttttaccaacaagaaaactggttttcaaatttctcgttactttctcgttagtgttaagatattaggagcacaccattttgcatatgatatgtgttcaactacagcataaaatgacctttttattgtgaaatgggtattcagtccatattgtaatagaaaaatatatggtcatttaggagaaggaaaagatgacgttcatctttttaataacagagttttaaaataactccttttttactgaacatggaaataatacatgctttttgcaagaaaaaaaagaatttggggaaaatatagcaaagcaaaatgaagttaataaaaacaccaataatctgaacccacaattattacctaagactaattcattaatttgcccaactgggagcacaccatatatactggtttatatcttggttttcttagtaatatcatcccaattattataataattactaaaatgtatagtacacttactgtatgccatgtatttttataagtactttgtatattatatctaatttaatccacacaagcctacaaaataggtaggtaccactttacagataagaaaattatatttagaaagattaaatgattaaataaattgacttggatgtagcaaaagatgatagaactagaatttgaactaggtagtctttactccagatcccttgctcttagccactctccttttcatataatgtaagcttttcttcatttaataactgttctacaaaaaaattgggatttgtcaatcactgaaaaatacttaaaaactatgagtaatttaatttccctatcattaaacatttaggttctttcctatttcctatcacattctctttgtataaattgttatgtatacttctaatgatcactttagaaatatttcctaaaatacaataactcactcaaaattgtgaagtttcatattacatattgctaaattaccctcttagaatatgtacaagtttatgtatttgtactatcagtttatgagactgtatttccattaatcattgttaatcttaccaatctggtaggtgaaaaattgtatttttattggcatattgtagaatattaatcatttttaatcttaccaatctggtaggtgaaaaattgtatttttattggcatattgtagagtaatttaaacactgttcttgaatttattcagttttgtttctccttttataaactgcccaggttttctgttttgttttgtttttggctcagtagctgttcttaaatactgattgtaaccacaaagaggagtgtaaagaattggttgtcaagaaataattttggtaaggtcaaatttatgttttggctgtatcattttgacatataaaccattcattttctcatttctcaaactccgttaacataccagtactcaattattttatcactcatgctcttaacaacacagatcaagccaaaaattatatcctgaatcaaaggcattaagttaataaaatacaaacacatttcttcctaataagttagtttttccctttgtgagattttttcatggctgatgcatgatagtttatgttctaactatccttttcttatgtaatgttcactgttaaataatttacagatagaaacttattgaacttcagtaatgtagaattaatggtctattcatagatataagccctggaaaataatgtataatttggacttttaatacacttagctactattagcagtcattttaaaaaataccaaatataaactcttacacaattattttgcttggcaaactcatttttctatataggaattccaaaggagacattattctagcatgcaattaatatgaattatatttgattatctagatattgaaaccattttataaacttctctgacatgtagagctcaacttcctcttaagcattcaagagaacctatttttttttagttgcccataatatgcaaaccatttcagaacccagagatttttggtgagtgaattaacatgtagtttgtatttttacatggaaactatatgtataaatggttttcaaccagggtaaattttggttccccagggacatttgcaatgcctggtgacatttttggttgttacaattggagggtacctagtgatatcaggtgggtagagcccaggaatgctgctaaacatcctgtagtgcatgggacagtcccggcaataaagaattatctgacccaaaatgttaatgcagagattggaaaaaccctcatgacataatatcgagtacgcactaactgccaggttgtgctggaggctgcgggtacatgggtagaaagttatgatcttactggttaggaaagttacatttcattgtgaaacagaaagatctagattttttaaaggataatttaaatgataatgagattttaaaaatgatatgatattaacatataataatgtaatataattgttatgttaatataatcacattttgttataagaatatataattattgtgctgtggtaattttatgtgtgataaatatatgacatatttaggaacaaaaattctgcctgagggacttacttagttttgggaaactttcaaagaagtgacaagtgatactggcactgtttttgttgttgttgtttttattccttaccttttatttaatttacaaaaaaaaaacccacaaatagtaagttacaccataatggattttcaaaaactgaacatatctatataaccatccagatcaagaaaccagaatattatcagtgtcccagaaaatggcccttgttcccccttacagtcacagctcaatcctcaagtgtaactacaactttgacttttagcactacagattactttttttttttcaaagacaggagctccctctgtcacccagactggagttagaattacttttgtgttttaccgaactttgtataagtggaaccatataatatgtaatcttttgtgtctggattcttttgtttagtgtcatttttgtaaaattgattcatattatttcatgtagtgttgttcattctcataactatattgtataatacagctatatttattaacccattctactgtaaaggcacaatggctgaaaccgttaagttgacaaataggtcagtttggctgcagaatgggttttgagggagtggcaagagagagctgggaaaagtaggtaaggtcagatgatggaggatacctttgtcatattaaaggcatttggatttttttttctattaagaaatgagatttttcaaaagatattaaacaaggggaaaatataatgagacttgcattttagaaagaccattttgacagcagaatagaatgggttgagtgggagcaagcttagctgtagcaccaatcaggaggtcattggaatagttcagataaaagatgctgagaacctagaagtagacagtgtaggtggggatagaaagggacatatgattttctctggatagaattaattgcacttttggaataactgagaataagggttgcaaagactagttttctgagccaaccttcaaagcccgtgtgtattactaaaatgcaaaatgtgtgcaataaagaaaaataatagaatttaatgttagaatttaaagttgaattcaaaataattttcaaatgtatctttaatgtttgaacttacagaaaaacagatatcattagttgagaataaattaataaaaatctttatggataatctgaaggaaacttggcaacagtctagactaaaggttaatagtactggccacttgtttgttttcatttcaatttttaaagtatggctttctcttttgttgtttcaggatatcactcatggtacattttgccactattacggtagctttcagttgaggagggaaaaaaatgtgtgtgtgtgcgtgcgcgtgcgcgtgttcacctgtgcacacattcacgcgctaaatgcaggagttgagagaagaaaggaaagggggagttaaaatattgcatatggatgaataagaagaaaagtgtcttaagcagaatgaacttagttccctgttattatttctgggtggggaaattgctctctctttttattttgtttgtgcatgcatgcctaaggagaataaaggcactcagaaagttcccccatagtcaccgggtgatagcttcatttcaaagatgtatcgttttctatctgagacagtagtcaagctaattgtctctttgtgacctacagaatgccagcaattagcttttgataaaaagaacagtgcctatcaatgttttcaaagatgaagaattctgacataaaaaataaaattagtgaactctcatttgatggtaattacacctgttgtctattgactaaagcaaatatgtgatactttttaaaattatggtcaattctgtaagatttttagatgaatttgtatcttattataacatctatattcattaaaagctctaatacacataaatgagggtaatttattcattgtataatcagtgctttttgcattaattggtgaaaggcttctaattgctctgatatacctcagggtctgtcctccacaaatgaagaaccacaggcacttgatttttttgtttgtttctgttgcatttggggaacatctgtattaggtccaaattttagtgaattctaaattttatgctttcaattaatgattttattgtagatttttaaaaatcaagtaaagagtaatctttatactaatttattttgaaaatgtcagattttgaaaacaacagaccaatgtaacactgagtaaagcacatctgcatttttaatttttaggaagaaatatggattccttttcttgtcacatttattacttaaaaaaaataaagtatgcctgttaatcttcaacacagattcaaagatgagaatagtatgtattagtctgttgtcatgctgctaaagagagacatacctgagactgggtaacttataaaggaaagatgtttgacacacagttccacatggctggggagacctcacaatgatggctgaagacgaatgaggagtcatgtcgtacttggcagcaggcaagagagcttgtgcaggggaactcccatttataaaaccatcagatctcatgagacttattcaataccacaagaaccaatgggggaagcacccccatgattcaattatctccacctggccccgcccagggcacaaggggattattacaattcaaggtgagatttgggtaggggcacagccaaaccatatcatactataatggcaaaaatttaaagaatcaaggagctaccttgctttgtatttgcttctacttttcttcatcagttttatcaaaaacagattttggcactgtatttttacctccataatttgagtttttactgaaggatccttgagagtattaaaagcatggcaattagctagaagcaagagttctttttctattttgccgttagtttatctgccatattccttatcatatcattttatcaccaaatgaagtcctaaaatcaacaaatgagaaacttttaaaagtactttgacatcatcttgtattcaatcaagaaaatattgagactttactagttttaagtgagaaagaattaaaagtattagttgtggcaaagatttagtcccttaacccgaatatttgttaaaatcaaagaacaaaataacctatctaatcactgcaaatcattcttatctaaatgttgccatcacaggagtagccaggtatcattagtgtaatcttcagtctcaatacccttcagtcatgagtccaataactcaaacctcatttcaagttcacattccttttatcccaaataatggaaaaatgggaagaatagtaccctttcttttttgtctaagctattaactgcatatgcctgaatggaagatgacagcaactataatatgagacacctattttcccaatgagaagatccataaatggggggattatccatcttaaatgtacatacttttagcaatttagataaaatagtggaacacttaggttaactaatttaaaacacaaatataaatttaaagccacattgaaaatagtatattatttaggacaactgattctttttcatggcaattttttgaaaggtgttatgcaaagtctcaacatataccattaacatcaatgtctttattatcatttccagagtctaagtaatttaaaagttttccatgctatatcatcttttgtttaacagctctattgagatataattcacatatcatacaattcattcattgaaagtgtaaaatttaatggtttttggtatattacatttattttctaaattgtggcaaaatatgtatagcacaaaacttgctattttagcctttttttttttttttcttctgagacgtagtctcactctgtcacccagactggagtgcagtggcacgatctcagctcactgcaacttctgccccccggattcaagcgattctcctgcctcagcctcctgagtagctgggattacaggtgcgtgccaccaagcccagctaatttttgtattgtagtagagacagggtttcaccatgttagccaagctggcctccaactcctgaccttaggtgatctgcccaccgcagcctccctaagtgttgggattataggcatgagccaccgtgcctggccctaatttagccatttttaagtgtacagttcattggtattaattatattcacaatgttgtacaattatcactactacctgtttttaaaactttttcatcaccccagaaactctgtaacctttaagcaataactccccatttcttccttcccataatccctggtaacctttaatctactttctatctttataaattttcctattgtaaatatttcatgtaagtgcagccacacaataattctccttttgtgcatggcttttttcatttagcctaatgtcttctcagttcatgcatgttgtagtatatatcagaactttattgctttttatgcctgaataatattctattatatgtaataccacaattcatttatccgttcatcttttgatgaacacctgggttgttttcatcttttggctatggggatagtgctgttgtgaacattggcaaacaagtatatgttcaagttcttgctttcatttccattggttatgcacttaggaatggaaatgtgggatcatatggcaattctgtgtttcacatcttaagaaattaaactgtttaagagttttatggttttagttcttatactatagataaagaactatagttctttatactatagatctattttgagttcatttttgtatgtggtgtgaggtacgagttcattcttactgcttaattatgaatacatggaatttaaaatttttctatttaaagatattactggaaatgttattccaagcctgaagtagccatttgcctaacattaggacacttaccattttcttttatcctgtaaagatatcctaacattcacaatataaccacatacaatattgctttttattaattatttctgacaggtatcttttatatccaaacaacactagtattgatgaagagatcttttaggcttgtgggccttcatcaaacagtactttttgatttaaaaaaagtgaattcagtaaaatatgcgaggccttataacagttcaaatgtaaggcaactaactgttctttgctgatgagtaactttggtttaaaaaaataacttgccatatggaagttaagatgtgggaacatgggtttgattttgtgctattcatgtatattggaggtgatctcaactctgtgctaattcaaacaatttatatttccaggtaaaaataaactttagaatttgtagaaaattcatatgctagtgttgcatcctgaaattattatttgtctccaaattaaagtgaaaagtgattcaatagagaaacaccttgattccccatatctgtcagttgataaagtagctattgcagaattctacaacagagagaaggaagagtgagatagtaaatagaagagtagcgtttatgagttcaattaaaactttaaagaacagataattcctgtcttatttcctcattatttaaattgtatctaaacacaggatgaagaaaacatctgaactcaatctataaagataacaaaaccttcataccaaagtggaataaaaataacaaggagactatagacctaatcatatgtgaaaatatatgtagaaatattgaaataatatgcaaaaacttgatacagcatcaagttttttctaaatgtacacctcttcctaagcgaaactgattttaagaattcaagaacggtaaattttagacatcctttaatttcatttttatcattattaggtaaatcacaaaagattatatggtcatcttgatgtatgccaaaaagacataaaattcagtgtatttttttccttctaaggatacatagtaaactagaatgaaagaaaaattttaaacatggtaaaatgtgtttatcacaaaaaccaacaaatacaataaagctgaaacactggataaattcttactaaagacagaaaaaagaaaaagatagttacagtcaccattatttgttctagaaagtctaaccagcacagacagtttgggcagtcagtaatatgtgtcaaaaatttgaatgtaatgatataattacatagagagattatatgatggaaatatgagaaaagatatgaagaatgaaatgagaaggtccaaagtacattatatcagagccccaaaaggaaaaaatagaaagaataaaggcaatgatcaaagagataatgactataaagtttacagaactaatgaaaaaacacaaatccagaaatcctaacggtatagtgtatctcaagaaggataaataaaagaaatatgtttctgaacacatgggaatgaaatgtcagcactaaagtaagggaactattgaaagtaaccagggagaaacagcagatcacttacgtagaaatgacagcaggcttttcgacaacattggaataaaacagacaatagaacatgtaaagcattgaaggaaataacgagaattgtttattaagcaaaatatctttcaagaatagagataaagagggagtaaagcaagttggccaaataaaaggctccaccagtcataccccaaacaggaacaccaaacttaacaactctccacagaagaaaagcatctttatcaaaaccaaaaaacagatgagcagttatagtacctggttttaacttcatgttgctgaaggagacactgaaagggataggaaacacagtcttgaattaccaacaccacccctccccagtcataccccagcagcaactggctgcatggcatggagagagaatctgtgcatttgggagaggaacagcacagtgattgtgagacgtagcattggacacagtgctgccctgtcacagcagaaagcaacaccaggcttaactcaactgaatactgcccatagagggaccatttggaccagccctacacagaggggaaccactaatccctgcgattggaaagtgagttttggcaagccttgccaccacaggctaaagtcctttgcagcccaaaataaatttgaaaggcagtctgcgctccaagaactacaattcttgggcaagtcctagtgctgacctgggctcagatacagtgggacgtgggggcacatgacctactaagacaccagccaggacagctaaaggagtgcttgcaccatcccttccccatgcctcaggccacatagctcacagctccaaaagagaccccatgcttctgcttgaggagagggaacagtaaaggggactttgtcttgcatttggaaaccagctcagccacagtaggataggacaccaggcagagtcatgaggccccctttccaggccttagctcccggacaacatttctaaacacaccctgggccagaagggaacctgttgccttgaagggaaggactcagtcctggcaagatgcatcaacttttgactaaagagaccttggatcctccaaggtccagcagtgatacccatatagtatgccatgtgccttaggtgagcctctgagacatgctggcttcaggtgagacccagcacattcctagctttgatagctatcgtgagagactctttctgcttgagaaaagcagagaaaaagtaaaggggattttgtcttgcaccttaggggagtagagcaccaagtgggctcttggggacctgatttcaggccttggagcttggacagcatttctgaacctgccctgggccacaggggagtccactgccctgaagagtgagtcccatgcctggcagcattcaccacaaactgactgcagagcccttgggcctaaaggaaacatcagtgttagcctgacagtactccccttgggtctgttgtggtggtggccataaggtgaggctcctctgcctgtggaaaatagagggaagagtgggaaggactgtgtctcatgatttgagtgccaactcagcttcagtaaaatagaacaccaggtaaatgtctaaggttttttttaattccagtccctcgctcccagacagcatctctggacctaccctgggctgggataactcaacaccttaaagggaaggacacaagcctgtctgacttcacatctgttaatcgtacagccttagtgccttgattgaacatagacagcagccagatagtggttacagtaggccttgggtaagacccagtgctgtgctggcttcaggtctgacccagctgacccatactactggtgatggccactggtgtttgtatcaacccaccatccccagctccggaagcacagcacagagagagactccatttgtttgggagaaaataagagaagagaacaagagtctctgtgtggtaatacagataatttttctggactttaaccaagaccaccaaagtggtatctctgcaagtctgcaagaactatagcattactgggcttggggccgaagtcccttcaaatacctggaaagcctttctgagagagacaggtgccaacaagcccagattgcgaaagctaataaatacctaactcttcaatgccagaaacactgacaaacatctacaagtatcacgatcacccaggaaaacatcacctcacactacaaactaaataaggcactagggaataagcttgaagaaacagagatatgtgatcttttagatagagaattcaaaatagatattttgaggaaactcaaattcaagataacacagagaaggaattcagaattctgtcagataaacttagcaaagagattgaaataataatttaaaagaaacaaacagaaattctagacatggaaaatgcaattgacacacccaagaatgcatcagtctcttaatagcagaatcgatcaatcagaagaaagaattagtgagcttgaagaaagactaattgaaaatacacagttagaggagacaagaaaataaaaaaggatgaggtatgcctacaaaatgtagaaaataggctcaaaagggtaaatctaagagttattggccttaaagaggaggtaaagaaagagataggagtagaaactttattcaaagggataatatgagagaacttccaaacctcgagaaaaatatcaacattgtgcaagaaggttatagataacactaagcagatttaactcaaagactacctcaaggcatgtgaataattaaactcccaaaattcaaggataaagaaagaatcctaaaagcaccaagagaaaagaaacaaatgacatacaacggagctctactacatctggcagcagaggtttcagtggaaaacttacaggacaaaagaaagtggcatgacatatttaaagtgctgaaggaaaaaagttttgctctagaacagtatatctggtgaaaatatccttcaggcatgaaggagaataaagactctcagacaaacaaaagctaagagatttcatcaacaccaagatttcatcaacaccaaacctatcctacaagaaatactaaagggagttcttcagtcttaaagaaaaggatgctaatgagcaataaaaaatatcatctgacagtgcaaaactcactggtagtagtaagcacccagaaaaacagaatattttaagactgtgattgtggtgtgtaaactactcttatctcaagcagaaagactaaataataaacgaatcaacgataataaccgcaacaacttttcaagacgtaataagacataaagagacacaacaaaaagttaaaaagcggggacacaattaaagtgtagcatttttatgagttttctttttgcttatttgtttctatatgcaatcaatgttgtcatcagtttaaaataatgtgttatagtatttgcaagcctcatggtaacttccaatcaaaaaaacctacaatagctacaaaaaaatatataaagcaagaaattaaaacataccaccagagaaaatcacttccacaaaaaggaatacgggaaggaagaaaagaaggaagagaagaccacaaaacaaccagaaaacaagtaacaaaatggcaggtgtaagccctttacttaataataacattgaattataaatggaccaaactctcaaatcaaaagacagagtggctgaatgaatgaaaaaacaagactcaatgttctgttacctgtgagaaacacagttcacctgtaaagacaaatataaactgaaaataaaaagatggaaaaagatattccatgccagtggaaaccaaaaaagagcaggagtagctaaggcaaaatagttttctaaacaaaaactgtaagaagagacaaagtcattatataatgataaaagggtgaattcagcaatgaacccaatgctggagcatacagatatataaagaaaatattattagagctaaagagagagatagattccaatacaataataactggagacttcaacaccctactttcagcattaggcagatcatgcagacagaaaatcaacaaggaaacatcagacttaatcagcactatagaacaaatggacctaatagatgtttacagaatattttatccaatggtggcagaatacacattattctcctcagaacagagataattctaaaggatagaccatatgttgggtcacaaaacaagcctcaaaacattcaaaaaaattgaaatgatagcaagcatcttttctgaccacaatggaatacaactggaaatcaataacgaggaatgttggaaactatacaaacacgtggaaattaaacaagatgctcctgaatgatcaatgggtcaatgaaggaattaaggaaactgaaaattttcttgaaacaaatgaccaaatatgccaaacataccaaaacatatgggacacagcaaaagcagtactgagggaattttatagctataagtgcctacatcaaaaaaaggaaaaaattcaaataaataacctaatgatgcatctcagagaactagaaaagcaagagcaaacaaaacccaaaagtagtagaggaaaagaaagaataacgatcagaacagagataaatgaatttgaaatgaaggaaatacaaaaagatcaacaaactggaaagcttgttttttggaaagttaagcaagattgacaaacctttaaccagaataactaagaaaaaaggagagaagatacaaataaacaaaatcaaaaatggaaaaggagtcattacaattgatactgcataaagtcaaataatcattagtggctactatgagcaactatataccaaaaagttagaaaacccagaagaaatggacaagtttctagacagatacaacctatcaaggcttaaccacaaagaaatccaaaacctgaacagagcaataacaaatatcaagattgaagctgtaaaaaaaagtatcccagtgaagaaaagcctgagatccaattccctgctgaattctacagaacatttaaggaagaactaataccaatcttactcaaagtattccgaaatacaaggaggagggaatacttccaaactcattctatgagaccagtgttaccctgataccaaaatcaggccaagacatgtaagaaagaaaagaaaagaaaattacaggccaatatctctgatgaatattgatacaaaaatcctcaacaaaatactagcaacccaaattcaacagtacattaagatcattctcataaccaaaagggattcttggcaagcgtacaaggatggttcaacctacatcatacatcctatcaacagaatgaaggacaaaaactatatgatcattttacttgatgctgaaaaatcatttgctaaaattcaaacttgctgcatgataaaaatcctcaaaaaaactgggtgtagaaggaacatccttcaacataataagagctatatgcagcagacccacatctggtatcatagtgaaatgggaaaaactgaaagcatttcctctaagatctgcaacatgacaaagatgcctactgtcagcactattattcagcgtactactggaagtcccagctacagcagtcagagaagagaaagatataaagggcatccacattggaaaggaagaagtcaaattatccttgttttcagatgatatgatattatatctagaaaaaaactaaagactccaccaaacaactattagaactgagaagcaaattcagtaaagtggcaggttacaaaatcaacatacaaaaatcagtagcatttctatatgccaacagtgaacaatctgaaaaagaaaaaaaaaaaagtcccatttacaatagccacagagaaaattaaatacctaggaattaacttaaagaagtaaaagatctctataatgaaaactgtaaaactgatgaaagaaattgcagaggacaccaaaaactggaaagttattccatgttcatgggttggaaaaattaatattgttaaaatgttcatactacccaaagcaatctacagattcaatgcaatccctatcaaaacaccaatgacattcttcacagaaagagaaaaaaaatcataaaatttatcaggaaccgcaaaagacccagaataaccaaagctatcctaagcaaaaagaacaaaactggaggaatcatattacctgacttcaaagtatattatagagctatagtagctaatacagcatggtactggcataaaaacagacacatagaccaatggaacagaatagagaatctaaaaataaatttatacacctacagtgaactcatttttgacaaagatgtcaagaacatgcactcaggaaaagacagtctcttcaacaaatggtgctgggaaaactgaatatttatatgcagaagaatgaaactagacccctatctcttgccatacaaaaatcaaatcacagtagattaaaaacttaaatctaagacctcaaaactgtgaaaccattacatgaaaacattgaggaaactctcctggatattggtctgtgcaaaaatttcttgagtaatatctcataagcacaagcaaccaaagcaaaaatggacaaatgggattacaaatttaaaagcttctgcagagcaaaggaacaatcaacaaaatgaagagagaacccacagaataggagaaaatatttgcaaactacccacctgacgagggattaataaccagaatatgtaagaagctcaaacaactctataggaaaaagatctaataatccaattaaaaatgggcaaaagatctgaatagacatttctcaaaagaagatgtacaaatggcaaacaggactatgaaaagatactcagcatcattgattatcagagaactacaaatcaaaaccacaatgagatatcatttcaccccaattaaatggcttttatccgaaagacagggcataacaaatactggtgaggactagagaaaagggaacccttgtacaccattggtaggaatgttaagttagtacaaccaccatggagaacagtttggaggtttcttggaaaactaaaaatggagctaccatatgatccagcattcccactgctggttatgtacccaaaagaatggaaatcaaggccaggtgcggtggctcatgcctgtaatcccagcactttgggaggccaagacaggcagatcacctgaggtcaggagttcaagaccattctggccaacatggtaaaaccctgtttctactaaaaatataaaaattaaccgggcatggtggcacatgcttggaatcccagttactcgggaggctgagacaggagaatcactgaaacccagcgggtggagattgcagtgagccgagactgtgccactgcactcaagtctgggcaacagagcgagactctgtctcaaaaaaaaaaagtggaactcagtatttccaaggaatatctgcactcccatgtttctggcagcactgttcacaatagccaaggtgtggaatcaacctaagtgtccatcagcagatgaatggataaagaaaatgtacatctacacaatggaattctatttggccatataaagaataagaacctgttatttccaacaacatggatgaaactggaggtcattatgtttgtgaagccaggcacagaaagacaaacttcacatgttctcactcatttgtgtgagctaaaaatgaaaacaactgaacgcatggagatatatagtagaaggatgattaccagctgaggatggtagtggggaagtaaggggactaagtataaaaagtagttagaaaaaaatgagtaaaacctggtattggatagcacaacaggatgactgtagtcaataataatttaattatatatttttaaataaaaaatataattggattgactaacacaaaggataaatgcttgaggggatggatattccatataccatgatgtgattattatgcattgcatgcctttatcagagtgtctcatgtacttcccaaatttatgcagtacctactgcatacccaggaaaattaaaaatttttcaaattttttaaactaaattattcaaagaagattacaaaaagtctgatagtctctgggcaatttgtgttaatacaaaaaaaattaaaaccaggaaagaaaaccctgagagatcaggagataacatactcttcatagagatatgaagcatttctttgttttctgtgctttcttagaagcaaacctgattaggtacagaagaagcctatatatgtccttattacagtgttgagtaaaatgtcagtttccatctatcgcatttattgttcctgatttgaataccctcttctcttggatacttaatttttattctgtgaaaagaaatggaagagaggatctgagtttaggttattcataatcatctcaatataaaatagtattgcctgcttacaaaatctttcaagtttattttggaagcctaaatttttaaataatttttgttgattaattcttaagtttggcttggctcttttattacctgagacactcttaagtgtataactttgaaagcataacattgaacatcaaggtagcatcaaaggaggaaatgtataaatgtgcagtctcagtagtgtttttacgtatgtgtgtgttagtgggggtagtcatttctacccattctgaccaggtaattaagtgtggttggtgccagtagatacaaccagtttcttctaccccactcccaccagctgccctaataaagtcacttttcagttgcctgttgtccaaacctgaaaaacaatcccaatcctagggtgtatagtattattaactatagtcaccatattatgcattagatttcctgaacttttttcctccatatctacatatcaacttctgaagaacaggaatgagtaactcttttttttaacgtaggttgaaagacatacctagccaatattctaccattaacgaatacatacatattccatatataaaaatgttaacaatccataggaatatcaatattctttcatcttttcctggaatgagatacaaagtagtactgtttatataagtggaatatgaagatacgtattctcatgaaaatctcttataaaaagtgatttgttcacctgagtgcccaagttttatggttagataatttaattatcagattaatgtttagataaaagttattgaaaaataatatgtaaagagaaaagttgtgatgctaacgagtgttcactgctatgtacttgagttggttcttgaacaggggttgggatctaaatgttagcaaatacagtgagatttttcatagttaaagtgaaaaaaacttgaaaatctttcaaatacatattaatctcagtaagccaaacaaccagtttttaccccagcattgaaataaattctttggttgaattaggtaaattggttggcatgctttataaagaggaataattacctttaaacattagaaccttagctggcacagcaattcattaaccattggaactgaggtaaactgtgaaaactaccaactcagacaccatttcatgctcactgcaaagtatatgttcattgaatggaatggaaaacaaaatgcctgcagtatgtaaatttgtactcttttcttcctgtgtccttcctaccatggtactgtctcctttgacctttcatcacaaccagatcttatttaaatattgtacaatttgaactgaaaaaaaaaatggagcatcttctcttcacatgaaacgttatctgcttcttccaggaattgaagaagatgtaaatatttaagaatattaaaaccccaagaaaagatgttcattagcaataagataatatctctcaagtaaaagtgagatgccttttacaattaccttgatttccagattgcatcttctctgtgtagcagtagtctttgaccatttggttgtattattataagttgatgtggttatgattgtttgaaagttgtttgtaactaaaataaaaataaaatctgtaaatgaatggttttaattaattagactaaattcgagactgcttttacaataatgtgactcttacttccgttctgctctgtttcttgaatgagaaaaaaatagatttataacaagtactccttgaacatccttgggagtttgtcgtggatgtaacttttatccactacatgatgtcccaagaaaaatattttaaggatacctactctgtaccatagaatacttataggagcagcctcagaattgttagtttattataaccctttttaaaaatgtaaaatgaaattaatgtgtttgtcctttaataagcagaagtcaggaaaatgtaactggctggcattaaactgcctatttttacctaatttatctcctcactaaatctatattctgttctgatgaaggattctcacatttatgtcagtctacaaagttgaacataaagtgattataaagataagaccaaatggtacatattgtcattaatctacatcattccttccatcagcagtatgtttttcaaagtatggtcttctgaccagcatcagaagcgtcacctggaaacttgatagaaatgtaaattttcacctggaaacttgttagaaatgtaaattttgaggcacctagacattctgaatcagaatctctggaagtggggcccagcaatctgtattttaacaaggcttctagaagattctgatgcacactaaagtttgagaaacactgctctaactacatctcactttgataacttaacaaagttattattaatagtagtcattagctggtatttcaaagatagtctttgttatttatttaagattatttaatcagcagagggcactgcagtaattgttaaggaggaaattttattaaatctacctaatcaggttacaagcacatgagtactaatatataaatttgtctgctctgttaataaaatcatgtctataaaaataagtgaaagcactatactaagtgatttttcacagagtcactatgcatgtaaagtatttctgcacatttagatatatctattatatgttctttacgggtttttttaagacagagtctcactctgttgcccagactggagttcaatggcacgatttcggctcactgcagcctctgcaacccgggttcaagcgattctcctacctcaggctcttgagtagctggaactacaggggcatgccaccacgccgggctaatttttgtatttttagtagagacagggtttcaccatgttggccaggctggtctcaaactcctgacctcaagtgatccgcccaccttggcttcccaaggtgctggaattacaggcatgagccaccatgcccaaccatatgttctgtacatttttaaacatcattgtctgttagcaatatcttttttaaggtcatttttcctatgaagttaaaatatgaacaatttcatcaacaagatacctgaattactgaatcattgtttttgacactgtttttacagcttagcagtctttgaagcgtctttctgactttaatgttgtcctcaaagtatcaagaaaaaaaaaggaaaagatcacaattatgtgatttttcacagaagtttgcaactttcatattggaaaaatatttagacgtcaaagataaatattttatttaaaaagaatagctaagtccaattaaacctttatattttagaccgactagttcagaaatactgatacctgaagtaagactataaatttctaccatctttcaaggaataaaagaatctggtaatcaaattaataatgtataagagggaaacagaactttaagctagttaaggaaaaaatggtttcaagcttttaatggcatctttttgccattgataatgaacagtctgttaataatgaatacttgtgttatctattcattaacagatacagataacctttatttgtctgtattgtactagcatatgtgattgaaagtgataaagctacattcttcaaaccattcttctgttcagattttctaataaacaggtatctttctcttgttatatttgtaattaagttttattctcttattctttgttttctagttgcatctccccatttatagtttacaggtctttgtactcagctcttgctctcttgtccatcttccagtccccatctcattcgctgcctgctccctagtttagatccctaatttcagtattctacttcctacgtggcatttgccagtgctcttgcatctgggttcttgctctccattctctttttcctagtctttggttctctactactctttgcaggtagtttctggatttttgtattatttctgttctctaactgatatgtgcagaactgcaaggatgtaagaagaattggaaagtagaagcatagaaagagctaacatgtattgaatacctattctatgctaagtgatttatcatttagttctcagagccctcttataagatgtaggtatgttttattattacctccattatattcataagtactctggaaacttaggttaaatattttattctaattcacatagcaaaactacatagtaaagccaagtttcacatctagattggtttatttattccttcacttctttattcaacaaatatttgttgagcacatactatatgttgggctccgaactagatgctgaaatagatccagctcctattgttattgcccttaactgtgtaatgtcattttctgacttcatagatgatgatcttttactacaccaaacagcttaagaggaagagaaaataaaaggaaaatagaagggttctaatgttttatgtaaaatgtttgatacaaacgtgagaaagactgtgtttgtgcttgatttaagaataccctattgaaaagaacagtttgtatctagcatagagagtctgacatccacctaccccaaccaactcaccaccatcagcatcaatgcctttcagtggcatcaccatgatatattttttcttttatgttctaaaacatataaggtttgtgtctctatgcccaaattcttcagaagatcttcagaaagaattaactgtcctgcctgaattatgtttagagaaagatgaagaactttgtaaagaatacagtcagccctgcagaacccctaactactgtattttcgatcctcagttgattgaatccacagatgttgaaccagcaatatggagagcaactgtacctacactgtgatccatccatctatatatttttataccctgaaaaatattttagatggcttacccaaatacataaatacaacagaatttttaaaaatataaatgtgaagagtaggacagagaaaaatcagatgaaactaaagttgtgttcagtaagcctactgaaaggtattcacaaatttgttctcaaggataacttgattcacaagcattgtaatttaaaaacaaactggtaacatagaaaagtatccattcctagttatgatacttgaaaggaaatttctcctgtaggtcctcctaaagaccacagtgtaatacggtgaacaattcagatgcttcctaatgtaaataagagtttgagccattttattgattctgatttcataccacagaagcaaagcccaataaaccaattctataaaaagtgaaatgaggcattcaaagtagatcactctccagtggtctggcaaaatccagtggtatgttttagaggatttagaaaaattaatgaaccacatctcttttaggcaattctcacgtatcatttgtcaattgagtttttcatgtgctgggtgacagtgagcttacacgctctctgaggtttgttctactcactactgtaacatcaatacctcagatactacctagtacatagtagatgcttaataaatattcgttatttaaatggataaatgttgtgctttgaagtatcaattttaagtgaaatactccctttcagctatctgttgatatttcccttcatgtccctgaataaagtgtgctactatactttgggatatatcatctttatgtgaagccccgaattcatgaaatgtcaaccattgcttatataactttttcaagcaagtaatgaaataaatattaacactatccaagaagttcctttaatattgttaacagtgacatccccttgcttgatgtttagggctctgattttaacatccttgagaaggtgttaacctccataaagcaatttataacatagaagtagtgtttcgtcttggtaagtctcaaaatcataacagatagattggctttggaaaataagtaataaagattggataatgacatggatgaagctggaagccatcattctcagcaaactaacacaggaacagaaaatcaaacactgcatgttctcactcataactgggagttgaacaatgagaacacatggacacagggaggaaaacaacacacactggggcctgtcggcggggtgagggggaaggggagggagggtattgggacaaatacctaatacatgcagagcttaaaacctagatgacgggttgacaggtgcagcaaaccaccattgcacatatacctatgtaacaaacctgcacattctgcacatgtataccggagcttaaagtaaaatttaaaaaaaaatttaaatacgtaaaaaaagatgggataatgccagcaaagtccttacgtttttgttagtttttctttaaaatgtctcccattgttaaatatcctgttatgctaggattcactgtaccagtaaattgcatcaattctgctaatcctgtattctgtataattggaagggattaactaatttatatgcgttctaaactttatttataacatcaattagcatctaatacatacctgatgcattttaactgcttttgcccagagctacaatcttattgaagagtagcattctactttcaaagaaatattgaaatataaacctttctctctataccttcataatttactttttgtttgcctttctacttatttactgtaatacttcattttgcaaactttatttttgtattgcttccaactattataacttgcttaatttttggaaacagaggactggaaatggattaagtcatgtatttcaccctcaagttttagcctaaaatgtatcttgaccattatacagtaaaatatatacctattttgattgacccttcaaaaatgaaattttcttgtctttaggaaaatttaggagactttaggaaaatgaaattttcctttcattagtgtattccagatttaactgtacttatcttaagaatgccgtatcctccaggcatggtggcttatgcctgtaatcccagtactttgggaggatgaggtgggcagatcaccctgaggtcaggagttcgagaccagcttggccaacatggtgaaaccccatctctactaaaagtacaaaattagccaggcatggtggtgcgcacctgtaatcacagctactcggaaggctgaggtaggagaaacacttgaacccgggagacggagtttgcagtaagccgagatcgtgccactgcactccaggcaaaaagagcaaaactttgtcccaaaaaaaaaaaaaaaagggtgccctatcctaaaactcctagtatataggtaaaccccttcacatcattaattttttatttaaaaaagacggttgggcaagatggccaaataggaacagctccagtctgcaacgcccagcaagatcaacgcagtaggcaggtgattgctgcattttcaactaggtacacggctcatatcgttgggactggttagacagtgggtgcagcccatggagggtgagctgaagcagggtgaggcattgcctcacacaggaagcactagggatcagggaagtccctccccttgccaagggaagccatgaggaactgtgcattccggcccagatactatgcttttcccacagtctttgcaaaccgcagaccaggagattccctcgggtgcccacaccaccaggaccctgggtttgaagcacaaaactgggaggccatttgggcagacaccaagctagctgcaagagttttttttcataacccagtggcgcctggaatgccagtgagacaaactgttaactcccctggaaagggggctgaagccagggagcaaattggtctaactcagcagatcccacccacacagaacccagcaagctaagatccactggtgtgaaattctcattgccagcacagcagtctgaagtcgacctggggcactccagcttggtgtggggagggggcgtccaccattactgacgcttgagtgggcagttttcccctcacagcataaacaaagcagctggaagttcggactggacagagcccaccacagtgtggcaaagctgctgtagccagactgcctctctagattccttctctctgggcaggacatctctgaaagacaggagccccaggcaggggcttatagataaaactcccatctccctgggacagagcacctgtgggaaggggcggatgtgggcgcatacttaaacttagttccttcctgccagctcctaagagagcagcagatctcccagcacagggctcaagctctgctaagggacagactgcatcctcaagtgggtccctgacccccatgcctcctgactaggaaacacctcccagcaggggttgacagacatgtcatacaggagagctctggctggcatcaggtgaatgccgctctgggacgaagcttccagaggaaggaattggcagcaatctttgctgttctgcagcctttgctagtgatacccaggaaaacagggtctagagtggacatccagcaaactccagcagacctgcagcagagaggcctgactgttagaaggaaaactaatgaacagagaggaatagcatcaacatcaacaaaaaggatttccacacagaaaccccatccaaaggtcaccaacatcaaagagcaaaggtagataaatccacaaagatgaccaaaaaacagcacaagaaggctgaaaattccaaaaaccagaacacatcttctcttccaaaggatcacaactcctcgccagcaaggtatcaaaactggagggagaatgagtttgacaaattgacagaagtaggcttcagaaggtgggtaataaaaaactcctccgagctaaaggagcatgttctaacccaatgaaaggaagctaagaaccttgaaaaaaggttagaggaattggtaactagaataaccagtttagagaagaacataaatgacctgatgtagctgagaaacacaacacgaaaacttcatgaagcatacacaagtatcaatagccgaatcaatcaagccaaagaaagaatttcagagattgaagatcaaattaatgaaataaagcatgaagacaagattaaagaaaaaagaatgaaaaggaatgaacagagcctccaagaaatatgggactgtgtgaaaagaccaaacctacttctgattgctgtacttgaaagtgacagggagaacagaaccaagttggaaaacactcttcagggtattatccaagagaacttccccaacgtagcaagacaggccagcattcaaattcaggaaatacaaagaacaccacaaagatactctttgaggagagcaaccccaagacacataatcatcagattcaccaacgttggaatgaaggaataaatggtaagggcagccagagagaaaggtcaggttacccacaaggaagcccatcaagctaatggcagatctctcggcagaaacccaacaagccagaagagagtgggtggccaatattcaacattcttaaagaaaagaattttcaactcagaatttcatatctggccaaactaagcttcataaacaaaggagaagtaaaatcctttacagacaagcaaatgctgagacaatttgtcatcaccaggcctgccttacaagagctcctgaaggaagcactgaatattggaaggaacaactggtaccagctactgcaaaaacatagctaattgtaaagaccatcgacactgtgaagaaactgcatcaactaaggggcaaaataaccagctagcatcatgatgacaggatcaaattcacacataacaatgttaaccttaaatgtaaatgggctaaatgcccccaattaaaagacagactggcaaattggataaagaatcaagacccattgatgtgctgtattcaggagactgatctcacgtgcaaagacacacataggctcaaaataaagggatggaggaatatttagcaagcaaatggaaagcaaaaaaaagcaggggttgcaatcctagtctctgataaaacagactttaaaccaacaaagatcaaaaaagacaaagaagggcattacataatggtaaagggatcaacgcaacaagaagagctaacctaaatatatatgcacccaatacaggagcacccagattcataaatcaagttcttagagacctgcaaagagacttagactcccacacaataatagtgggagactttaacaccccactgtcaatgttagacagatcaacgagacagaaaattaacaaggatatttaggacttacactcagctctggaccaagcagacctaatagacatctacagaactctccaccccaaatcaacagaatgtacattcttctgagcaccacatcacacgtattctaaaattgagaacataattggaagtaaaacattcctcagcaaatgcaaaagaactgaaatcataacagtctctcagaccacagtgcaatcaaattagaactcaggattaagaaaatcacccaaaaccgcacaattatatggaaactgaaaaacctgctcctgaataactactgggtaaataacaaaattaaggcagaaataaataagttctttgaaaccaatgagaacaaagacacaataaaccagaatctctgggacacagctaaagcactctttacagggaaattcatagcactaaatgcccacaggggaaaatgggaaagatctaaaatcaacaccctaatatcacaattaaaagaactagagaagcaagagcaaacaaattcaaaagctagcagaagacgagaaataactaaaatcagagtaaaactgaaggagatagagacacaaaaaaccttcaaaaaatcagtgaatccaagagctggttttttgaaaagattaacaaaagagatagaacactagccagactaatgaagaaaagagtgaagaattaaatagatacaatacaaaatgataaatgggatatcacactgatcccaccaaaatacaaactaccatcagtgaatactataaatacctctatgcaaataaactagaaaatctagaagaaattgttaaattcctggacacatacacccccccaagactaaaccaggaagaagtcaaatccctgactagaccaataacaagttctgaagttgaggcagtaattaatagcataccaaccaaaaaaagcccagaaccagacagattcacagctgaattctaccagaagtacaaacaggagctggtaccatttgttctgaaactattccaaacaacagaaaaagagggaatcctccttaacttactctacgaggccagcatcatcctgataccgaaacctgagagagacacaacaaaaaaaatttcaggccaatatccccgaggaacatggatgcataaatcctcaataaaatactaaaccaaatccagcagcacatcaaaaagcttatacaccacaatcaagtcagcttcatccctgggatgcaaggctggttcacatatgcaaatcagtaaacataatcctcacataaactgaaccaatgacaaaaaacacatcattatctcaacagatacagaaaagtcctccgataaaattcagcggcacttcatgctaaaaactctcaataaactaggtattgatggaacgtatctcaaaataataagagctatttatgacaagcccacagccaatatcatactgattgggcaaaagctggaagcattctctttgaaaactggcactagacaaggatgccctctctcaccattcctattcaacatagtattggaagttctggccagagcaatcaggcaagagaaagaaataaagggtattcaaataagaagagaggaagtcaaattgtctgtttgcagatgacatgattgtatattttgaaaaccccattgtctcagcccaaaatctccttaagctggtaagaaacttcagcaaagtctcaggatacaaaatcaatgcacaaaaatcacaagaattcttatacaacaataatagaccaacagagagccaaatcatgagtgaactcccattcacaattgctacaaagagaataaaatgcctagaatatgactaacaagggatgtgaaggacctcttcaaggagaactacaaaccactgctcaaggaaataagagaggacacaaatggaaaaacattccatgctcatggataggaagaatcaatattgtgaaaatggccatactgcccaaaggaatttatagattcaatgctatccccatcaagctaccactgactttcttcacagaatcagaaaaaaactactttaatatggaaccaaaaagagcccttgtagccaagacaatcctaagcaaaaagaacaaagctggaggcatcacactacctgacttcaaactatactacaaggctgcagtaaccaaaacagcatggtactagtaccaaaacagatatatagaccaatggaacagaacagaggcctcagaaataacaccacacatctacaaccattttttctttgataaacctgataaaaacaagcaatggggaaagaattttctatttaataaatggtattgggaaaactggctagccatatgcagaaaactgaaactggatcccttccttacaccttatacaaaaattaactcaagatgaattaaagacttacatgtaagacctaaaactataaaaaccctagaagaaaacaggcaataccattcaaacatgggcaaagacttcatgactaaaacacaaaaagcaattgcaacaaaagccaaaattgacaaacgggatctaattaaactaaagagcttctgcacagcaaaagaaatgattatcagagtgaacagacaacctacagaatgggagaaaatttttgcaatgtctctgtctgacaaagggctaatatacagaatctataaagaacttaaacaaatttacaagaaaaaaacaacgccatcaaaaagtgggcaaaggatatgaacagacacttctcaaaacgaagacagttatgcagccaacaaacatatgtaaaaaagctaagggtcactggtcattagaaaaatgcaagtcaaaaaccacaatgagataccatctcatgccaattagaatggtgatcattaaaatgtcaggaaaccatagatgctggatagggatgtggaaaaataggaatgcttttatactgttggtgggagtgtaaattaattcaaccattgtggaagacagtgtggcgattcctcaaggatctagacccagaaataccatttgacccattactgggtatatacccaaaatattatatatcgtcctattctaaagacacatgcacacatatgtttattgcagcaatattcacaatagcgaagacttggaaccaacccaaatgtccatcagttatagactagataaagaaaatttggcacatatacaccatggaatgctatgcagccataaaaaaggatgagtttatgtcctttgcagggacatggatgaagctggaaaccatgattctcagcaaactaacacaggaacagaaaaccaaacactacatgttctcactcataagtgggatttgaacaatgagaacacatggacacacagagggaaacatcacacaccagggcctgtcaggggatggagggttaggggagagatggcattaggagaaatacctaatatagacgggttgatgggtgcagcaaaccaccatgccatgtgtacgcctatgtaacaaacctgcacgttctgcacatgtaccccagaactgaaagtatattaaaaaaaaaaaaagtggagaaatctgaaaaaaaaaagacagttaatttacactaaagattaggaagatggtaaatgtagaatttttcctctagccagtacatggggaaacctgacatgatgacttcttgagatccttttaattctattataaaagcatagagctaggagagatatggattatctcaggttttcagagactaattatttcaagagtaatagacaaaggaaaatacccagattacttacctggtgagaaatctactaagttgttatagcaatctgaggccacatttttagaatttaagttattagtgagatgagatttctatcaaatacttctgagctataagcaatatgaaaggactgctaatataaaaattttctttattttcttggtcctcagcttttattcagtggtccttgtgaattgagtctggatgcctcaaaaagataaatgtttcagaaactaaaagtatggttattgaaagcctggtttataatcatttttaagtgggttttactagtctgacttcattcttttttggcttatttcactcagtctgctatttaatctttaattacaggccacaaaagaagtaatagaacgggaagcaccagggatggccctggcaatgctgatgggatcacttaatgttacacctctgggcatgctctctaggtaagaaagtcaccaacatgttgcaaaccatttgctaggtgaactgtttccgtgatattaaaaaaaatctacactttggcattgttgtgaatattaaatgagctagtccacataaagttcttagcttatactaatcacttaataaatattacctactatcattgttaaaaaaaaaagttaattccataccactaatcaatacactatattgatgaacctaagaaactttagtcttaacacttaagtttgccccttttttttccagagttaagagctttagtattctgtcagccacaattttcccacttcacttctttttgttgttgttgttgttgttgttgttgttgcttgttaagttaaactttcagagactgtcatattactactggtaaaagttatcaattcctaacccagagaatccagtttattactatgtaaagttactgttttctgtgactgtttataatcatcagttgatatctattaattgtaggtaaatactgatttaataaaactaaactgccaagtttattaaaataacttgttctcacaagttaggagcttatattccaatttataaatagctatgttgatgtgttgttgtgaaaaaaaagaagctcaattcatattgttaatcttttaatgcttggcaactgggtatattttaattattatattacattaatgatatactattattatatgaaattagtctacctaaaactatgcctttgttgacatagatgttgatatccatcctcgatttaatggtacttatttgctactattttagcaactcttagatttagatcccctaaatgaggacaattacatcacttaagttaaagatagaagtgtcaacttagtcagaaactgttgaaggatttaatgaacgttaattaatagttgatctcagagcaacctaaaaataaatagcagctgtatagtttcagggtttcataatttatagccctttatgtatcctgtgtgtaatatgaatataaaattaaatgtgtccattgactattatggaatatgagttgtaatgttctttctgttacatagacaaagtttatatcccatcagtggcagccacttgaagcacagatacaggagattatgaatgggtcattagttactatgttctttttgctgtcacgtgtactgtaacatttaattttagtaaaagcaaataaagaattaaagtaccacgatagagactaaagctaaaattcatgctggcctttaaggaactccagttgattctttcatagtgttctttttttaaaccattacttatattacctacaccaatgaggtcaggggatcccgtttttcctatggaattaagtagtagttttcaaacataaaagaactctttcttgtatacaagcaataacatcaggaaagaattaaacttcattctcttgctaattcttttgtaataaaattttaattcggtaaacataataatatgcttatttgccaagtcccatattaagcattagggatcctaaggttagaaagaaaaataagaaatggtcctctccttaaggatcccacagtttaaatggagaaattatttcttgcaactgttaagataattcttcaaattgaatgtagctttcttgatccagtatagaaatatcactttttgttatatcaaaaggttttcctgaattaatttttttctcccttttgtatcctcataattacctagcactggactgctgagtgaatggaaaattaattagcaggagctgattctaattactttggaatgagttgttcatctttatcctgaaggctttgaaaattaatacatataagcagcatgggagcaccttctggcttttctgtctgtgcattgctgatttaaccaagaatatatttataaactttggaacagacatagtagtttacattagttacagaaaaggggatatttccctgaatgttcattttttgtgcttctcaaagcctttttaaaaattattatttttataatagccatcattagattggttcttcctttctacagcctttctattttgtatgcacttctggctttgtacatgcttctgctatggaacatgtcatagtatattgtaattaattatttgcttgtctgtattacctagttagtagaaacttcttaaagacaggagctttatcttattcttttttacatcctcagcccctaaaacaaattctgacacatagtaagtactcaaaaaatgtatattgttgcagttactatggataaatcagtgttttaccatagttctatagcatgtttttttcaggtaaattaatgcatcaagttggtgccttaccttcctatttttatgtctagagagcagcattagataaaaacaaatgtttaaaccattacgtctgtttgaaatggtttcctactatttggacaacttaatatcctccagattttttatataagtaagttgggagatattatgaagtaatggttaagaacatcatctctgaagacagattgcttgtgttctatgttaatgtcttttttgttttcattttctcatctatataataaagatgttaatagtaccaaatttcttggataaagtgaattaatctatgtaaagcacttagaaaactgactcgtagtaactcttaagtgatgaccatggttgtttcgttagagtttttgtttttagagtaggtctgctggtgaaaccttttcgtagcttttcttcattaggaaatgtctttatttccatattactcctgaaggatattttcactagatacagaaatctgggttgactgttcttttctttcagcattaaaaaaaaaaaagtaaaataaaatatgattccactctcttttgctccatggttcctgaaaagaaatgagcaatcaattcaaattgctgtttccttatgtgtaatggcaaatttctctggctgctttgaagatattttttctgcagctttagtttcagcaatttgattatgatgtatctgggtgtagttttcttttagattatccttctgggttcagtgaactttatgattctgtaaatttatgtctttaaccaaatttgggaaatttccttttttttgctgctcctatgacatgaattttagattttttggtaatgtctcacaaatccctgaggctctgttaatttttaaaatcttttttactctgtattaattttaggttatttctatgatctatcttcaaattagctgacttttcccctctttcatcttcattctgcctttgagaatatctagtggtttttatttcagatatattttcagttctaaattctccatttggtttttttgttaatggtttccatttctctactaagaacttgtatttttacatttatttcaaaagtattgccctttatgtcatggagaatagttataataactgcttaaaattattcttcggacaatttcaatatctggcttaccttggggttgacatcggttgatttcttttcccatgagaactggtcaaattttccttgttctatgttgagaaattttggattgtatcctggacattttgaacactgcattgtaagtaaattatttaactcctgttaaaatcctttggggaattttaattagttagttttagcaattgatctgattgggttcagattgtaaattctgtctcactttctgtgggtagtggctcagcctttgctatattgttagtgtctgcccagtacatgaatgatttaggagttagtttgagacttgggcagtagtatatactaggtttatgttttaaaatcttttcttgtacttattttatactgtcccacgtattcacagctcagggatgaccctggaacttgggtcaattcacatccaaaattagagaatccaccttctttagctctcttcttttcaagaattttcccctcactctccagcttccaggggaccccattcccagttactctggccagaagaggtttcttacagagtattaactccctttgcaattatgtagttgtacacaactgacctttgggacaaagagcaaaagaaaagaaaaaagagagaaagagattcctcttaccttagttctttagacaatatcggctccttttttttgtttccattagccaaagagataggtaggtcttctctctgagctttgggtgctaacactgtcattatggtattgcagctccacaattaggcctagccccattaagagctgttattcaagttctgacttcagtcccaaatctgcctgctattatttacattaaacgtcatcaggtaatcactgtgtactctataaacaatcggtaggagagagaagctatggttactttctccatcttggctgacaccaaagaacaagtgttcaaactttaataccagatccctgacttcatatttactagcatttactagcagtgttaccttggtactttacaaggtttagcacatcttgttccagtggttaactaaactgcccacaaaatagtagcatttaacctccctaaatttataatttattccctacttgtttttttttaaaagatcaaatactcttttttccccctaaatttcattaaaaacaacagactaaccactgtggttatacactgaagaatgatttgtcatggattttattctcagttttgtcattaatttgatttatgatctctacttagttttatagggatattacatagctgatagaaatgttatgaggtcctttaaagatttactcacacatatgtgtgtgtgtgtgtatgtgtgtgtgtatatatatatatatatataaaataagaaatatctaattcataaaaagagaaattgattgccagttttccattttagtatgaagagatttaccattgtaatcttcagtgactcatctttcaattctgtaactgtaataaacacatgcactgcttttagggaggagataatattttccatttgctgccaaaaatggttttataactgatattggttaaaagaaaaatttcaggaaataacaacacaaaacttattttttatagaaatgaatcaaattattcttagtattatttagataatattaaagtaacatgagtcatttaaagtaacagtactatcatcttaaagagtttctgtttttttaacccacaccaaatatacttagcttataaaagtctgtaggggagcataagatggcagagtagtatatataggaatctgtttctccacctggacaaccgtttgaactggcaggatctctctgatataactattttggaactttgtagtctattcaaaggcttatggcttactggaaaagacttgactagtagattttggttaatttgggtcaattttaacctagtgtgctactagccaaccattctccagtgctccagctagcaggtactagggtttataggacagcttgtagaagacagaatgggtaattaaggaccttatcttccaaatattggggatccaggttctattgtggattactgctttaggttgtagaagtgcagaggcaaagacaggctgccattgtttcaacccacactggctgaagtatcttcaagggatttataaggacagtacctacattttcccctacatttttcttcttctcttttgggacccagaaattacaggattagaaaattcaaaggcagctacatatatgggggaatttagaaagtcactatgcatgcccagaggaaaaggcaggctgagaaaaagagaaaggccttaagtttatacctcaggcttatttcttacacagaacactttataacaatttaaaaaaaaaaaaaagcaaaccctagggaagggagagaagctgatttctagaattaccatattataagattcaaatattcagagttcaacaaaaataaaatgacaaagcaaagaaaaagtatgatccattcaaatgaaaacaataaattgacaaaaatccatgaggaagatgaaatggagaacttactagacaaaggctttaaaacaactatcttaaagattctcaaagaactaaaggaatatattgataatgccaagataatgatgtgtaagcaaaagtaaatatcaataaatatattttaaaaacataaaaaaagaatcaatcaggcagctaaaatgacctatcagtttaatatcatcttttaaggccatgatgggactgtccataatcaggcttctctccactgtatgcaggaggaagtggccactattaacagccctccctttttgtagcattagacagcaacaggccaccctgagattatttacagagaacagctataaaaacacttgcaaatatattcagtccagactagaaaatacttttcccccatgagtgtgaagattcatattgtaggctagtaaatctctctgcacatgttcatcatgacaatgtactcaggagttctaagtcatgatgagcatcctgcagcagttccagtgaattatggatgaaaaacatgtatcctttaaaaaaataaagaagaaaaaaaaaagaataatgaagaaatgagttgacaagtacaatcgctgaaaaaaaatcattagtgggattcaaaagcagttttcagcaggcagaaaaaagaatcagcaaacttaaaggcaaaacaattgaaattaacaaatctgaggaacagaaacaaaaaagatggaagaaaactgaacagagcctaagggacctatggaacaacattaagcagaccagcatacacattatggggattcaagatggatgagtgagggagaaaggggcttaccagagcaaagactcatgaacactaataagcgtgggaaactgtcaggtaggcaaacctaaactgtaattgacaaattgctagaggttcagtgcagacaactatgagagttaaaaacttcagggaaactcagtcgctacaattttgtgaaaactgaatggaacctaagggatctctggaacaagtccttcggaacaaccaggttctcacagtaaatattagaggaaaattccctcatgtttcagcagggaagaggaaagggaactattgtgaaatacaccagggtactctgttcttcttaatgagccctaacccgaggagaaactacttaacctgaacctaccctgctggagtataatcaaatactaacttacctaggggaagggaaatacccaacttcagctcactgtagccatcttctcccatgtaacaggggaggaaaaattgagaaaaactcgtgaagttcactaaaagcctcactaaaagactgagacctggccaggcatggtggctcacacctataatcccagtgctttgggaggccaaggcaggtggatcatgaagtcaggagattgagaccatcctggctaacacagtgaaacctcatctactgaaaatacaaaaaattagctgggcatggtgccacgtgcctatagtcccagctgaggcaggagaatcgcttgaacctaggaggtggaggttgcagtgagctgagatcgtgccactgcactccagcctggcgacagagcgagactccatctcaaaaaataaaaagaccaagacctaatgataggactatagaatacttccccacccccacacatccccaccacattactagaggcctgtctacagcagttccttttacctggtatatcatgtttggctatgaagaaaaattacaaggcatatcaaatggcaaaaaaatacaatttgaagagacaaagcaagcatcagaagtagacatggcaggaatgttggaattatcagtctgggaatttaaaaatcattgtgattaacatgctaagtgctccaatggatgaaacagataccatgcaagaacagatggataatgtaatcaaagacatgaaactcctaagaaccaaaaataaatgctagagatcaaaaacactataacagacataaacagtgcctttgatgggcttattagtagaatggacacagctgaggaaataaaaaactcttgagcatgaggatctctcactgcatacctccaaaactgaaaagcaaagagaacaagttctgagaaacgaaaaaacagaacagaatatcaaagaattttgagacaactctaaaacgtagaacatctacataatgcgaatacccaaaagagaagaacgagaaaaacagaagaaatatttgaaacaatgaccgagaatttccccaaattaatgtcagatgtcacaaaaacaactatacctagacataccatcttcaaactagagaaaatcgaaaataaaaaatcatgacagagtccagaggggaaaaaaactccctatctatagaggaagaaagataagaattacatttaacttgtcctcagacatgcatttaaaaaatcagtctatgatttggggcatacagtatgtaaagatgtaatttaagacatcaataactaaaaggggtgagggacagagtagtataagagcagaggttttgtatgctgttgaagataagctggtataaattcaaattattactttaggatgttaaatgtaatcttcatagtggccacaaggaaaataggtacaggatgtacattaaaaaaatgagaaaagaattaaaatatttcactaaaaaaaattaagaacaaatgaagatagtaatgtaggaaataaggagttaaaaagctataaggcatatggaaaacccttaacaaaatggtagaattccctttttgtcactaattactttaagtgtaaatggattaaactttccaatcaagagacagagattaatggactggataggaaagcatgatccagctatatgctgtctacatgagactcattttagatccaaagacataaataagttgaaagtgaaaggatagaaaaagatagtcaggcaaatagtaaccaaaagcgaaccatggtggctataataatatcaaataaattttaaatcaaaaatgtttaaatatcttaaatccaaaaagtttacaagagacaaaggatatatgttactagaaggtttaattctgcacagtaatattatacttataaacatttatgcacttaataatagactgtcaaaatagatgaagcaaaaatggacagaattgaagaggaaaatagacagctatgcaagaatagttgaggaattcaatatgccacattcaataatggatagaacagccacacaaaaggtaagtaaagaaatgtaagaacttaaacaacacaataaaccaactagatacaacccacatatataaaacacttcacccaacaacagtagcatacaccttctgaagtacacatgggacattctccaagatagagcacattaggctacaaaataagtttcaataggttttttaaaatagatgccataaaaagtatattgcaaaatagtatattcttcaaagcatattctccaaaaagaggatgaagttcgaaatcagtgacagaaggaaaaccggaaaatttacaaatatgtgaaaattaaacacactcaaatagccaataagttaaagaagaaatcataagggaaattagaaaatatttaaaagtgaattaaaacaaaaatgcaacataccaaaacttcatagcatgcagaaaaagcagcactgatattgctgtaagcatttaaaaaataattacatttttgaaaacctcaaaaacagcagtctcatgtataactataagttaagaaactagaaaaagaataacaacctaaacccaaagctagcagaaagaaggaaataataaaaattagagcagagataaatgaactagaaaatcaaaaaacaatagagaaaatcaactaagctaaagttggttcttcaaaaagatcaacaaaatcacaaaattttagctagatagactaagaaaaaaaaagaaactcaaattactaaaatcagtaatgaaaatggagtcattagtaccaattccacagaaataaaaaggactagaagagtacagcgtaacaattacatgccaacaagttgaataacccagacgaagtggacaaactcctagaaacacaaaacctactgagactgaatcacaaagaaatagaaaatctgaatagacctatacctaggaaggagaatgactcagaaattaacaacctctcagctgggtacggtggctcacacctgtaatcccaacactttgggaggccaaggtggatggatcacttgagcacagcaaaaccagcctgggcaacatggcaaaaccctatctctactaaaaattcaaaaaattagccaggtgtagtggcacacacctgtagtcccagctactcaggggtctgaggcaggaggatcacttgagcccaggaggtagaggccacacagtgagccctgatcatgcgcactgcgctccagcctgggcaacagagtgagaccctgtctcaaaaaaaaaaaaaaaaaaaaacctttctatctttctatttacaaaataccaggaccagttggcttcactgatgaattctaccaagtatttcaagaacaactgacactggttgtttccaaaatcttttccaaaaaattgaagagaagacaacacttcctaactcattttatgaatggcagcattggtctcataccaaagacaggaaaaacaaaacaaaactgcaggccaatatcccttaatgaatgttgatggaaaaatgctcaaaaaaaacccccagcaaactgattgcagcaacatattaaaaagaattatacaaggtgaccctagaatacaaggatggttcaacatatgaaaataaatcattgtaatataccacagtagcagaatggagggaaaaaaaaacccatgtgatcatttgatgatgggttttcagcatcaatgggtgctgaaaaaaaatttggaaaaattcaagtttcatgttaaaaacactcaacaaactaggaaaagaaggaaactaccttaatgtgaaaaaggccttatgtaaaaaacccacagctcacatcatattcagcggtgaaagactgaaagcttttcctttaaaatcaggaacaagatggggatgcccactttttccacttccattcaacatagtattggaacttctagccagaacacttaggcaataaacagaaatgaaaggtatccaaattggaaaggaagaagtaaacctatctttttttttttgacatgattatatatgtagaaaacccaagattccacacacaaaaccattagaactaataaatgaattcagcaaagttgcagaatacaaaatcaggctgcaaaaatcagtcttatttttatacaatgacaataaactatccaaaataaaatcaagaaaatggaatagaaacaagagcccagaaataagcccttgcatataggatgtaataattttcaacaagggtgtcaattcaatgggggagagaatagtcttttcaacgaatggtgttgggaaaattggatatccacttgccaaagaatgaagttggacctttgcctactgaatataaaaattaattcaaaatggatcaaagacctgtacacaagagctgaaactaaaaaactcttagaaaaaaacatagggggacagcttcatgacattagatttggcagtcatttcttggatatgacaccaaaagcataggcagcaaacaaaaaactagataatttggactttatcgatgttgaaaatctttgtacattgaacaaagtaaaagggcaacccatggaatcaagaaaatattcacaatcacatatctggcaaggtattaatattctatatatatatattttttttaattcctacaagtcaataaagaaaatgctatttaaaaacaggcagaagactcaaatagatatttctccaaagaagatacacaaatgactgataacatgaaaagatcctcagcatcaatagtcattagggaaatgcaaatcagaaccacagtgatatacaacttcacacccattacgttggctgttatcaaaaaaataataataaataagtggtggcagaatgtttagaaacattgtgtattgctggtgaggatgtaaaactgtgcaactgctatgggaaactatggcatatcctcaagaaattaagcatagaattatatgacccaggaactccacttccaagttacatatccaaaagaattgaaagcaggggctgggtgtggtggtttaaacctgtaatcccaacactttgggaggctgagacaacaggatcacttgaggccaagagtttgagaccagcctgagcaaaatagaccctgtctctacaaaacttgtttaaaaaaattagccagtcctggtgacacacacctataatcctagctactcaggaggatgagggaggagtatcacttgagccccggaattcgaggttacagtgagctgtgatcatgccactgcattccagtctgggcaacagagtgagactgtctcttaaagaattgaaagcagggactgtaatagatatttgcacgccaatattcataacatcattattcaccttacccaaaagttggaagcaacccagatgtccattgattgatgaatgcataaacaaaatgggttaaatacatggaatgaaatattattcagccttaaaaattattgttaattctaacacttgctacaacataaatgaatcttgaaaacattgtgctaaatgaaataagccagattatataaggacaaatgtgtgattccacttacatgaagtatctagaataaccaaatgcataaagaaaatagaacagtgcttatgagtggatagcgagaagagaatggagagtttttgtttgggatgatgaaaaagttctggagatggacagtggtgatggttgcacaataatgtgaatgtacttaatgccactgaattgtatacttaaaattagttagaatggtaaaggttatgttatgtatattttaccagagttccttttatagctataggacaggaaatgcaacatacataaaatgtacattttcttgaaacatttctgcagtgtttcaggcccaacttccagactccagtatgacaggaggtatactgggtttcaaaagacaagtgacacagatggtgtgaggaccacctcaacacaggagagctgacacctttctccttctctcacccaacttttatattttcctaaatatcatagcttcataacagatttgtgatagctggacttatttgttataactcataaaataggaactctgggcaataggaacagctccagtctacagctcccagcgtgagtaacgcagaagacaggtgatttctgcatttccaactgaggtaccgggttcatctcactggggctcatcggacagtgggggcaggacagtggttgcagcccactgagtgtgagctgaagcagggtgaggcattgctatttatgacaaacccacagccagtatcatactgaatgggcaaaaactggaagcattccctttgaaaactggcacaagacagggatgccctctctcaccactgctattcaacatagtgttggaaattctggccagggcaatcaggcaagagaaagaaataaagggtattcaattaggaaaagaggaagtcaaattgtccctgtttgcacatgacatgattgtatgtttagaaaaccccatcgtctcagcctaaaatctccttaagctaataagcaacttcagcaaagtcttaggatacaaaatcaatgtgcaaaaatcacaagcattcttatacaccaataacagacaaacagagagccaaatcatgagtgaactcccattcacaaatgcttcaaagagaataaaatacctaggaatccaacttacaagggatgtggaggacctcttcaaggagaactacaaattactgctcaacaaaataaaagaggatacaaacaaatggaagaacattccatgctcatggataggaagaatcaatatcgtgaaaatggccatactgcccaaggtaatttatagatttaatgccatccccatcaagctaccaatgactttcttcacagaattggaaaaaactactttaaggttcatatggaaccaaaaaacagcccacattgccaagacaatcctcagccaaatcctaagctggaggcctcacactaccagacttcaaactatactacaaggctacagtaaccaaaacagcatggtactggtaccaaaacagagatatagaccactggaacagaacacagccctcagaaataataccacacatctaccactatctgatcctgggcaaacctgacaaaaacaagcaatggggaaaggattccctatttaataaatggtgctgggaaaactggctagccatatgtagtaagctgaaactggatcccttccttacacattatacaaaaattaattcaagatggattaaagacttaaatgtaagacctaaaaccataaaaaccctagaagaaaacctaggcaataccattcaggacataggcatgggcaaagacttcatgtctaaaacaccaaaagcaatggcaacataagcaaaattgacaaatgggatctaattaaactaaagagcttctgcaaagcaaaagaaactaccatcagagtgaataggcagcctacagaatgggagaaaatttttgcaatctactcatctgacaaagggctaatatccagaatctacaaagcactcaaacaaatttgcaagaaaaaaacaaccccatcaacaagtgggcgaaggatatgaacagacacttctcaaaagaagacatttatgcagccaacagacacatgaaaaaatgctcgtcatcactggccatcagagaaatgcaaatcaaaaccacaatgagataccatctcacaccagttagaatggcgatcattaaaaagtcaggaaacaacaggtgctgaagaggacatggagaaataggaacacttttacactgttggtgggactgtaaactagttcaaccactgtggaagacagtgtgtcgattcctcaaggatctagaactagaaataccatttgacccagccatcccattactgggtatatacccaaaggattataaatcatgctgctataaaggcacatgcacacatatgtttattgcggcactattcacaatagcaaagacttggaaccaacccaaatgtccatcagtgatagactggattaagaaaatgtggcacatatacaccatggaataccatgcagccataagaaaggatgagttcatgtcctttgtagggacgtggatgaagctggaaaccaacattctcatcagactatcgcaaaaacaaaaaaccagacaccgcatgttctcactcataggtgggaattgaacagtgagaacacttggacacaggaaagggaacgtcacacaccggggcctgttgtgggatgcggggagcggggagggaaagcattaggagatatacctaatgtaaatgacgagttaatgggtgcagcaaaccaacatggcacatgtatacatatgtaacaaacctgcacattgtgcacatgtaccctagagcttaaagtataattttaaaaaatatgtttattttaaataaaaaatggaaataatatttttgaagtaaaatgatttattgatgaaaaatacttgaaacagaagatactagaataatactttcaatgtgctgaaagaaaataacatttaatcaagaattttacactcagcaaagttaccattcaagaatgggggaggatgaaatgtcattttcctacaaacagaaatgggaacattttatcaccaaaagaacctcacgtaaagaattttaaagatatactctggcagaagaaaaatcatctcagatggagagttgaggatacaggagggaaaagagagcaaagatattggtaaatatctgaacaaatcttttttaaaaaattgactattgtcctggtccattctgctgctgtaacaaaataccttagactgggtaatttataaacaacagaaatttattgcttacagttctgggggctgggaagtccacaatcaaggtgcccgcagattcagcgtctggtgaatgcttcaaagatggccctttcttgctgcatcttcacgtggtagaaggggcaaactagctcctgacggcttcttttataagggcactaataccactcatgaggacagagttaatcacctcccaaagtcctcaacactttatactattgcactggggattagatatcagcatatgaatttggggtaaacaaaaacatttagacaatggtaactatataaaacgataaaaataatgtctcaattatgggaagaaaaaatatgttagaattcttgaaaacagcatgtaatttgagatactgtgattatagttaagtattctaacaggccaggcacagtggctcacccctgtaatcccagcactttgggaggctgaggtgggctgatcacttgagtccagaagttcgagacaagcctgggcaatatggcaaaactctctttacaaaaagatacaaaaattagaccagcatgatagcacgtgcctgtagctactcgggaaactgaagtgaaagaatcacctgagcctaggaggtcaaggctgcagtgagccatggttgtgccactgcactcgcctggggtacagagtgagaccctctcttaaaaaaaatttagtcctattttctaggaagatattaaatattgattatagttttttaaagttaagtatgcatattaaacttattagggtaatcactaaaaggatggacggagtatacaacttccagaaatagagggaagaaattaatgaggaaaatacttaaagtaagataagaaagggagaaaaaaacaaacaaacaaaacaaaacaaaaaaaaacaaagacaagtagaaggcatatgtattggttaaaaaaagttataatacgaattcccagaacatcttccacttaaaattttcccatagaacactgcttagtttctcatattcaaacttgataaacatgtataccttcatgtttatctgaaaaacagcttcagctgatacatatgaaaattttatatttatatctgaaaaattcagtaaattttcaaaaaaattttattaaacttttaagatggtaatataattgtagattggcatgcagtataaggaatgatccagagaagtcctgtgtaccctttactagttttttccagtggtaacatcttacaaaactatagtacaaaattacagttggatgttgacattgataacatcatgacacaacaatttgttcattctttcatttgttcatgggtacttaggttgacttcatattttgcctgttgtgaatagtgctgcactaaatgtgggagtgcagatgtgtttttgatatactgatttcctttcttttagatatatacccagtagtgcaattgctggatcatatgataattctatttctagttttatgaggaaatttcatactgctctccatagtggctgtactattgcttttctattgtcattgcccttttattgccacaccacctctctgtcacccagcccccctttcctaaactctggcaaccactaatctattttctagttcaatattttgccatttcaagaatgaatataattagaaccatacagtatgtagccttttgggattggtttcttccattaagcataatttcctggagattcgactaaattgttacatggatcaataattccttacattttattgttgagtagtattccatactatatatgcactacagtttgttcaaccattttctgttgaaggacatctgggttgtttacagtttgtaattatgatgaacattacaccaaacgatgcggtatctaggttccatggcagttgcaggttttctgtttaaatgaactgtcaaattattatccagagcaactgtatcattttacaatcacaccaacaatatatgagtgtgtctccacaccttgccagtatttggagttgtcactatttttattttagccattttgatagttttgtaaatagttttaatttgcatttccctaatgactagtaattttgagcatctgttcaggtgttttgcctattgtctgactgtgttttttagtttttttatccctgatttttgagagtttttatgtgttctagaaacctgtccttcgtcagatatgtggattgcaattgttttctcccagtcaatacattgtcttttttcctcttcacagtgtcattcacagagcaaaactacttaatttccatgaggtccaatttatcatctttttcttttagcagttgtgtttttttgatgtaaagtctaagcacccttcacctaggcaaaggtccaaagactttctcctgtgtttttttctaaaacttttataattttacattttacctttaaatccatttgagttgatttttttctaaggtgtgagtttaggttgaggtgttttttcgtttggttggttggttggtttttgtgtatgaacgaccacttgctccagtgctacttgtttaaaaaaaaaaaaaaaaaaaaaaaaagctacctttcctctgttgaatggcttttgcacctttgttgaaaattaatctggcctattattagtttagttctagttctggtttctctgttctgttctatatgtctgtccctctgtcagtaccacataatctttatcattgtagctaaacaataagtcttgaaattgcatagacagattcctcccactttagttgtctttttcaaaatttttagctattttggtcccttttgttttccatgtaaattttagaataagtttgtctatatctacaaaaaaattgctcagatttttataggaattacattaaatctggatgtaaatttgggtggaagtgacatcttttccatgttgagcctccatgaacacattatgtctcttcctttagattgtctttgatttcttttattgcagttttcagtataaaaagtctgaacatgtttcgttagatttacacttaagtatttaattgtgttttcagttattgtaaatggtgttttattattaatttaggtgtccacctcatgttcattgctaatatatatagaaatacaattaattcttggatgttgattttatattctacagccttgcttaattgctagtactattaattctaggagggctttttcttttttttttttttgttttttgttttgtttgttgtttgttttgttttattctttgggattttctgtatagacaatcacatcatctgcaaataggggtagttttacttcattctttgtgatttatatgccttttattctttttctgcctgttgtcctagctaaaacttccagtgctattttgaatagccatggtgaaaatggatatccttgctcttttcctgatcttggggagaaagcactcaatgtttcactattaagtatgttagttgtacatttcttataaaagctctttttcaaattaaagaagtccatcccttaatttctacattttttgagagtttttatcatggatcagtgtttgattttgtccggtgaatttcctgtgttaattgatatgattgcatgatctactttttcttcttagattgttgatatgatgcatatgttgatttattttcaaatattgagctggtcttgaattcttggagtaaacccacttggtcctagtatatagttctttttacttattcctgacttctatttgctaatattttagtaaggatttttatatctatattcataagagatactggtctatatttttcttttttatactatcttcatctgattttggtatcaagttaatactggcttcataaaatgagttgtgatattccctccacttttactctctggaagagtttatgtaaaatgtatattaatttttctttaaacatttcagagaattcactagtggaaccatctgtcctagagctttatttttctagagtttttttactataaattgaattttcttaaaagttacagggctatttatctattttatatatggttaatgtagtattttatgctttttgagaaatttgtccatctcatctaagttgtctaatttatgtatatagatttgctcctagtattctcttattgttattttctcgtcttgagagtctgtattaatacgcctgtttcattcctgatattggtaatttccatctttttttcagtcttgcttaagatatttccattttatttatcttttcaaagaacaagctttttgtttcattgactatctctgtttttctgttttaaatttcactgttatctgctctttattatttcattccttctccttgtttggggttcattttgctctttatctagttcttgagctggaagcttgttattgatttgagacttttctaatgtaaactttaggagcactgatttaggtgcattccatgaatttgatatgttatatttgcatttttattcatcttaatgtatctttttattttttgagatttttttcttttttttttaatctatctaacactaggtcttatttcttctatcaaacttcatatgtgcccatcaatcaacttctcatctttccctcctccccactacccttcctggcccctggtaacaaccaatctactacctatcctcatgagattcacttttttagcccccacattatgagggagaacttgcgacattcttccttctgtgcttgccttgtttcatttaacataatgacttttagttccatccatgttcctgcaaatgataggatttcattttttaatcagtgaataatgttccattgtatatagatactgcattttctttatccatttgtatgttcactggtacttaggttgaatccatattttagccattatgaatagtgctgcagtaaatgtgagagtgcagatgtcttttcaatatgttgatttcccttcttttggatatatatccagcagtgcaattgctggatcgtatggtaattctatttctagttttatgaggaaattccatactgctctccatagtggctctactaatttacatttccaccaacagcgtacaaatgtttcctgttttccaaatccttaccagcatgtgttactgcctgtctttttgataaaaagccattttaactggagtaaaatgatatctaattgtagttttggtttgcatctatctgatgattagtggtgttggccatttgaatgccttctttgggaaatgtctattcatatagtttgctcattttttaattgaattatttgttgtttttgttgttgttgttttctgtcaagctatctgagctccttagatagtctagttattaatcctttgtcagacaggtagtttgaaatgttttcttccattctgtgggttgtctctttgctttcctgattgtgtcctttgctgtgcagaagctttttagttttgtataaccccatttgtctatttttgcttttgttgcttgtggttttgaagtcttagacaaaaatctttgcctggaaagatgtcctggagcatttcctcagtgttttcttctagtagtttcatgtttcaggtcttagatttaagtctttattttgatttgatttttgtgtatggtaaaatataggggtctaatttcatacctctgcaagtggatatccagttttctccacatcattaattgaaaagacaggtctttccccattgtttgtttttggcacctttgtgaaacatgacttggttataaatacatgaatttatatttgagttccttatcttccccattggtctcgcatatctgtttggtgtcagtaccatgttgatttggttactatagctttgtagtatattttggagtcaggtcatgtgatgtgatacctccagctttgatttttttgctcaagattgctttggatattaggctcttttgtggttccatatgaattttaggattgtttttatatttctgtggaaaatgtcattgatattttgatagagattccactgaatgtctagattacattgggtactatggtcattttaacaatattcttcctatcatgagcatagaatatatttccatttttttatgtgctcttcagtttctttcatcaatgttttatggttcttcttgtataggtctttcacttctttggttgaattgattcctagttattttatatctttggagatattataaatggggttgctttcttgatttcttttttggattgttcactattggtatatagaaatgctactgctttttgtatgttgattttgtgtcctgtaactatattgaatttgtttatcaattccaacagtgttttagtggagtctccagatttttctaactataaggtcatgtcatctgcaaacaagtctactttcacttcttctcttccagtttgaatgccctttgtttctttctcatgcctaattgctctggccaggacttccattttgaaaaaaagtagtgacagtgaagatccttgttttgttccagatcttagaggaaaggcgttcaatttttttccttttcagtatgctagtaactgtgggtttgtcatatatggtctttattatgttgaggtatgttccttctatactcagtttgaatgagggtttttatcataaaagcatgttgagcttcattaaatgtttttacagcatatattgaaataatcatagggtctttattcttggttctattaatgtagcatatcacatttattgatttgcatatgttgaaccatccttgggatgaatcccacctgatcatggagaatgatctgttcaatgtgttgttgaacttggtttactgacattttcttgagaatttttgcatttgtattcattggggagggtggcctgggtttctctttttgttttatcctttttggttttggtgtcagggtaatgctggccgcatagaatgactttgaaagtattccctcctcttcaattttttttagaaagtttgattagaattgctattatttccaaactaccatcagagatactataaatacctctacacaaataaactagaaaatctagaagaaatggataaattcctggacacatacaccctcccaagactaaaccaggaagaagaaaagaatgtgtattctgcagcagttgggtgaaatgatttgtaaatatcagttaggcatattaggtctggtgtatagtttaatttggatggttctttgttgattttctgtttagatgacctgttcactacagagagtggagtattacagtcccctactattattgtattgcagttatcccttaagatctattaatgtttgctttatatacttggcagctccagtggtgggtgcacagatatttataattgttatatcattttgctgaattgacctctttatcattatataatctcctcctttgtctatttttacagttgtttacagttatggctacagttgttacagttacagttgttacagttacagttgttgatttgtagtccattttatctaagtataactactcctgctctgttttggctcccagttgcatggaatatcacttttcaccccttcacttacagtctatatgtgtctttagagacgaagtggatttcctgtaggtaacacatagttgagtcttatttctttatccattcaggcactctatgtctttgccttggagaagtgagttaatttacattaaatgttattattgataagtaaggacttactcctgccatttgtcatttgttttctggttgttttataactcctttctcccttttttactttcttcatatgtggtttcagtgattttctctggtagtatcttttaatttgttgctttttatttttagttaatctgttgtaggtatttgcattgtggttaccatgacgcttataaaaaataccttataacaagttattttaaaaagatgacaacttatcttagatcacagaaatgggaacagaaactgaaaaaatgggaaaaatcttttacactttacttccatcttccccacatttagactcgtattgtctcaatttgcatattttatattacctatctcttaacaggttgttgtagctcctattgtttgtgatatatttatctattcgccttcatactggagttatgattgtgtgtccagagttggttccttccggtgggttcgtggtctcgctgacttcaagaatgaagccgcggacctttgcagtgagtgttacagctcttaaaggtggcgtggaccaaaagagtgagcagcagcaagatttattgtgaagagtataagaacaaaccttccacagggtggaaggggaatcaagcaggttgcccctgctgactagggttggccagcttttattcccttatttgtccccgcccatgtcctgctgattggtccattttacagtgtgctgatttgtccattttacagagggctgattggtccattttacaaatctctagctagccacagagcggtgattggtgcgtttttacagagcactgattggtgtattttacaaacctctagctagctgtagagcactgattggtacgttttacaattctagctacagagtactgactggtgcattttacaatcctcttgtaagacataaaagttctccaagtccctggttgacccaggaagtccagctggcttcacctctcaatgccccctttagacaggacaccccaactgctgttgggaattgggcgatgcttgctctagctacttcctgctggaaaggggcacagaaggggccctacagtggtagtgtcctccagaggggaactctctaggccagccaaagggtcagtgggttggtccaggggtcctcggtagaagttgttcattgagctcatttggggttccattggtaagacatcttactgcttttaggattctgtcttcattcatgacctctgattgattattgtatgccttggagtagtcttatttgggtcctatccatttggtgttctctgaccttcctgtacctgaatatttatatccttgtgaagatttggaaagttctattattatttctttgaataagctttctaccccttgatcttcctcaactccctcttgaacatcaataaaataatttctagatttgttgttttgatgtgattttctgtatcttaccggtgatcttcattgctcttcatgctttttgcttttttcttctctgtgtattttcaaatagcctatctttgagctcactgactctttcctctgcttgatccattctactgttgagagcttctaacgaacttttcagttgaacaaatatatatctcagttccaaggttaatgtttggtttttaattatttcaatctgttcattaaatttttatcataaattttgaattgcttttctgtgttaccttggagatcactgtgttttcttaaaactactattttgagctcttggttagggagctcacatattgctgtttcattagggccagttactgtttcattgctctgtccacttgggaagatcatggtttcctgtttactattgtttcttttggatgtatgtacatgtctttgcattggaggattagttatatttattccagtgttctgtctggcttgtttcgcttttttgtgtttgttttttataatctcaacttttagattcaggggtacatgtacaggtttgttacatgggtatatcacataatgctgaggtttgtggtacaaatgatcccatcacccaggtaatgagcgtagtatacaaaaggttgtttttcagcccttgccccgctccctctctcataccttggtagtccccagtgtctattgttcccatctttatgtccatgtgtaccaaatgtttagctcccacttacaagtgagaacattcagtatgtggttttctgttcctgcatgaatttgcttatgataatggcctccaggtacgtccatgttgctgcagaggacatgatttaattccttttatggctgtatagtattccatggtgtgtatgtatcatgttttctttattcaattcaggatatatttgattcgaggcttttttttttttttttaccacttccccattttcagtcctaggtgacacattatccccaggttcacctaagctctagtaaatgatcagaatgctacccttctcgggtgagggaggtgaaacatggtatatccttccagtgtaggaaagctaagccagtgtttcgtgcccagggaacctgtgggatgcacctcctacagcgtggtactgctgaacagccatcatgatttagcatctcctttggctgagtttatgagcagagtttccagggtcagagactataatcccacctcctccctttgtctctgcctatcctcaggtatatttgttccttcagacacttgtgatgcttcccatgggttaaggcagggacaggtctactgccagggcatgcaaaatgatggaaagctggctgttcaccttgatctcactttttccaatgttaaaacagtaagttagaggaaaattttctacatgcttcgtgcaaggcaggatggggaggaggaacatcatggatgtggaaatctgatattcttactgtctgttcagagttttttcacttctttctggccccagggccacatctcatcttcatatttgagttctgggatatttctagtgatattctctgtgctgttcatttgcttttggtttcctgttgagaggagtgaagtcagcctgctcgtacattgccattttgaaaccagaagtctctggtttcttgagatttcctctttgatccatagattattcagaagtttatggtttagtttccaagtgtataggaattttcctgttatctttctgttactgatttcaactttgcttccactgtggtcagagaagttactctataatttcaattcttttaaatttgtttaggtttatttttatggtcacagatatggtctatattggtaaaaacaatgtgtattattctgtcagctggagtgttctacaaatatcaattcgatcctgttgatttgtgttgctgagttcttctatatgcttgctagttgtctgtctagtcattctatcatataccattaaagtgacttgtatccaaaatatacagagaacttctagatatttaaccaatttatgtgaaaacttacatccacacaaaaatccacatgcaaatgtttttaacagccttattcgtaattgccaaaagttggaatcaaccaagatttacttcaataggtaaatggataagcaaattatgctgcatccatacaatggactcttattcaataataaaaggaaatgagccatcaagcaaccaaaaaagacatccttacatgcatattgctgagtaaaagaagccagtgtgaaaagaatacatattatatggttctaactttatgacattgtagtaaaagtaaaattataagaacagtaaaatgatcagtgtttgcccagagtttttgaaaagaaagatataggtgaatggataaagctgaacagattttttagagcagtaacactatttgatatgaagtagaaatacggaaacatgacattatacatttgtcaaaactcatagaactttatcacaaggaaggcttaatatatgcaaattgcatttgatggatcccagaaagcaatgaggactctgccaagagaatttaaatgcattacaaaataaataaaacaacctcatggaagcgggtggaggggaaaagtactgacctaaataactttggatatgagtggagtctgtaagactaaaggtaaaagcaactgcacataagcgctttagttgataaagttgtatcccatggaggtatgggttaacaattctaattttaatatatatgtatactggaattgaacagttaataaatggatggcaggtagtgagacaggtttctcactgtcacagtgggaaatcacatatgtacaagcaaggggaagaggctagaatgatccatgtgatcctaggtaatgaattagagttggagacatcagtatgaactcatatctagctttaacatagatacaaatggttacatacagaaatatttgttttatatatatatatatgcacacacaggttagtttacacacgtattcctttgctttgtcagcagagagggtctaaaataaatgacatatcaatatgaaatgatataattaatgctgaaatcttagtttttattaccatttggcaataaaaggagcctgggttccttggagaagtggctgattctgggaccaaggcaggaaatatacaagatgaacctggtatatctcgtagtgcttaaaagtaaggaagcactcaagaaaacaaactacaacaaaacacacattggcgggtatatattaaaggggcataggagtcaattgacatctcccgatgaccaaagatgtaaaaatgtgagcaacaaaataagcaacaagcagtatcttattataatccaaagtataaaataaacatccatgactccatgcttatacaaataactttttgcacaaattaattcatgagggagaagagacaaatgtcctgtgcatataatttccaaataatttatatagatgctccaccctcaaggaaggggcacataactcctcacttcttaggcatgggctacatacagtgacttccttccaaagagtacagaactggggtcaggttggggaagagtaactttgctatggggagcacctgacaaatacctcagctaagagatcaagatcagtatcaacattcattagtcagattgatagcatatacctgtgatatgatgtaataaaaatggctgtatatctctatagtcttcttccaaaaatcccataaccctaatcttatcatcagaaaatatcagacagacaccagaagtgggcattctgcaaaaaaaaaaaaaactgaccagcacttaccaaagctatcaaggtcatcaaaaacaaggaaagcctgagcatctatcactgccaagaaaagcataaggagacatgacagctaaatgtaatttggtaatctgaatgggatcctgaaacagaaaaagggtattaagtacaaagtaagaagcatgaataaactgtgggctttagttaataataatgtgtcaatattggctcattaattgccacaaaggttccataataatacaagatgttaaatgtaggggaaacatggtacagagaatatgggaactccctatactatcttctgcatttttctgtaaatccaaaactgttcttaaaaatgaagtcaatttaatcaaataataacgggatattctatacaactgtcaaggagcaaatgatttcaatattatttaaattgttcctgagtgtagtaaaacgtaaacatttctcaattcatgttatgagtctgggataatcttattacaaaactagaaaatgatagtagaaaaaagggaaaatgtaggtgaatattcattgtgaacatggatgtgaaaacttcaaaaataagatactaacatatcaaatctaaaagtatatttttaaaagatacatcaggataaagatggatttatttcaaggacacaaagatggttaactgattaacatgaatcactgcattaacagattaagggagaaaagtcatatgaccttctcaattgatgcagaaaaagcatttgataaaattccaaacctgtttatgaataacgactcttagcaagcaatgattcgaagggaacttccttaatttgacaaagcaaatatagttaataattagatattgttagtattctctttaaagttaggaataagacagagtccaagtatacttctgtccaatattgtacaaagtaaaaaaaaaatgatacaagcattgaaaaggacaagtaatctcccatgattactacatgggaattattaaaaaatcagtagtcttttagaagtaatggaagagttcatcaagtttgttggatagaagatcaggatacatcagttgctgtcctataaacccaaggtgtattttttaaagggaccaaatttcatatttactgtttatttcatgatgtagagattgtaactgtaacagtttctgagcattcctcatttcatcaaaatggatttaataaatgtctaactggtgaagatactgtattaggtgctatacaataggttctatgcagaatcgaccctctagaagtttataattttggggcaccctgcactaacagacggaaatacactaactgcagaacagaaataataagccagtacatatatgaacactaaaatgtttagatttaagtttaaaattacaaataaagagactttatctcaacctttttattgtgaaaaatttcaaacatataccaaattgaaagaattttacagtgaatacttaagattctactattaacattttattgtagttgctttatatctgtcatctattcggccaaaagaaattaaaaaagaaaaacactgacaacatctagcattgtcaggagaagcagcaacagtgtgttgataggaatgtaaattggtacaaacactatggaaaattacttttatacagtaaaactgcacatctgcttattcctgtgactcataaaatctgcttctagctatttaccctagaacattagctttcaaatgtttttgaccataagccacagtaagaaatgtacttaacattgtaattcagtacacacacacatatgtatatatatgtctctatgtatgtgggtatgcatatatgcatatatatctacataaacaatatgcacacacatacatatacaaaaggcacaaacttttctgagtcaatatttatcctaacttccaggaaagcattctgatattttctgttctgttcttttttaaaaaatgctagttatggcaactgaagtcagtttactgccctgttaattggtcgtgacctacaatttgaagaacactgtcctagagaaagctgtgcacatatgtaatattgtgcagcattgaaaatgaactatagctatgcatatcagcatggaggagtttcacaaacacagtgttgagtgagaaaaccaagttgtataagaatatgcacagtatgatttcatttgtatataaatttcaaaagcatgctaaaatgaaaatatatttagataaacatatgtggaaaagttttttttaagtgaatgatttatataagcaccacatggatgaaccttgaaaacatgttaagtaaaagaagcaagtcacaaaaggtgacatattatatgtttccctttatatgaaatgtctagaataggcaagtctgtatggacagaaaatagcttagtgaatgcctagggctgggagttgcaagaaaatgtggaatgactgctaatgggtatgggatttttttgtggagggtgatgaaaatgttctaaaatggattaccaggatgattgtacaactctgagaatatactttaaaaactattgaattgtatcctttaaatgggtaagttgtatggtatatgaattttatattgatagagctgttttacaaaaaagtaagaatgttttaaaattcaggataatagttatttggagaagaagggacttgagatcaagtcaaggcacgcagtactctttgaaagtatcagtgatagtctattgcttcacctaggtagtaggcacatcagtgggatttttattgttattgtctgttttatacacgtcataccttgttgtgtatttaatatttaacagaaattttaagagaagcaatatttttcatattcttctattctcatgcctgttgtgatcaagtttaacatagaatattgaacttctagtgtaaatctagattaggaccagttttcatccaaatatgtcctgtttttaaaaattactctttttgtattaaactttcaaaaaaattggaataaaaaggtaactatcccattatatagtctgtgggtcagaatattcttaactataacctgttcgcttttcttcatcacctttgcaaccaccctaattcacctgttacatttttcgacattctcttaactgtattccttgcttcctttcttgcacctctccaaacaactttctactttgcagccagaaatatcttttgaaaatacagatattagtatgttatttctctgctcaaaattttttagcaaaatctcactctccactgtagataaagactgaattctttaagattactttccagggcctatatataatttgtcactgctgctttttgcatcagcttccacccacacttgttgttgtttttaccacacatatcaggttctattgttagcttctgagtactttgtacatgcccttttctctgccttgaatgttcttccttctctctttacctctgtaacaactaccagttcttcaggcagaagcttagattttttccttccttatagaagccttctcttaactacccctacccttccttacctaagactaaaatgcccttcctattgttcccaaaggatttttgcttaatatacatttacatttatttaaaatatgctttatattttatatacataaacaaaaacaatgcgctatgtaacatgctgaatcagatacatgagagaaaataaactaagaatgagtcaactcgtatttagtgttttttgttatcagactttcttttctttatatcttctgtcatcccctttcagttcatcttagactattattcctgaaatagtgcttggtaatattagtaatagcagaatccatgtatcatctccaatgccttaagaatacattctagctctttacagtgaattcatgacttctactgtcttaattctaatgtactttttaaggaaagatggaccaaatatttatttaatgcctattatgtactagattatactgtaccttatatttcaaagattatgttaacccttttaacaactcaggttatggaaactaaggattaaagaagtttagtaatgaagacaggattacactaatagtaaatagtagtaccaaaactcaagcacagtttatcacagcagttctcaaacttttccatggatgagagtcaactagagaacttgttaagatacagattactggaccccaccctcatagttttttatccaatatatcagcaacagagaggaggggataagggtggtatgggacattttgcctttccaacaaattcctgtatgatgcatatgtttctggtccagagaccacaaattgaaaaatactaatctgtcagacagcaacatctttccactggtccttcttagcctcatattactcctctataagtaagcaagtggatgcttgctggtgagagacaatatactcaaaatgcacttggtgctttttttaactctatgcttttgcattatttttcccctcctcctaaactgcccttctttttgatttttgttttgttttgtttttttgagacgaagtcttactactgtcacccaggctggagtgcaatggcacaatctctgctcattgcaacctccgcctcccagattcaagcgattcttctgcctcaggctcctgagtagctaggattacaggaacctgctaccacacccggctaattttttgtatttttagtagagacagggtttcactatattggccaggctggtctcgaactctgaccttgtgatcctcccacctcggcttcccaaagtgctgggattacaggcatgagccaccacactggctacttttttttaacctatggtactttataccaatttgtgttactacttactatcttgtgttgtagttgtttatatgctttaatgttctacattttacaattataaacttcttaagcatttgggttgcatttattccataatacttagtacagatctttagctatttgataaatattggaatatgctaaaactttggtgcttatagtttttaaattattgaatgatataatgtttgtaaaaatactttattaatcctaaagcattatatagaggaggagtactttcttcttgcagtgactctggacattctatagatgaaaaagtatgtcttaaaattaatttttaaacacttcaaagagatcagggaaatgagaaagaatacataaatctctgatgtaatgttttgacaaaatagtaaaaaaaaaaattgatgggaaataacaaatgtaatctcctggctgtatagaaacctttaattatatcacatatgcatacatacacacacacagaaaaatagtggtctggatgtaactgttggttatattagcactgctactaaggtgtcaacctagagcaagtgaagtattattggagacataaaaagcctggatttgattaccaaaaattggaataaaaagaattaactaagttttcacttgccactaaccttctaatggagggagttacaacattcttggaaaataaaatccaacacatttcataacgtgataaaattgttacagtgatgtcagtaaggataagttaatggacattaataaacacaagatggaatgaacttactggataaaattacaaaaatcccagagctatgtattaatcaaattctttgtactccaaattatttttccatattttgtaggtaactatatttgtctttccttcatagaaatattgggaggataatatgcagtaattgttatggtaatatttctagtttttagaaggaaaggtgctacaaacttccggatgtagctaatactatattctacgagggattattgtgctcttagttaaaattctagatttattcaataaattgctagatttgcttacatgaaaatagagaacttaatattgatgacattccaatcatattactggtgatattataatcaattagctatcatattgacaaaaagctaaaatgtagcattttagtttggaaagaaaaacaaaattcctaagtaaacaggaacatattaagaactatataattacccagtgccattttgtcactaaagtactttatccaattctgactgccagaactaaaacagattttgaagaaatatcattaagattaaaggtcagaaaatagccttaaagtttttaatgaaataatgaatagtttttctagtaagaagaaggccagcaggtgattcagtaaacattttcagatatatggaaagttgtaaataaatggcaatcttctctttcagattgtaagtaggacaagaagaaaaagtaataaaatataggacagttttaggttatttcagagaataagagtggttaaagaaaaactcagtcaagacatttggggaagagtgttcttacattactttaaaaatactgtaaaattttaaaaatagcataatctctttgttttcaaattatgaaaatgagataatgttaccagatcagagtaacacaaccagtcaatgacagcataattccagctctcatatgaaaatctaggcctttgctccttgactccagtcttccactgcttttccatttttttatgtttcttaaccagttagtttaaatgtagcctggaaattgacaattatctctgaaagatgtttctagcttaaaatgcctgtgattatcagtgggtctattaatgaatgagctctccaacctcttcccttctgccattcacttgtgaaaaaccttgttttactttaaaacttatagacttcctgagaagcaagagctcaaatctaaatcttaagtgctttttgtgttagacttttgaacataaatatcactaggcatttttaatgcactatctcaaactcttaaacaattgtataaaatatgaagaagctgaagttagacaaaataggtaattagacttggtcagattgcttaaaagtaggtaaattattctgattccacattcagtacattttttccaatttgccatactaaccataatgtaaaaacttcaaccagaatgcctaatttgtatagcaagcagtgaatgtcttaagataacacttttattcctaaaacagttgttcacatgtaaagtaaaatgattgttatttgttcttaatgtatttaaaccgggcattcatagcaatttagtgttcatctactttctcttttctttcaggcctgtatgtggaatcagagggaaaacgctcataattaacctgccaggtagcaagaaaggatctcaggtaaatcacctggacatattaatggtttagtgtaagagcttttgaccagccgtgaaagttagccagccaaaaagttggagcactccacaagactgccctcacatctgataccaattgcaggattcccaaagtcactcttgggttcagtaattcaatggaaagacatagaactcactaaaaactgttacacttacagttatggtttattatggggaaaggatacagattaaaatcagccaagagaagaagtgcataagacaacgtccaggaatactaccaaacacagagagcttcccttgtcctctccttgtagagtcatcaatgctttactctcctggcattcgtgtatgataatatacttgtaatatttttaatcagagaagctcacctgagtttttgatgtccagagtttttttttttttttttggtttggtttttttttttgttttgttttgttttttttgcagttcattatattttgcccatgtgaatgacctttagtctttagcgcttcccagagattggattgatagcattagtctccagtatgttccagaactgacaccatgtggccaaaagtccccatcataagtcatattgttagattgtgtggtggccaaagccatcaggtaaacaaagacactgctgtcacacatgacattctgaacatctagagatctcctccaactagttaagggcaactacttttaccctcagactctctttgggtactgttaattctttgctgtacaagctaccccctggcctttggccaaggctttttttattgtatagcaacacagtcatgtttgtctgggcatctatatttactatggtatttatgtgacagacacagcagtagtatcagtgtgaatatgcctaagatttggccaaggcagtgtagggtgtggatatatttagagaaatagctaatccatccactaaagccattacatacattttcataattttgtattaagttactaatttctcacctttaatctaccactattgatatgtttgtacagaactatatatcatagaaattagctgatggttacctaagtgcatttcttcctcaggccagtcattttctattaacattatatcctgaggaggctttaactgaatttcccaatacacttagccataacctaaaaaataaaagtcaaaagatactggcacgttcttagagtccttctcagacattaacagaccagaatgtctcccagaatgatgctactcaggtttgcaggcttgttggattccaaaaataagagtggtctcagcaacatatgacttcactctttcaagcatctgttacagttgagctaagaaacaatgtcatctcttgttctgaacctctttggagataccaatgcagtattatttcccttactgcataacctatccattcattcctttaccctcagctaccattcttccttctctctatttatacccaaactttttcaccttttaaagagttgtaaggtttggccactgtgctgattcagattgccgttggtaatactagtttagcaagttcctcctgcacagtctattcctattcatttagagtaggattgtatcccttaccttcattttagctagcatagataacaataaccaagagattgtgtgtttaacttctttctttatattttgcatctccttatgcatccagtgagataactttttgggaattatctccattaactaatcacagtaaagaagcaattccatgctgtggttgacactgtcttcactcagggatcaaaggttcatcatcccacaccctctcttcacttcctaagccatgtatttcagtgagtcagggtctttctagaaaatcttatttttgacaccaactgtaaggagttttagccaactgcaaaaaatagccacctacaaatgtggagtactccacaaaattgctcatttctgaccctaattgcaaattcaggagatcctaaaatgaccttcaggtttaataatttactagcattcatggaactcacagaaagctgttatactcatgattattgttcattgcaaggaaagaatacggattaaagtcagccaagggagaaagtgcatagggcagagtctaacagaagtaacaaatgaggaacttctgttgtcctctctctttggagacatggacatgtcacccttctggcgtcaatctgtgataccacacatggagtaatgccagctggggatgctcacctgagcctttggtatccagagcttttattgggactcaaacacttactgccagtgtggctgacctgtaatctttaatcctaaagtagagagaagcaattgggggccttctatgtagaaagtggggtcagaaggccaagaaagggagtatgagtatatatccaagtcacttaggaacttttatgcaggtgcaaaaaaacttatgtcaaagtggccacaagattatttaatagacagatgaatgaaagtccatgtttactgctagacacgaaagctttgtgtgaaatcttgaattaatggggagagagggagggtagcctatacctgtctgttcttttcctgatccctttccctcattcctgaactgcagtctaacattgttagactgtctctggtgcccaaagtccatggacaacaaagacattcctattaggcgtgaaattccaaggacctagagatcactcccagaagctgagtgtaaagaccagacctctcctcggtcaaggttaaattctttaccacacaatctttaaagagtaaactgattgagccatacaaagataggtcgaaagattaaacatctttcccgatattatgtaaccctccaaaaatttttaagatttttttttttacatcttagattttaagctattacttcaaatgtgaaagagaaagacctccacctcttctgcagctatagctggccttatattctgatttttaggttcttacctattctcttttggtaatacgttatagataatagtgagcacctcagcagcagattatattaactttatgcagtgctctttgcaagcttattttatattttgcttgctgtacaatgttacctagctatactttatgatggtagttagaactttagctctctggacaaaataatctggttctcacctcggttgttagttctactgccctgctctaactaaaaatatgaaacctctttcctgcctttttttaaacaacttcagtaccaataaatctttattcattgtattttcccaagaaaaggagaagggataggaaaagagtcagcatgtgtgttaaaaaaatgattagaagatgggaaaagaagtagagaatacagcaaaatcaaccatcaaataaacataccccagtggtggggtcaccgaagcccaaacgggctcaatctcctgcagttcaagaatgaggggttgggattaggaaaataacagacaggtacaggctactctccctccccataaattcaagatttcacacaaaggtttggtgtctagcagtaaacacagagtttcatttgtctgtctcctattaaacaatcttgtggccactttgacataagtttcttgcatctgtgtaaaagttcctgagtgccttggatataaatattcatattcttttacttagcctcctgagcccactttctgcatggaaggcccccagttgcttctctctacttttggattaaagattaagtagatttggccaggcgttggggctcaggtctgtaatcccagcactttgggaggccgaggtgggccgatcacaaggtcaggagttcaagaccagcctggccaacatggtgaaaccccatctctactaaaaataaaaaaaaactagccaggcgtggtggcaggcacctgtaatcccagctactcaggacgctgaggcagagaattgcttgaacccaggaggcggaggttgcagtgagacaagatggcgccattgcactccagcctgggcgacagaatgagactccgtctcaaaacaaacaaacaaaaaaaaatggttaactagatttgacccatccaagatacagcagtgtcttaagtgtttggcatgaatcacatcaagaaatggtcttgactcaggaggttgggaacaagggatgaagggctcctagtttcttcaggatttttgcataaatcatttaagagttgtagaaataacgcaagaattaaatgtgtgtatgtgagtatgtaagttttctcttggggaggaggggatggaaaagagggtagtatacaagtttttagaatgtatttatttatttatttttagagacagagtctcactgtgtcaccctggctggaatgcagttacacaatcatagctcactgcagcctcaaactcttgggcttctttcctatctttcctgtctttctcataatgcatctttcaactaccaagttgtatatagaaattttactttttttaaaatgcagtgcatgctttttttttttttagagaatgaatctgattctgaccatccatgcctgtcctcagtcttatttttttttatttttccataagttattggggtacaggtggtatttgcttacatgagtaagttctttagtggtgatttgtgagatcctggtgcacccttcaccgagaggtatacactgcaccatatttgttgtcttacccctcaccccccacactctttcccataaattcccataagtccccaaagttcattgtgtcattcctatgcctttgcgtcctcatagcttagctcccacatatcagtgaaaacatacgatgtttggttttccatttctgagttacttcacttagaataatagtctgtaatctcatccaggtcattgcaagtggtgttaattcattactttttatggctgagtaatataccatcatatatatataaaatagtttctttatccactcattgattgatgggcatttgggttggttccacgattttgcaattatgaattatgctgctataaacatgtgtgtgcaagtgtcttttttgaataatgacttcttttcctctgggtagatacccagtagtgggattgctggatcaaatggtagttctacttttagttctttaaggaatctccacagttttccttagtggtttcactagtttacattcccaccagcagtgtagaagtgttccctgtttaccgcatccatgccaacatctactgttttttgattatttgattatggccattcttgcaggagtaaggtggtattgtattgcagttttgatttgcatttccctgatcattagtgatgttgaacattttttcatatgtttgttggccgtttgtatatcttattttgagaattgtctgttcatgtcattagcccactttttgatgggattgtttttttttttttttcttactgatttgtttgagttcgttgtagattctggatattagccctttgtcagatgagtagattgtgaagattacaaaacactgctgaaagcaatcatagacgacacaaacaaatgtaaacatatcccatgctcacggattagtagaatcaataatgtgaaaatgaccatactgccaaatgcaattttcaaattctatgccattcccatcaaaataccaccatcattcttcacagagttaagaaaaacaattctgaaattcatatggcaccaaaaaagagcccgcatagccaaagcaagactaagcaaaaagaacaaatctggaggcatcacattacgtgatttcaaactacactataaggccatagtcaccaaaacagcatggtactggtataaaaataggcacatagatcaatggaacagaatagagaacctagaaataaaatcaaaaacttagagccaactgatcttcgacaaagcaaacaaaaacataaagtaggaaaaggacacccttttcaacaaagggcgctgggataattggctagccctatgtaggagaatgaaactttatcctcaactctcaccttatacaaaaatcaactcaagatgaattaaggacttaaacctaagacctaaaactataaaaattatagaagataacattggaaaaacccttctagacattggcttagacaaggatttcatgaccaaaaacccgaaagcaattgcaataaaaacaaagataaatagctgggacctaatttaaactaaggagcttttgcatagcaaaaggaatagtcagcagagtgtatgttttttttttttttgtcactgtaactatttttattacatcacaataattaggagtagtacagttcatgacaaaaatattacaaattttagatcatttcacagcacatactcctataaacatttaaaagttaatttcaattaaaagagtggtcatttttaatgtttcatatgaccaacattgtagcactgtagttccttagcttatggagaatgctataacatattttatgcttacttcatggcatattgctaagacaatgttttacatatgattgattctgagattgatggaggaaaatgcaaatccaaaatcacgaaacagtttgattgccaccatcttatataattacaaaagtgcttcatcttaatttttttttctttctcttgcatacaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaaggtaagcctgatgagagttactcagaggcctaaaggacccacaggtaaatgtactggtttcatctgttttgcatcgcatccctccctacatttaatacttcttcagagaaccctaaaaaaataagtgggatgtccatgacactccactactatgtttccttcttgatatagattccttgaagtcactgaagttaattctgagttctgaggcattactgatgagctgttgcctattgaagtaatagctacaatgataaacaacgtgacattttagaactctttggagatgtcatttttgtggacatattaaatatataatgtttatatattcaaagtatcaaaatgtcacaaattcttaaaggaacagcaaactgaaggtaaaagaccttagatgattcaagaaatgagttgggaaagattaataaagatttttaaagggacaaagcttttcagcgattgttgaatttttcttaactaataacttattcaaacattgcttgacacaaattaccctagtggtaaagataggaaatggatatatttgcatttctactttaagaaatattattaggacaatatcaaagtattacaaattctctttgggcaactccatgggtaaatatactaccatgagttacttgagtaaatttaactgtcttaaagttatagaacatggtttattcttcatacctactaaagtcaacctagtatgccttaatatctacagaaagtagcatatcaattctggaaattatgatttttcattaagagcataaagattgaaaatttaattgctatatgacataattatcagattttatggattatccagttattttggctacgagcattgtgaggttttttttttaataatatatagattagaatcatcgagaaatccttttgaagtgtccattcagtgatccagtgagtgcttactaaaggctagtaagtatttaagttttgtgtgattttttttttatgaaaccaattggtgaaacaggcatttttaaatcattatatgttccttttcctttactctgaattaaaagagtaagaagtgccataaatttcaatcttaggagagaagcttatggcatttaaaatctaagctgattctgtcattctacatttggaaaatgttagcatttcatttttccatttgtttttaccttttttcctttttagtcattttgcttgtatagtttcatgttttcctgtcactatattcatagttgttatgtgttgtgcattagaagcatccattctacaccagtcctgctgttgtcatggcacacggtgaacagcccatccctggtctcatcaattattcccatcattcaacagatgaacgggtaagacaagaggcttttgcattaatggttttccaaatatgtattctacttcctctccttggagataggctgtaacatatggaagatgtgttgttttattctgatggattttcagccttgctttcttgtgaaagtgtgagtgccattgagtatatccatcaaggaatttaatagagtttctcctgtgactaaagtactctgctatcattaagattctgtcatttgtgacaatgaacttttatcaaatgacttgcaagaaagtcattgctcagaagttatttttgtcttaccaatttcatcagatatctttaaataaattgcctggcttaaaattacctcttaagagaatcactttgagtcttaaaatctagacagattggtcaagcaaatagttgatttgtattaaccttcctgttttgtcttatgattttgcatctcatttttttttcattcattgagctctcattacaaccattgcagagttgaattttgatataaattctgtgattcctcatcataagtaaactttttaggtgcatatttgtttattcagtcagtggctgaatgatagcttgcaaaaaaatgccaggttgtaaaagattaaactgatacataaaaatcattaaacagtgataatttagacattggatgaaaaaaaaacgatctaagtccctaatatggatgtaaaatgagaggggcagagaagaaaaagaaataataaagtgaaatttggttttaaatacttaggaagcaaaacacccaaaattaggagagaaaaaaaccaacaacttagcatccatagtctcttagaagatactaccaagtgaagactttttaaaaattttaattttgtggggtacatagtagtggatatatttatggggcatgtgagatattttgatacaggcatacaatgggtaataatcacatcagggtaaatgggtatccatcacttcaagcattcatcatttctttgtgttacagacattccaattgtattccctaatttattctaaaatgtacaacaaattattgctgattgtaatcaccctgttgtgctatctagatcttatccattgtatctaactatattttggggtacccattaaccatccctatttcccactccccctacccaccctctccaccctctggtaaccatcattctaccatctttatctccgtgagttcaattgttttaatttttagctcccacaaataagtgagaacatgcaaagtttgtctttttgtgcctggcttatttcatttaacagtgtcttccagttccatccatgttgttgcaaatgacaggatctcattcttttttatagctgatcagtactccattgtatatatgtaccccattttctttattcatctgctgatggacactcaggttgataatgctgcaatacacatggaagtgcagatatctcttcaatatactgatttcctttcttttggatatacacctagtagaggcattgctggatcatacgtagttctgtctttagttttttgaagaacctccatactattctgcatagtggctatgccaatttacattcccaccaatagcgaacaagtgttcccctttctccacatcctcaccagcattcattattgcctgtcttttggataaaagccgtattaactgggaagagatgatatctcattatagttttgatttgcatttatctgatgatcaataatgatgagcaccttttcacatacttgtttaccatttgtatgtcttcccttgagacacatctattcagatcttttacccatttttaaattagattgttttatgttttttcctatagagttgtttatatagtctggttattaatcccttctcagatgcatagtttgcaaatattttctcccataccttggattctcttcattttcttgattgtttcctttgttaggcgaagctttttaacttgatatgatcccatttgtttactttttcattggttgcctgtgtttgtggagtattactcaagaaatctttgcccagtccaatgtcctggagagttttcccaatgtttccttttagtggtttcatagtttcaagtcttagatttaagtatgtaagtctttaatccattttgatttgattttttatatatggcaagagataggtgtctagttttaataatctgcatatggatatccagttttcccagcaccatttattgaagagactgtcctttccccaatgtatgttcttgacccctttgtcaaaatgagcttactgtacttatatggatttgtttctaggttctctattctattccattggtctatgtatctgtttttatgccagtaccatgatgtattagctactatagctctgtagtataatttgaagtcaggtagtgtgattcttccagttttgtttttatttttgcttaggatagctttggttattctaggtcttttgtggttccatataaatgttatgattattttttctgtttctgtgaaggtattttgatagggattgcattgagtccatagattgctttgggaagtatggacattttaacgatattgattcttccaatccatgaatacggaatgtctttcctttttgtgtgtgtccacttcaatttcttgcaaaaatgttttatacttcatcatagaaatcttttacttctttggttaaatttattcctatgtgttttctttgtagctattgtaaatgggattactttcttaatttctttttcatattgttcactgttggcatatagaaatgctgctaattggccaggcgtggtggcttacacatgtaagcactttgggaggctgaggtggttggatcacctaaggtcaagagttcgagaccagcctaaccgacaaggtgaaaccccgtctctactaaaaatacaaaaattagcctggtgtggtggcaggcccctgtagtcccagctactcaggaggctgagacaggagaattgcttgaacctgggaggtggaggttgcagtgagctaagatcgtgccactgcacttcagcctgcgtgatggagcaagactccatctcaaaaaaaaaaaaaaaagatatgctactaatttttgtttgttgattttgtatcctgccactttactgaatttgcttattagttctaatggttttttgttggagtcttaggtttttccaaatattgtatcatcagcaaaccaggataatttgatctcttcctttccaatttgggtgctgtttatatctttctgttgtctgactgctctagctagcacttccaatgctatgttgaataacagtggtaaaagtgagcatctttgtcatgttccagatcttagaggaaatgctttcagtttttccccattcagtatgatactagatgtgggtctgttgcatatagcttttattatgttgaggaacgttccttctatacccagtttttttagggtttttatcatgaagcaattgaatttcgtcaaatgctttttcagcatcaagtgaagtgatcatacggtttttgtcattcattctgtagatatgatgtatcacattgattgatttgcctatgttgaaccatccttccatccctgggatgaatcgcacttggtcatgatgaatgatgtttttaatgtgtttctgaatttggtgtactagcattttgttgaggatttttacatcaatgttaatcagatattggcctgtagttttctttttatgatgtgtctttgtctggttttagtatcagggtaatactgaccttgtagaatgagtatagaagtattccttccttctctatttttcagaatagtttgagtaggattggtatcggttcttctttaaatattttgtagacttcagcagtgaaggtattggttcttttctttgctgggagactttttattatggcttcaatctcattacttattgctgtattcaggttttggatttcttcatggttcaatcttggtaggttgtatgcatctaggaatttatccactacttctaggttttccaacttattggcatatagttgctcatagtagtctgtaatgatactttgaatttttgtggtataatcatgatgtctcctttttcatctctgattttatttatttgggtattctctcttttcttctttggctaaagatttggcaattttgtttatctttcttagaaaaacaacttttcattttgttgatcttttgtactgttttttgtttgtcttaatttcatttattgctgctctgatctttatttctgttcttctactaatttgggcttgattttctctagcttttctagttctttatcatgtgtcattaggttgtttatttgtagtttttctacttttttgatgtaggtgcttattggtataaactttcctcttagtactgttttgcctatcccataggttttggtgttttgtgtttccatattcatttgcttcaagacattattaatttgcttcttaatgtcttcagtgacccactggtctttcaggagcatattgtttaatttccgtatgtttgtatcatttccaaagttttttttattgatttctagttttatgctgttgtgggttagataagatacatatgatttcagtttttttaaagacttgttttgtggcctaacatatcgtctgtccttgagaatgattcgtgtgctgaggagaagaatgtgtattctgcagccattggatgaaatattccataagtatctattagatctatttgatctgtaatagagattaagtccaatgtttctttttttttttttttttttaagatagagtcttgctttgttgcccaagctagagtacagtggggcattctcagctcactgcaacctctacctccaaggttcaagcgattctcctgcttcagcttcccgagtagctgggattacaggcacgcgccaccgtgcccagctaatttttgtgtttagtagagagggggtttcaccatgttggccaggctgatctcgaactcctggacctcaagcgatccgcctcccaaagtgctggaattacaggcctgagctaccacgcccagcctcaatgtttctttattaattttctgtctggagaatctgtccaatgtttaaagtggggtgttgaagtctccagctattggcatattagggtctgtctctctctttagttctaataatataataatatttgttttatatgtctggatgctctggtgttggttgcatatatgtttacaattgtcatatcctcttgctgaattgattcctttatcattataaaatgaccttccttgtctctttttatagtgtttgtcttaaaatctattttttctgatctaagtatagctactgctactctttttgggtttccacttgcatggtatatctttttccatccctttattctcagtctgtgtgtgctttttttttttctttttttcttttttgagatggagtgtcactctttcgcccaggccggactgcagtggcgctatcttggctcactgcagtctctgcctcccgggttcacgccattctcctgcctcagcctcctgagtagctgggattacaggcgcccgccaccacgcccggctaattttttgtatttttagtagagacggggtttcaccgtgttagccaagatggtctcgatctcctgaccacatgatccgcccgcctcggcctcccaaagtcctgggattacaggcgtgagccaccgcgcccggccgtctgtgtgtgtttttataagtgaagtgtgtttcttgtgaccaacagattgttaggtcttgttttctaatccattcagccattctgtgtcttttgattggagagttaagttcatttacattcagtgttattattgataagtaaggacttactattgccattttattatttgttttgttttgtttttttctagttctttgtggtcttctctttcttccttccttcctgtctttctttttgtgaaagtgtttttctctggttatatgttttaatttcttactttatattttttgtggaactattgttagttttttggtttgaggttaccatgagccttgcaaatactatcttataacccattattttaaaccaatgacaacttaactttgattgctaggagttaagagcaaagagacaactgataaaaactctacactttaaattcatccccccagttttaaacattttattttttctatctatattttataatagtatgtctcaaaaagttgtaggttttttttttttttttttgagacagggtctcactgtgttgcccaggctggagtgtaatggtataatcacggctcagtgtagccttggcctcttgggctaaatcagtcctcacatctcagtctcccaagtagctgggactacaggcacgcaacaccatgaccaactaatttttgtattttttgtaaagacagggtttcactattttgcccaggcttgtctcaaactcctgggctcaagcgatccacccaccttgccctgtctaggtgctagatcacaggcatgagctaccatgcctatagttattattttttagatcatctcttagttgtcctactcaagatatgagatgagtaatttatacatcacacttaacagtgtataatattctgtgtttgtctgtgtatttattgttaccagagagtttggggccttcagatgatttcttatttctctttaatattcttttatttcagagtgaagaacttcctttagcatttcttgtaaaataggtctggtgttgatgaaacccctcagcttttgtttatctgggaaggtctttatttctccttcatgtttgaaggacattttcacaggatataattttgtaggataaaagtttttttccttcagcagtttaaaatttgccattctctcccagcctgtaaggtttccactgagaaatctgctgccagacatattggacctcctttatatgttatctgttatttttctcttgatgcttttaggatcctttctttatccttgatctttgggagcttgattattaagtgtcttgaggtggtcttctttggggtaaatctgcttagtgttctgtagccttcgtgtacttgaatattgatatctttctctatgttttgaaagatctttgttaatatctctttgaataacctttctaccctgatctcagtctctctctctctctctaccttttctttaaggccaatacctcttactgccctttgaggctattttctagatcctataggtgtgcttcattattttttattcttttttcttttgactattctgactgtattttcaaatagcctgtcttcaagcttactaatttttttctgcttaatcagttatgctgttgaaagactctggtatattcttcagtttgtcaattcagttttcagctccagaatttctgcttgattgattttaattatttcagtctcttagttaaatttatctgatatgattctgagttcattctctgtgttatctttcattttgttgagcttcctcaaaacaactatttctaattctctgtctaaaaggtcacatatctctgttactacagacttggtcactggtgccttatttagttcatttagcaaagccatgcttttgtggatggtcttcatgcttgtggctgttcatcagtatctgaatatttattctaatctttgaagtctaggcttgtttgtacccatccttcttgggaaggctttccaaatactcaaagggaattaaatgttgtgatctaagtctggtcactgaggccatatgtgcattagggggcaccccaactctagtaatgctgtgagtcttgcagaggtactctgactcttatagaggtactgccgtggtggtcttaaataagatccaggagaattccctagattaccaggcagagtcttgttcttttcccttacttttccccaaacaaacttaatctccctcttcatgctgaactgcctggagttggggaagggttaatggaagcactcttgtggccaccaccactggtactgtgttgggtcactcctaaaaccagcccagtactgggtcttgcccaaggcctgtggcaactattttctggctgctgcttgtgtttactgaaagaccaagggatctttagtcagcaggtggggaatcctgccaagaccaggttttttttttttttttttttttttttttttttttttcagtgcagcaggtccccttctggcccaaggtgggtttagaaatgccgtccaagagctagggcctgggatgggaggctttaggaatcttcttggtgtttattttaccaggttgcaagacaaagtcctctttacttttccttctcctttcctcaagcagaagtctctccctatggccattatcactctaggctcagggcagctaccgcttggctgccactgatgtttattcaaggcccaagggctttttagtcaccactggtgagtcctgcgaggcctgtatctctcccttcaggacagtgaatgcctttctggcccaaggcaagtctagacatgccctccaggagctaaggttaagattagtacatcaaaaattatttgagtgacccatttttcagttctcccaaggattgtacacaactaataccattctagatgcataggagataagttaattattagggtttaattctttggaggaactagttgagaatgattgtaaaactgttctaactggatgttctcatatagcatcagtgaagactttctcattgattaactatttattagctggtatttaacagtcctttgtaaatagtaattggtcttttgacagatgttcagttttataagtagactcacatgtttatgtttcctgtgacaaatgacagttaacaacatatcaaagagtataatgttgttcttcagactgggcatctatctatacagtagaatgaaaaggaagaaataggtaacagaaaataatgaaaagaaggccttgatgcttctgaagaagttatgttaactttgaatgcttctctagcactaactttattaatgagtcccactggttctgaatgacctggtgtgttgtcagtgtgtcagaagacctctatgtgagaacagtcatttggaatatctatatatactatttggcttacttttacaagttttacctatgtaaaattaatattgaaagggagcacctgattacctattagaaagaaaaattacaatttccctcagctggtcacaatctgaggcatgtgaagcaatgtggaataatgttaaaatcttgtatttagagacggaaaacctggatataagcccttacctcaccacttaataattcggacaagttacttaaaatttaagcttcagttctcatctataaaatggaaataataattatcctgtatctcacaacagattattatttttagtacaggagatgacatatatgaggaaatttttataaactttgtaaattaagaattaagtatttgcagaattctttcaaggtaccaaacactatcctcactgctcagaatacaaatataaacaggttgttccagcccataaaaagttcacagtctagggcctgggtgcagtttctcatgcctgtaataccagcactttgggaggctgaggtgggcagatgtcttaaacccaggagtttgagaccaacccgggcaacatggcaaaaccccatctctactgaaaaataaaaaattagccagacgttgtggcacatgcctgtagtcccagctacttgggaggctgaggtggaagaatcacttgagcccaggaggttgaggttgcagtgagctgtgatcatactactgcacttcaacccaggtgacagagcaagactctgtctcaaaaaaaaaaaaaaaaaaagagttcacagcctagctgaagagttgcttttttaaattacttctttaccttcctaactcagttatctacttctagtaatcaaaaagtgaaacttggtcaatgtactgactgttcagtagttactaatgagctcattgctacttattgcaaaattaatcagcttgctatttcaggagatagagacttaagaaattcctcttgtaattgacatttgttcgttgtctgtccagcagtcattttccattccctcttcctagcactgtaccacatttcccagtcatgtagtttgggtggaattgattaaacctccagtgtaggttgtcttaatactgtataatcaacatacccatttcacctagccacagtcattagttaaaggatcatgtaattcaaagcagtcagagccagtggatttcatctcttatattttaatttaactactgggggacacagattctctgtttcctgctgaacatgaatgaggaaatatacaaccccaagaattacgtcttgggaccgtgaatggaatgcctgctatgatggaactagcataagaaacaatcctgagaaacagaagtttaaaagagatactgggtcccagtaacattttgtgaaccactcattcaagcccttcttgaactatacagactgcttgactttttggttacatgagccaataagctaatagagataactgttgtccataactaaaaagtatcttaactattataatatacctgaataagtactgtatcatcaaagaaataagacattttcctaataatgactaaaatgtatcaaataggaatccctgaagtttcatatttcagtaaaaaaacctgattcaagaggatagagggttggaaaatgtgacttaaaggaggaagaggatgaaaataaatcctgctcctctgtatttataaaataaatgaagatattttcagagagactggatccaaatctgaaggtgacaacttatgctttgcagcctcaaggcaactgataggttcaaaactcaaagtaataatattaacaacaggcaaagaaagaatttaagacaaagagggaagctatccttggagatttgtaataggaaatctcatttcactgacagaaattaaatcttctggagaaatccaaaacaataatgatgctccctaagctgtattgtatgaaagaacatctactgattgccctgggaagaaaaagagttggtgacttcttcttggtaaatgatacggaaaaaacaatatttttatccatatcatttgtatatatattatatatatatgtgtgtgtgtgaatatatatatgtgtatatgtatatatatgtatatgtgtgtgtttttatatatatataaaacaaacatgctgtatgttatgtttatcaaacatgtacatatacatgtatacaccaccgcatggtggctggcacctataatcccagctacttgggaggctgaggcaggagaatcacttaacatatatgtgtatacgtgtgtttatgtatacgtatacatgtgtttatatgtatacatgtatacgtatacatgtgtttatgtgcacgtatacatgtgtttatgtatacatatatattaaaactatatatatacagttttattgtttccttttatccatgaggattttgagatattaaaataattatattaattgaataccaatcattctctaagcattttatatatatcagctctttacgtaaatcctcattttgcttgtaagaaatctgaagctcatggtagttaagaacatggaactacttagtggctgaactggtattcaagtctaggcagtctgattctaagatgggaattcttgactactctgctatagcacctttcataaaagaaaaagtaaaagaagacattttgggaggtgacaaactaattataaactctcctcaaaaatgagaattggggtccaggtgcggtggctcacgcctgtaatcccagcactttggaaggctgaggtgggcggatcacctgaggtcaggagtttgagtccagcctagccaacatagtgaaatctcgtctctactaaaagtacaaaaattagccaggcgtggtggcgggcacctgtaatcccagctactcgggaggctgaggcaggagaatcacttaaaccccggaggcagaggttacagtgagcagagattgtgccattgcactctatcctgggtgacgagaaactccatctcaaaaaaaaaaagaaagagaaagaaatgggattttttaccatggtttgaaatacttaagtgataagatgcactgcccaatctaagaattgtaaacaatcgaatgtcgaatgtgtttactctggaagtttactgatccaagcaaaaaagctttaagctataaacatctgtggagtaagaagaatatatagataaatcaatataatgaaatactttggagaatacagtatgatacatgttaaaagatagttttataaaggttgagttataacacttagaagtataaaataaatatgtgccaaagattttatttaacttattaaataatgagagaactagtaagctgttacaccaattcaaacaagaatggaaaggacacagacatatgtcaacagtcatgaagactggaatgaatttataaatagaaaatttgtgcaagatatacaggccaatgagtagttgctcctgatcaggactaaacttatttgcatttctatggacaggaatcattacttacattattattagttttcttcaacttgcaaagttgtaaaatcgtgtaaaacaatgaaaagtacagataactcagaaggatatacaagtcagggcattctagtaatcttagtaatcgtgaagataatttttttttccagacaggagcttgctgtcacccatgtcggagtgcagtggcacaatcacagcttactgcagcctctaccttctaggctcaaacaattatcctgcttcagctgcccaagtagctggggactacaggcacacagcaccatgcccagctaatttttgtattttttgtaaagacagggtttcatcatgttgcccaggctagtctcaaactcctggattcaagcaatccaccctcctcaacctcccaaagtgttagcattacaggcatgagccacagagcctggcctctaagatagtttttatttaccacaaaaaaatgtgtttgatctcattaggtttgggctgattcgttacataactggagcaatttttttttttttttgagactgagtctccttctgtcgccaggctggagcgcagtggcacaatctcagctcactgcaacctccacttcccgggttcaagtgattcctctgcctcagcctcccaagtagtgggattacaggcatgtgccaccacacccagctaatttttgtatttttagtacagacagggtttcaccatgttggccaggatggtttccatctcttgaccttgtgatccggctgcttcggcctcccaaagtgctggattacaggcatgagccaccgcacctggccgcaagattattaattaaccagatatcctccttaagtttgttttacaaataagaagaccacaaaattaatttttgtctggaaattttcttagggaatctcagattctattaggttgttaaaaaagtaattgcggtttttgccattacttaatacttttaaaggtctctatttttgccaacccaagattagtaaactatgcccaagaaacttcaccatcatcatcattttggtaagttcctctcttctccaggtcaccaaaattttattcccacatgtaagtgatcttccttaccacataaaaggctgaaaccttctgctccaggtactaggttggtttctctgggagggcattgtcaccattggcttcaggagtacagccaatatttttttcttcaaagtggtagtgatatttgattagatgaccatcattctcaaatatatctccaggtaaggccttggttgcacaatcagtttgtacaattatatcctgtttaaaaggaagacattcttattaggattgcaaataactatactgtcaagaaaagttaggaaattactaagagtttctgaatttggaggaagtcagaatcaaatattattttgaaatgtttcatattagtttaagaaatcagggtctactaaattgtgtgggttacatatagcttaaaaagaagaaaaagagcttcctcatgtatccagaaaatagaacatttaaaacaaccagtgtcaatactactccaaacaaataggaaaagaaatttccttctgtattcctttttcattctgtgttgattcagtcctgtgataattaattattattcaaataagccttggcttagcagtctgctttcatgaaactttctgcttctggcctgagagagttttagaaattctaactcagtccactgtttaggtccaaaagttgtccaagcagaagtctactcatgagtctattctttcaagtattagtactttgaagtatttggtacaattctttccatgaagcttttgaaactatctctgttgaacacacaaactctggcctatagcttaataagcataatcttcaggtaaacatcaaaatttgttcatagatgacagactattgttaattgtaaccaataatatcaaaatgcaagaggttaaaattctttccactgggggataactatttcaaaagagttttgatcagtatccccttaaactaaaaactcttgcaaatatggtcaaatgatttttgaccagggaaccaagaccattcagtggggaagacagtcttttcaaaaaatggtcctgggaaaactggatattcacatgcaaaagaattaatttgaacttttatctaacaccatatacaaaaattaattcaaaatggatcagagacctaaagctaagacccacaatacaactcttggagtcaaaactttatgacattggatttggcagtgattttcttggacatgacaccaaaggcactggcaacaacagcaaaaagtacacaaattagactgcatgggaattttaaatctttgcacatccaaagattctatgaacagagaaaaaggcagtccacagaatgggagaaaatatttgcaaattatatacctgataagagattaatatccagaatatacagagaactcctaaaactcaacagaaaaacaacctgattcaaaaatgagcaaagattgttgtagaaaaaaaacaggttcttgtcacaagaccagaataatttaggcatgtggacacattgtagggtgagtagggcaggatttattggatgaaaaggaaaaaaaaagggaaattggaactcctggcaaagcaagagagaatcctgctagcaggtttcctgcctcacagatttaattgcaggccaccccacacgcaagctgaagaccccaggctcctcccctctgcaaatggtgtgggattccaaacttcccgtaactccaccccatcctccccgtgccagtcagagattctccagggatcctctgccttatctgcctcctgcatctatcattccccctctgaagacatacatttaactgccgttaaaataaggataaggatgaataccaatcttaactgcttcctgctggtaaggggcactgttttggtaaacagcagtcacatctccttcagaggcctatctaagggtccccaacaaaagggaccatcggccaagcctccagttgcatgaccgtttggaggttgatggcctgaaggtgacaagagagaaaccaggttattagaaaacttgtatcaaaatgaaacaaggggcaggtgaggacagctcaaaaatctcgtgtcctttgaccagtctgtacagggagaagggggaccaaaagcttgaccggtaagaaaaacttttacccttttgctagcatttcagacttctgggttcctgtcccctgagctcaatcctaagccaatcagtttaaggtttgggaaattaactcttctcagtttggaagatgtatccaaagggagtgtcccatagtatggagacacagttacctatctgtgaagagaggacagggaaggaaaaaggaaaaaaaaaaaagaaggcgttttgttgttgttttttttcagaggagtcccagtggttcaggatgcaattgaaagggatacagactgaagattaatgactactcatgtagaaagaggggagcaggtgtccctggttcctttttcttcctagcatatacccgaggtatgtgagggagggaaagtgaggtgttcctctttctttcctccatccttgtatcccagtgactgcaacagggtgccacccataggttttaaagtggctttcacccatgttaacagggggagctaaggggtgggaggtatcagcttttaaccacatatgccctatctccactgctgtcagtagccttgaattccccagaccccatttatgcgatggatactagcataacctttattcatgaaacaagaagcttggcttaactggcaggaatcagtcatgctcacctgcattgtgccttttaacttccattaccgtctgcctctggattcctcagatctagtgttctttcctagggcgttgacccatagcttggagttgagtttgagacaaaaatgtgtcttggggtggggaggagttgcatggactccttatcataagctgaatgctaaggtgaagctgtggaattgagtcctcctccaacaagggagagaaaaggatgtctcatgacatgcccaaataactgttggctatattcatgcttgctaagatttgggtgcatggtgcttggctttggttagctcccttggtcttactttcccaaaaaggaaacctggatgggcatcctatttattgccatcacctggcaggatttgcaggttaattgctcagaactagaatattgatccagatttctacatcacctgtcccttttgttctttctgagctacagctggagattgctggaacatgcagggttagtctaaaatgtaggttacaacttaaaaacaactaggagtttagaatgtaatgacaaatgtataaattgtgaaacataatttctctctctccagtccttattttcattaaaaaaaaaatcatgataggactgagttgtttgcaaaatagacttagtcttatatttagcctgattatttgcataaagtacagcaagaataactatttgtaaataggccttttagactggctttgatggaactctattccacaaggaatctcagataagaccttttaaagtgaagcccagccatgggtttgtagcctcaaatacctgtgagttaggtgatcctctcctcttaaggtcccaggataaacttggagatcctgggcctgttagaaagagacattctttactgaccacagatcaggaaccctatacagggactgggtagacaagggtatgaggccagttttctcaattggcttttatgagctctgcaagtcaagcttgactcctgaaagggaaacacacccttccagtcaaagccttggtaaaaaaaaaaaaaacttgtttctccaattgcatcctgttgcaaaagaaaatggacttttattgcactgatccaaacaactatattgccagaagttaagaatactcacagatactttccaaattctagagaaaccaggcagagagaaacacacgttctccaaattttgttcacagtataccttacttgattattaagggctgtaaatagttcaaaatcagtttccatgaatctgaaaaataaaacaaggatcagcaatattccaaaaaactcaaaaagattgcttcagttttctgcatttagtccatttagttaagtctttgtgttgttgtttacttgtttgttttgagacagagttttgctcttctcacccaagctggagtgcaatggcatgatcttggctcactgcaacctccacctcccaagttcaagtgattctcccgcctcagcctcccaagtacctgagattacaggtgcctgccaccacacccagctaatttttgtatttttagtagagacagtgtttcagcaggttggccaggctggtctcaaactccatacctcaggtgatccacacacctcagcttcccaaagtgctgggattacaggcgtgagccaccacgcctggccccatttagttaacttttgtgttgcttaatattgatgaacattttatttctttatgagtcctgtacgtttttcctttattccaatgtcactatctccaaagttattagaaacctgcatttgagagcacctgttagagtcctataggtgattataaaccatcttttgaaaaggatcaaaacaaaacaaaaattgtctgaataacaaaatgtccagggtagttacagttagaatcaccattgacagagaagtttggttatctttgtggtttataataacttgacataacaaccttaattatgattgatagcatatactttagacattagaatttttgaaatttcctacaattttgggacatatattagtattattccccaaaatatatcctaaagtagattaaacaccgtttggcaatcccatgtaactaaatatgccaaataatcctgtttacttcttttctagatgccccaggggacctctgtagcactcaaaaagccaggtatcaggaaaaacaattttgaaactgaagtttgattttgggaagcctattaaatatattagaggtttaaaacaactattgttatgaaatagaattccagattaccatgaattatttattttgccaaaatgatgactcagatactttaaaaaagcaaaaacttattatgaccctttacaaattttgcaaaagagcagattagtgccttaagagtatcttgtgctttcatttcaatgctcagttcactgaaaaaccatataatacctttttgaatttagtcaatatgtttacacatggaatttttttcaagatttttacagtccttctaccacttgtttgaactttgagctttattttatctaattcaaaacaaccctttaacactaggcaagaatttacatttttatgccttttttataatcttttactaaaaacacatcttattagtcttacatgcctcacatgtaaatttatttccagtagtttgagttatatgttataatggtaactccttgaaattttttactttaatgtaaaacctgataagttgttttcattatgtgctaggtgctgccaaggcttaactccttccagcttaattaaagatgcggttagtactacatgtccctagccttaccatttatggagcaggcaagtcaaatagttctttaaacccaaaaagcagtttataaacttaaaacatttagcaaacctagcacctgacctgcatagtttagtccacctgtttatattttaatgacatctgctttttaccaatattctttaagggttgtttttatttctcaaagattaaagtcacatgaactgaaaggcaccacaacttttatcatccctttaaaaatttttttgatccaagcacttatcttcctttaagccagttaattagagctctttttataggcatcacacacacaacacatatataactaaacagacaggcaaaagaaaacccagtcaccataagatcttttgcttaccaatctcctaattggattattggatatagccctttaagagacagggctaggaaaacatgcagcttctaaaacctaataaacaggcatagatggggcaaaaacagattttcagagggatctatccacttttaattcttggggttccatgaagaaaatagaggtctttccccttcatgtgtgcattgagggtggcaagacaaacggagaaaaataattcagtcaactgagaaaaaaaccctttttccagaaaaacaagatccaagaaaagaaaaacataaaggccatttaaatatacctataatttgaatatccacttttaattaagccgagcactctttttaagaatttccttttaactcccttactacccgactttagcgatgccaagtggccaatatttctggctttcaaactttactaaagactcagagaaaggaaaatccaaggcggttcatggaggggaagagaatcaataattagcaaaggtcacacaaatatcaaactggaaaggactcattgaatcccaggccaccattgtaaaatggcagaggctagaacaaaacattgccacatggttacaggctttgctcccaaggacataaaacaagatggaggcctgcagcaaagtttgctactgaccatatggaaagtcatgcaaatcacaccagattggttacagcttaaggccaaaataacaaatcctttttcacaagtaaaactctacagagaatataaacagtgatccccattattcctggtccagcaaaatctcttccaaaaggaaaaaaagaaaaacaaaccctcacttaaaaataaattcctgaccctgtggagaaaaggaaaagacagcttaaatgcagggctgtattaactgctaatagggtggagaaaagaaaaagatgcctggggaagaacttcgtattcttatgcaaataagttcttccaccagtgagaaaaacttaatcactttcccacagagtgaaacccctttccctggggaggggaaggctccacagatgcaatgcagagagcattggccagcctgccattaggcacccttgggccatgcatcccagccctggcagggagaggagtgcaggagctgccattctgtggtccatcttgcgcatgcctgcagctgttgggatgaggtggtgcacagtttcctctaccctccaaagaggtctgaggagaaagagacatagaagtgaaaggaaaaaagatttttagacttgcttggtacttaccttttctcaagccccatgttgggcgccaaaaatgttgtagaaaaaaaacacgttcttgttacacaacagggataatttagttgcatggacacattataggatgagtagaacgggatttattgtgtgaaaaaaaaagggaaacaggaaacctcagcaaagtgagagagattcctgctagcaggtttcccgcctcacagattgaattgcaggccaccacacatgcgagctgaagagcccaggctcctccccactgcaaatggtgcgaacttctaaacttcccatagctccaccccatcctcccagtgtgcaggccagttggagattctccagggaacctccaccttatctacctcctgcatctatcagtatgaggatacaaaggcataagaattatacagtggactttggggactgggggaagaaagtgtgggagggggttgagtgataaaagactacacactgtgtacaatgtacactgctcaggtgatgggtacaccggaatctcagaaatcactactaaagaaagtattcatgtaatcaaacaccacctgcttcccccaaaaaacctattgaaattaaaaataaataaataaaaacaaaagtgagcaaaagattcgaatagacatttctcaaagaagatttgtaaacggcaaatcttgaataccacagttttaaaaaggtaaaagaaagcagtgtggacagggagagcattaacagttctctggggactttatacaaagcatacaatttttaatatgtttacattaataaaattttccctatagacatataacctagggaagactgggcttctcttttgatattgtaactctttatctgtgcttaaagaacaaacttttgtgatttctattggctttctgggaaatgtcaaagatagttttatttctttttctttttttctgggcctgtggactttgtagataagtacaaaatagttttacattccctgaaatttttttttaatttattttatgtttgggatcaaattttgagttatcagaggaaacttagacatgtaatttaaataggaccatggatacttgagaaataatttttgattgtctaatcaaaatgataatgaaatattttttttaaaagcatgaaaggtaatacagttgttaagaagtgaggaacttttgttctttggggttttttccttaaatacccaaatacgtaataaagttaacatataggagagaaaattaatctggtaagacacagaatctctgctatctaggcagatgatgtagatcctaggtaaaggcattaatcaccaaaccagccaagaaagccatcaaaattaagtgaactttgttgatatgttaacacatttattttttctttttttgacacagagtctcactctttttgcccaggctggagtgcaggacacaatctcggctcgctgcaaactccacctccggggttcaagtgattctcctgcctcagcctcctgagtagctgggattacaagcacgcactaccacacctggcagatttttgtattattagtagagacggggtttcatatgttggccaggctggtctcgaactcctgacctcatgatctgaccacctgggcctcccaaagtgctcggattacagacgtgagccactgtgcccagctgagaaaatatattcttaagtgaaccagttttataagtatattataactgttagtattttcatagataaaaaactagtctgctactctaaatgccattttaagaaatcctgtgagacttattggtgactcttctagattcacttggcattataaattcccagggaacaacttggtctaatcaactatcatctatcatctttcaccttaattatttcagtggctggtctcatcatttccacccttgcctcccttcaattcagtcttcaacccatagccagagtcgactttttaaaataaagtaaataatgtcacttctctacttgaacccttcaatggattcttatcacattcattgttaccaaaactccttgacatgttctgctaaattctgtataatctggctcctccctgatttctaggctcttctcttaccatttctctcttgtgctttattgcttactaagctccatatagctttttctttcctcagggaatttgctgtccccattacttaaaatgttcttaaacctactctttacctggctaactcctgtgcattctttctgttctggtttatctctttctcacagaaggaattctgtgatccacactgcccacctaaattatgcctgcagttattctctatcattgcaccttgttattttcctttatagcacttatagttacaattatatacttattcatgtgtttacttaatttatctctagaactgtaggtgggaagatccatgaggacatgagtcacatctcttttattcatatggtctatccagcacctagcacaggttggcacatagtatggactatataaattttggtaaatatatcccatgaaaacatatgatgcatcattcgtcttgatggaatcaatgtctattaattaaattcttaagactgacattttaaaaagggatatatttcgccatacccatgatgtataagaattgttccatggccaggcacagtggcttacacctgtaatctcagccactcgggaggctgaggtggagggattgcttgaggccaagagttcaagaccagcctgggcaacatagtgaaaccctgtctctacaaaaagtaaatttagctggatgtggtggtgtgcacctgttgtcctagctatttgggaggctgaggtgggagaattgtgtgagcccaggagtttgagactacagtgagctgtgatcacaccaatggatctccaatctggatgacagagcaaggcctatctcacagaaaggaaaaaagaaactttcatgaaatagacaagtagtcaccatattctgttcctatattaagtaaatatattaaatgaatataataatgataatagagaatcatttttgaatgctaaccataaaacattcttctatgcattttataagtgccataagaaattaatactggcatgcagatttcagcaagagtatacctttttgttttcctaaaaggcaattacacgggaaaccaaataataataaggatggattactaccattgagagcaacaaaaattctgaaatttttaaagcaatgagagaataactttagtaagtataaatattccttgtaaaaaaaaacaagcttatatgaatatttaaatttttaagtttataaaaaagatctcttgatagtcatacttcatatgtttgccatctaagtggtttttcattataaatatgaatcatgaatttttgtagatttttgtattatgaatttttatctaaatttaggtattcacattttttgttaaatttcattttgttggattcagcccatcagtctactaagaggtctttttaaaatttatatcagctgtctagtatattacttgtcttttgtagtttctgtcaccagcaaatatgttaagcatgctttcattcaagtcactgataaaacttttttttaggctaggccatttcacatactaccagaaaccctgctggttgtaattgcttaactagcatatttctatttcaacacatcaaaacctacagacctactttctctatcgacaaggcatttatgcgtgacttatcaaataccttaatgaactcaagatacattgcattgacaagttttgggaggttgtttgtttgtttagatggggtctcactctattgctcaggcaggagtgcaacagcacagtcactgtatcctccacctcctgggctcaagcaatcctcccgcctcagcctcctaagtagctgggagcacagggacagttttttctttaataaaactttgtaacatttaattataacctctgaaggatcagtattagaagctctgagaagacatgtgatatatattttctgatataacccatttaggtattatatgtaatcaatcttttttgttcttgtttttgtttttctttctaagacagagtttttctctctggctcaggctggagtgcagtggcacaatctcacctcacgcaactttcacctcctgggttcaagcgattctcttgcctcagcctcccaagtagttgggattacaggcacatgcaatcacacgcagctgatttttgtatttttagtagagacagggtctcaccatgttagccaggctggtctcgaactggctggtctcaaactcctgacctcatgatctgcctgccttgacctcccaaagtactgggattataggtatgagtcactgcacccagcctgtaatcaatcattattgttagttcaggtgctgtatcacacacctggatctcaaataggatttatagaaaatgcagcctaccttaatgatctctaaaaagagaagttggaaagaaagggtgcacattttggacttggccaccaagctggtcaagggatccaaaaacctccaccatagagactgataaattgtagctattgaagctgtacttctttgtacataggtgctttgggagactcactctgattattgtaaatttgctcactagctacccaacattaaattcaaataacagagaatttctattgtacagccttgcaactttgctttaagtttaaacttttctttaaaataaaattttaagtggcaaaaataattattagaagagaaaatgtgtgctcatttttgaatattcttggcatcaaatataaatttgtatgtttactttattggcattcatactgccatttcaaaggactgcagcattcaaaaggggaaacaatattttgactgtgtattctgatttttataatgtaactctccatttcttcttttaaaagtgcctgcccaaccagtgaaattagctttaggacaggaaaaaaaaaaaaaaaaaaaaaaaaagcatagataaagaatcagcacagttcctaggaaaattatgtgttcccattacagttttccttaatgaggaaaattctgttatttaataattcacagtcaaaattacattgcatatctaaagaaagtttgagattatctgggacaaattgtttcctccatgctatgagttgcataagatagtagaaatagattacttctctaaaagtaggaatgttatttcttttgtgatttggcatttttccttctcatttgttctgatttaactcactacaaattctacttgctcaaggtagatcctcactactccatggcaagcctttggttcatctctcttactgacaaccttatatacattgccaaattgcaattttcagacctttgctcttgactcaatttcccctattttctcctcttcttattatattaaaggccatcagagctaaattatttgttctttctatttaaaacaattttcctgaattaatactttgctctattccttctatctcaaagaactgcttgtaattctcagttagtggctgcttctacttccttattattagatatcatctatgtacgagacactgtattcattccttgtttctccctagttgttgagtatgttggccacttattttctgaaacagtcccccaccatgttttcattactgaaatgttttaattaggcaagaacacatgagcacacactcactaaaaaaagaaaatgaaacatagataagattaatatcctttttgaaccaccctctcattcatttttatttaccctcacactcccccaaaagtaaacatttttatcattttgaagggtatccttcaaaagttttctgtacttttctgtaaaaacataggaaataaaatcctaaggtttttgtttgtttgtttgttgttgttttgtttgttttgagacggagtttcactcttgttgcccaggctagagtgcagtggcacagtcttggctaactgcaacctccccctctcaggatcaagcgattctcctgcctcagcctactgagtagctggcattacaggcacctgccaccatgcccagctaattttttgtatttttagtagaaacgggatttcatcatgttggtcaggctggtctcgaattcctgacctcaggtgatccacccacctcggcctcccaaagtacagtttttaagtggtgtgcgtgtgtttaattaagaaagggataaagggccaggcacagtggctaacacctgtaaacccagcactttgggggccgaggcaggcagatcacaaggtcaggacatcaagaccatcctggccaacatggtgaaaccccgtctctactaaaatacaaaaattagctgggcatggtggtgcatgcctgtagtcccagctactcagaagactgaagcaggggaatcacttgaacctggaaggcggaagttgcagtaagccaagatcgcaccactgcactccagcctggcaacagaacaaaacttcatctcaaaaaaaaaaaaaaaaaggaagggataaagaaacttgcaagctgcttctaaaatttatatagatagaattgcaaagggcaaaaaaacaaccaaaatagtgttgaacaagaaaaagatcaaagtgggaagacctgctctaccaaatatcaagatttagtataatgatacgattaaagtaacttcttaatggtgccagaattaatatttagaccaatggaacagaatttaaagcccaaaacacaccaacacacatatggtcacttattgtatgataatttatagtgcagaattatagagaagttattttttcaataaatgatgctgggacaacaggctatttatatgaaaataaatgaaattggaccccctatctcacagtatacaaaaatcaactccaggtgtattagagatccaaacaggaaggaggaaactataaagcttttatagatttttacagaacaatgtttttattatgctggattaagaaaggatttcttttttaattgaattgaagtaaaattcacataacataaaattcaccattctaatcattttaaagtgtgtgattcagtgacttttactacattcacagtgttgtacaactattttatccaattccagaaaattttatcaccaccgctcccaaaaaaacaccttactcattaaacagtctattctccattccctctgcccccagcccctgacaaccattaattggctgtctctgtaggtttacttattttggacataacatataaatgcaatcatacaatatgtaactctttatgtctagcttctatcactaaataaacaacattttcaaggttatccatgttgtagcatgtatcagtactcctttttatggctgcacaatattccattgtaaggtatactgcatttagtttatccatttattagctgatggtcatttgggttgtgtgtactttttgattattaaaataatggtgttatgcacattcatgtatgtttttatttgaacacctgttttcagttctcttgaatatacacctaggagtggaatttgttgtaatatgataattctatgttaacttttaaggaagtgccaaactattatccatagagctgcatcattttacatacccaacagcaatgtatgagggttccagtttctctatatccctgccagcatttgctttttttcttcttttttgcttttgagacagagtctcgcactatcgcccaggctggtgtgcagtggcccaatctcggctcactgcaacctcagcctcccgggttcaagtgattctcctgcctcagcctctcaagtagctaggattacaggtgcccggcaccacgcctgactaattttttgtatttttagtagagaaggggtttcactatgtttgccaggccggtctcaaactcctgacctcatgatcttccagcctcggccccctaaagtgctgggattacaggtgtgagccactgcaccgggccttctttttttcttaattcttatcatctgaatgggtgtgaaatggcatctcattgtggttttgatttgcatttccctaatgactaaggatgctgaacatctcttcatatacttgttgatgatttgtgtagcttctttggaaaaatgtttattcacaccttttgcccattttcaagcgggttgttggtctttttattattcagttgttagagttctttacatattatctggatgctggactctatcagagatatgatttgcaaatatttcctccctttctgtattttgtcttttcactgtcttgataatgtcctttgcacaaaagtttttaagtttaatgaagtccagttaatctaatttttctgttgttgcttgtacttttggtgtcatatctaaaaatccatcaccaaagtcgtgaagatttacctttatgttttcttcttagaatttgatagttgagctcttataatacaattaggtatttgatccattttgacttaatttttgtgtatggtgtaaggcaaggcttcaacttcattcttttgcatatggatatgcagttgttctagcataatttattgaaagaatgtcctttccagttaattgccttggcactcttgtctcaaatcaattaagtataaagttaggagtgcttatttctggaccctcaattctattccattaacctatgtttgccttatcccagtaccacactgttttgattacatagctttgaagtaagtttagaaagcaggaattagcctgacacggtggctcacacctgtaatcccagtattttgggaggccgaggtgggcagatcacttgaggtcaggcgtttgagaccactctggccaaaatggtgaaaccccgtccctactaaaaatacaaaaaaattagctgggcatagtggtgggtgcctgtaatcccagctacttgggaggctgagacaggagaatcacttgaacccaggaggcggaggttgcagtgagccaagacggtgcgattgcacgcgagcctgggcaacaagagcaaaactcggtctcaaaaaaaaaaaaaaaaaggaagaaagcaggaattatgaatcctctaactttctttgtctttttcaagattgttttagctattaggttccttgagattccatatgaatttcaggataggtttttctgtttctgcaaaacacaccagtgggatttgacagtgattgcattgaatctgtagatagctttgggcagtattaccatcttaacaatattaagtattgcattccattaacacatatgtctttctatttatttgcctttaatttctttcagcaatgttttgtaatttttgatatacaggttttataatttcttggttaaatttactctgcatattttattctctttgatgctattgtaaatggacttgttttcttaattttatttttgaacatttcagtattggtatatagaaatacaactgatttttgtgtgttcttcatgtattctacaacttcgctaaatttgtttattagctctacttgttctttttgtggatgtttcaggaatatgtatatatataaaaccatgtcatctgtgaatatagttctacgtcctttccaatttgaagccttttatttctatttcttgccgaatttccctggctagaactttgagtacaatgttaagtagaattggcctgagtagacatcctttttcctgaatttaggggaagttttcagtctcattattaaggaggatgttagctgtgggttttgtctagatgcctctatcaaattcaggaagttgccttatattcctagttttccaagtgttttatcctgaaagcatattgcatcaaatgtttgttctacattaacggagatgatcatttgtgaagtttttttccccttcattctgttaacatggtgtatttcactgacttcttatcttatggtgagccactcttacatttttggaataaatctcatttggtcttgatgtataattgttttagtataatatttgttgtttcctagtattttgttaaggatacttgcatctatatttataaaggatattagcctgtagtttttttgttcttatgatgtcattgtctttagtgtcagggtaatactggccacttaaaatgagctaggaaatgttccctcctcatattttgtagaagagttggtaaataatttttgttaattcttctataaacatttaatagaattccctagtgaggccatctggtcctgggcttttccttgttgaaagtatttttatgtactgattcaacctttttagtggttctattcagattttctatttcttcttgagttggttttggtagtgtctgtgtttctaaatatttatctgttttatctaggtcatgcaacttgttggcatacagttgttcctagtatttaattattatgaaataatcatctggtagtcatttcatttcggtaagctcaacagcaatgttcctactttcattcctgattttagtaatttgaatctttttctctttttgtcagcctacttaaagatttgttcgttttgttattacttttatttttttattatactttaagttctagggtacatgtgcacaacatgcaggtttgttacatatgtatacatgtgccatgttggtgtgctgcacccattaactcgtcatttacattaggtatatatatctcctaatgctatccctcccccctcctcccaccccacgacaggccatggtatgtgatgttccccttcctgtgtccaagtgttctcattgttcagttcccacctatgagtgagaacatgcggtgtttggatttttgtccctgcaatagtttgctgagaatgatggtttccatcttcatccatgtccctacaaaggacatgaactcatcctttttttatggctgcatagtattccatggtgtatatgtgccacattttcttaatccagtctatcattgatggacatttgggttggttccaagtctttgctattgtgaatagtgccacagtaattttgttgatacttttaaaggaccaactttgattttgttgattctttcaatgtttttgtgttctctatttcatttatctccactataattcttattattttcttttgtttgctttgggtttagtttatactttattttatagtttcttagggtggaagattagtgtattgatatgaaatctttcttctttttaaaagtagatgtttacagctataagtttccctctgaacactgtttctctgcatcacttgaattttcatatgttatgttttcatttttatttgtctcaaattattttcttatttcctttatgattttctctttcaccattggttatttaaaaatgtgtttatagcagcatgatttatagtcctttgggtatacacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatggggttgtttgttttttagaaaatgtggcacatatacaccatggaatactatgcagccataaaaaatgatgagttcatgtcctttgtagggatatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagatagagggtgcagcgcaccagcatggcacatgtatacatatgtaactaacctgcacaatgtgcacatgtaccctaaaacttaaagtataataataataaaaaaaaaagaaaaaaaaagtgtttaatttccacatacttgtaaatttctcaaatttctttctttcttttttttttttttttttttttttttgagatggggtctcgctctgtctcctaggctgaagtgcagtggcacaatctcggctcactgaaacctccacctcctgagttcaagcaattctcctacctcagcctcccaggtagctgggattacaggcgtgtgtcaccacacccagttaatttttgtatttttagtagagatggggttttgccgtgttgaccaggctggtcttgagcagctgacctcaggtgatccacccacctcggcctcccaaattgttgggattacaggcatgagccaccgcacctggtcccaaatttctttctgttactgatttttaatttccttccattatggtcagaaaaaatacactgtaaggtttcaatctttttaaattttgtgagacctattttgtggcctaatatatatggtatatcctcatgttcacttcagaaaaatgtgtattctgctggtatcagatacagtgttcctatatggctgctaggtctagttggtttatagtgttgttcaggtcttctattgaaggggtccccaagccccaggccaaggactgataccagtccatgacctgttaggaagcggtccgcacagtgggaggtgagcagcagcgggcaagcaagcattactgctgagctctacctcctctcagatcagtggcaacattagattctcataggagcatgaatgcaagggatctaagttgtgtgctccttatgagaatttaactaatccctgatgatctgaggtggaacagttttatccaaaccatccccaccaacccccagtccgtagaaaaattgtcttccataaaaacactccttggtgcccaaaacattgaggaccgctgttctattgtacttgttgatctaactagttattctaactattattaaaagtggaatattgcagtctccaactcttatttttgaagtttttctctcttcattattatcagtttttgctttatgtatttttttaataattgttatgtcttcttgattaactgacctttttatcattatataatgtcttttttgtctcttataacagttttggcttcaaagttgattttgtctgatattactgtagcttctctagctgtcttttggctacagctcccatagaatatctttttccattccttcaccttcaatttatttgcgtctttggatctaatttgaatctcttgtagatagcatagacaatcatactccacttaacaacagagatatgttctgagaaatgcattgttcagtgattttgtttttatgcaaatgtcacagagtgagtataattacacaaacctagatggtataaccaactacacacctaagccaaatggtatagcctgttgttcctagtcctaggctgcaaacctgtacagcatgttactgtaatgaatactgtaagcaactgtaacataatggtaagtatttgtgttttgaaacatatctaaacatagaaaaggtaccagaaaaatatagtattataatattatgggaccactgttgtatgtgtcatctgttgtctatcaaaatgccattatgcaatgcatgattctagttggattatagtatttttaattcattctgccagtttccatctttgaattggatagtttatgtacatttaatgcaattactataaagaagggtttcttccattttgctatttttatataatatcatttttgttttttatctcctctattacttccttttttctgtatagatattttctggtgtaccattttgattctccttgctacttttactaactattatttagttattgtgttagtggtttccctgggaattacaattaacatcttagctcataacaatgtagtttgaattaataccaacttagtttcaatattatacaacaacttcataccttgtccactacttacgttattattttcataaattacctatcaatatattgtatgcctgtcaacatagatctataatcattgctttatgtagtttttttaattatatggggcagaaaagaggattcacaaacaaaaatatacgtgagatacgactgacctttgtgtttacctatgtagagttctgtatttcttcatgtcagaggattcacaaacaaaaatatacgtgagatactgacctttgtgtttacctatgtagagttctgtatttcttcatgtcagtcacaattactatctagtttctttttatttcagcctgaagacctccctttagaatttttttgtagggcagatttatgagcaatgaactcactcagtttttgtttatctgggaatattgtaatttttcttcgtttttgaagtttagttttatcagatatagaattattggttgacagatttttcatctttcaacattttgaccatatcattccactgctttctgactgtcatggtttcttttgaaaatcagctgtaaatcttattgaggatcagaattctctcttcatctttgtcactttcaacaatttgattataatgtatcttcgtgtcagtcttttttagtttatcctgcttgggattgttgaacttcttgtgtgcattcatgtctttcatcaaatttgggaagtttttaggcattgtttcctcaaataatctctttgcttctttctctcctctccttctgggaccaccattaatcatatctcagtgtgtttgatggtattccacaggttgcttaagccatgttgttattttcctttatttaagccatgttgttattttcctttattttttttctttctgatcctcagactagataatgttaatcaccttattttcagctcacatctgctgttgagtcccactagtgaatttttcatttccgttgtaattttcggtgttagaatttgtatttggtttctttttatgatatttgtctttttattgagattcccagttggtgaggcatcattcttgttcttgcctttagttctttgtttatagtttcctttagctctttcagctaaactttattaaaataattaatttaaaatctttgtctagtcagctcagtgtctgagctttctcagagacagtttccgttcatttcttttttcttttctttttttttttccctgtgtacaggttatactttcttatttctttgcatgcttcataattttttgttgaaaacttgacatttaaatattataagtggcaactctggaaattagattctcccctctccctggggctttttgttgctgctttttcagcagtagtagttatttgtttgttattcattttttgaaatacttttttcaagcttgtatttctttgttgtgcataacctctgatgtttctgttgtttgcttagtggtcagctagtgatttgacaggtatttccttaaatacctagaaccaaaaaattaataataaaaacaaaacaaacaaatcagagaaaatctcccagtttttgcagatgagctctttgtatatgttaggtcacacttcaacactcagccaggcaatttacagctcttcattagttttcacttcctgctggtatagagtctcaaatttatccacaagtgagagaatagaaccttctcaggtcttttctgagggtgtgcccagccctgggcataaacctgaccttttagagtccaaaggatacatgggagcttttcagagtccttatgccttaaagtacctcattccataaccctcactcccaggtttttcactttatctattgtttgtcctgtttttccatgcccagatgacagtggctaatacatttgcctttaaatatttgaacaaacattacccaatgaatagctgcctcaaccctgggaatattctgagttaagtgaaataaaggcaggccctttgagtgtgtccttcaataagccataagatatttcaacacaaaaaaaccacaattctttcagaataaggtttgttttccttctggtactacagacctgtattggaaatgtggactgttgtcttcaaggccaccttttttgtctatttttcttgattacccatttacctggttgtaaacattttattcattttcagagttctggtaaagtttattctgcctgtttttgccaatttattttctgctttagtagagtgatggaattttggatttctctactctgctgttttcactgatgtcacccaggaaggattccttttaagacacaaaaaccactaaccataaaggaaaatattgatatatttagcaacattaaaattaaaagatttcgttcatcaatagacatgataaagtaaggtaaaagacaagctacagagtaggaatagatattcacactagatacaactgctaaaagactagttatccagaataaatactaaaatctaacaatttaataagaaaagaacaaccaaataagggaaaaaatgggcaaggatttgaacggggacttcacgagaaaaaatctaaatgactgaggaatgtatgaaaaagtgctcactctcactaagaatcagagaaagggaaaataaaaccataatgcaatattgttacacaccaaccaaatttttttaaatgaataataccaacaatgctgggtggaactgagttgtagaataagagaaactgttactattctttgtggacagatgtatagattggcttaaccaacttagaaattttttaaagaaggtattcataccctataaccaaccattctatccctgaatgtgtatatatatatatatatatatatatatatatatatatatatatatatacacatatctcccagaaatttactcacatgggtatcataacacccatgggttcacagtggcatttttcataatgtcctcaaaatgaaaacaatgcagttgtctatcaacagagtaatctatattcactgactccttttccttacctccagtttttttcttgaccccttgtaatcaggttctgtcttcatcaaataatgaaattttctttcaggtaactaattactaccatcctgttcttcataatctaattcttcaccctttttctagtatctgtgttgacatattcttctatgttcttcatctttagaatctcatttatttctgtaacttcaacaactgtatatctgcaataatttctaagtctgtatctccagcataggcagtttttgtttttttttttaagattggggcaaagatttgttctagactatgtaatgaaattgtaaatttatgtttactgatattaactggatccacaatggtaattgaaaattcttttgccttacccatcattttcattcatcaatgcattttttgagaattttaccactctcctaaagtcatctttatcacttttacttccccttattctcatcaataaggcctctcctgcaagcaccaaaaaaatagtagtaataaatatctgtgtcttttacccacaatttactttgctttatcatgcctactcaattcctccatttgtatctactctttttacttaactggtaatttctttaataactggatgtaatggcttcttttcagctctctctctctattcctattctctcccatatttgcttttttttaatcttgcaactttcttcttttttccattgccttgatactcacccatctcgatttgcctcttttttctctaataatttcttatgataagaacaccaaataatttatcttccaaaccagaatgcttttgaaaatgaaaagaggtgctgtttgataattaagccagcataataggtataatcctagattgttcaaggaaaaatcagatgtatggttaccccatacatccttatcttagagatcttatctcccttcagtttgttttcttttgttaacttttaatatgaatgttacctcaaattgtcagccatcgtcttttgttctttcacatattctctgcaggtgatctgacacatttgaatgactcaaattactacctccattgataattcccaaattatatgtcctaactttttcctgagttccagactcatatacctcatcaaatagctccagattagtagcccgaaagtacctagccacaaaatttaaacttatcttctctctcgagtatcctgatttttaatttacattgaggcatatatacacacagagatatgtagtgtatatatgcagttatgtgtataagtctggagatatatatcacacacacagagacattattcgtgcagttgcttcattagatattggacataaaatagtagcaaaacagttccatcatgacagtgcattctcatatgggagacagacattgatcaaagtatcacacgtataaatgttgtgatactttctgtaagtatggtcattgctatgaaggagagggatgtgatgtcatatgaagtataaaatgggtatttgaccttcttttaaatacatggcctttttaattggataagtggcaacaaatagctcttcaaaattagactttatttcttggaaatatttatgacaattcagtactcaaatatgttagcaaatggagtcgtcttgcttctcaaaattcctactgcttttcatactatttatgactatattgtttataaaccatataaaatttcaaacactgaaatggtggcaatatctttggaattaaggatgttggtatagaaactaaataaaggagcttctatagaaatagcattagttttgtgaggcagaaatgatgcataatattaggaataccttgtagtcacaaagtctggctgtttcttcttttcacatagtaagtgatatttgttgattaaatgttaattgcttgtctttttatcatatgtttcaagtcttgcgtgcaaaatttgaaagtcctcatgttcccattcttagaagacgtatgcccgttactggtagcccagaacatgaactaaattatgcaaggcctaaagtaataaatttataatcaacatatattaataatgttaaaaataatctacagtattagtctttatgtttgtatatttttagaataatgataattacattagtctttactatgttgataagtataataataacagtaataataaccaacacattaaatatttaccacttgaaagtgctaaataatctacacacattattttacttaacccttgcagtattccagtgaagcagattctattgttgtcctcaattttcagataaaggaagtagcaattcaaaaggtatatccatcaggatcctagcagacgtcagatagcatgcttaaataggtaattgaggagagttcaataagaacctataggatgtacaaaggtttggacagaatttagggaaaaccacaagacatcatggaatgcctgggattagtaacagtgggaaccattaatgcttctacctaatggggcaaagggaaggagtgctattagaatctagagaaagagctataagccagaagggcagtctgacatgagctatgatcttgagttgagtgacacagccaacctttgatgatctggtagagagggagctaggagaataaatgccagatcttaccctatcccaactcagtcttctgccagtgcctttcactgactgaacccagctggaagccagggcagaaaataatttgttgatggtgtgcatacaggtcagcttagagaagagagggtgaaaatggttggagactgatctgaaaaggaaatggaaaatatataggaattaaatagcttgctcaagatttcaaactattaaatggcatagcaagtatatgaatgaccaatcctttattcctaaccacaatactatactgcctctcatattaaaaagttttatgaaatggtacttgccagggaaaatactttaaatctgaaagtttctattctatctcaagttgttggatgcatttatacctaacagtaagtgacaccaaatatgtcagagctgagcagcaaagaatgctaaaacaaagggggtcttgattctacatgttattgacattttcagaatattaaaccatagttgttccccttgttcagattccagactccatcatttctcgtggtgttcaggtgctcccacgagacacagcctccctcagcactactccttcagaatcgcctcgtgctcaggctacatctcgcctctctacagcttcctgcccaacaccaaaagtaagtatggttccttcgcatcttacacctgctcttctatagtaatctgggaaaactaaccaatatttcctcctgcttgtcaaggttggattgcatgcaagattacactgtgaaaaatgaataaagtgtaagatagttcccacccattgtgtcacaaattgtcatattaggccactagtaggacaatacagatttcattcaaaatgtcttactcctacatcatagctaagggtattactttctgtagctcctgtttctttgttgtagatttgttattttttagtatacttaacattatagatgtaaagttatttgtttatgccgaggataaatgtacttttggccagtaaacagcaagattaacaaaattgtgtcaccaaagggatttctttaaacttgtccgggctggggtagctccctgctctagtatcattccaaattttttcaaacattcatcttggaatgttgctgcctaatatttgcaaacaaatctaaatttattagaaagaaagttttaatgccaacctttgggaagagggtagaagtttcttagtctttttttttataatctgtcactgaattgtatagggtgaggaaaggatgagacacttatatgctgttcacatctttgtatacatgataaattaactagcagacattattactgctgtgactactttctcctggaatgctccttgcctgattaagttagtcatttgtgctttcaagttctctatgtgatggatgcaatattggtatcaaaagattaacagtaacattccttattatttaataagacatgatgttagacactaaatttgttttaggattctgacagttaatttttcaaattatagttttttctctgtcatcaaatttaaggacctgtatagctgtcttcctcaattccatcttttctatcagttttgtgaatgttataatttaatttgactagaagggatctcagtttctgatgtgaatagtgcagtttgttttacattacttgttacaatcttctcagcaatgtttccagtgttactgttgtatatcattatttttagatatatgtcaaaaaaactgatattaattttatcatttaaaaaactgaggtcctgaatcttcaataaagataaactataagaacattgtagacattaaatgtatgccagtgccatttgggtgccagtaagctacattttcaaatgcataaaagcaaggaattcttaaaacctgaattagatggaagaatctcatctatatcttttatattattaaaacaaagtaacttacagtttgactgcattaaaatccagttgtaccagctaaactcacttgtaaagtctagaaaatatttaaaactaaaagttaagttcactataagatgttttgttcactgaatattaagacctaaaagttgggaattcagaactattcaaggcatagttgcttttccttaataatatgctgaaatcataaatattttttgaaaatattttatgctaaatttaattatacatagtagttcttgagtatttttataactttgtaattatattttagttacaaagaggatattaaataaaatttgaaaaatcacttggtacttccaaattcaccaaagtaaaattctgaaaaataataatgttaatattcgtcaaattaatttgcttattgcagaactttaggagagcaagtggcttgtcttgatattttttccttagttaacacttagatgttcaaattgacagtgaattcataaaagcattatatctttttctaggaataagattatatttcttttgaataattttgatcagcactagaatgtatacctcaaagataaagttatcactctggtgtaatttttaatatacacttgaaatgctgaattagaatattaatataataaaagaaactagtttgaatgttgatattttaaaaggagttagtctattccaattaggcatctggaaataacgtttaaaaaataaattaaaggacagaaggaagtgaaatttgtctttctagtaagaaaggtctcataaatcataagactgcttaagagaatctaaactaggtgcttttataagtgctttaatatcagtgacaaatatactccttgtcttcatggagtttacaatttagtcatatattacaggttgagtatccctaatccaaatgcttgggaccagaagtgtttcagatttcagattttttcagattttggaatatttgcagatacttaaaccagttgaacatccctaatcagaaatccaaaatactccagtgaacatttcctttgtgctaaaaaagtctcagatttcagattttcagatagggatgctcaacatgtaaaataaacaggtagataataactttaataattataatttcatattaatttaataattataatttaaatacaatgcatgctaagaagaaatgaaaatgttatggtagtagaaaataatagcaggggaacttcatttagatagggtgagtagagaagacctaacatttcaccaggggcgtgaagaatgaatgaaaaccaaatgtgagcttttgtgctatgtggaggttttaggaattatattgatcaataatgaccactttaaaggcaggtgtcaccaatcaagaactcttacactaaaacttcattagtatgtgaatagtctaattcagtgatgtcaacagccaatttcaaatatctgttcttttttatttaaaataatgaatctttttgcctttccccactgagtcaaatatcaagaccatagattttagcaccgagctctgtttaataaaaaattaaaatttattttaattttttagcataaaaatttggggccgagaagtccaaaagcaatttcggggtttcaaatttgagatactgggtagacaataatgttattaactataccaaggaataaaagagaagtaccaagtcttgagggtaaaagaaaagagtttaatgcatcttgattgggaatgtgtttaatctgaggcatatgtgagacaaccaaggagtgatatccagcacaaaattggaaatacaatttgagtttgaaattcttatttttactgcatcttggttatgatatttataacttagtacatattagtgttagccaaatcccatagaaatcctttctacatttcaaattcggcatgcacagattttcatgcacagaaatgtatgtgcaaacgtattttgtctacatcagaaatacaatatagttttgaatgatcggtactagaaagagcacttgacttgataatagaagatctggatggaaatgcttttttctctacctcataaccacagtaaattaagcaagttacttaactttactgagttttgtgtctattatttgactgaccatccttacctctacaacagtgtttattaactcattaaataagtctttgcctggtagtagaatagcaacagtgagcaagtagacattgttccaacttctacaaatagatcagacaactaaaaattaaaataaagcataataaattctagaattgattatcaagaatacataatattatggaaatagctaccagaagcacttaaccaatatatagatatattgcagtataacatcctaaattatatattgaccgtttaagattctccagctatagtgagaacaaaatctataaaactataccaggtcttgatttctttttgttttttttggtaccctcattacaacctaatgaagataaccatgtattatcttttcttaacaattcttcatagattatattttctccagcaaatttgtttgctgaaattatatcgtatatagggaaaagtcatttctcttttatatcatatattttcttttaatgaaatctgactgaaatgaggaataattttcactcctcttgctttatgacagtgaagtatctttcaagaacaaagttgggatatttgactttcattgtcctgagtaaaatagtgcctaagtcaaatagtacataaattatatttaaagaagtatagacaatatctagactcaagttctaaaataatgatagtcttctaaaaatgatttgctggaagaataattctgtaattgataaattctcttttaaagtgagcatgattcatagcttagatgagtgctgattttcaattatgaaggacagcagcatctctatttagaaataaaatcaaggccgggcacagtggctcacgcctgtaatcccagcactttggaaggctaaggccagtggattgcttgaggacaggagttcgagacctgcctggccatcatggcaaaaccccatctctactaaaaatacaaaaaattagccgggtgtggtggcacatgcctgtaatcccagcttcttgggaggctgaggtgtgagaattgcttgaagctgggaggcagaggttgcagtgaaatgagatcaagccactgcagtccatcctgggcaacagaacaaaactctctctccaggaaaaaaaaaaaaaaagaaagaaaggaaaagaaatcaagaagcttaaggcagaaaataatgattacagcaaaaaataaaaatttttcaaactttcaatttaccattcattttagatgttattaaaatgaagaatatttttaaacactaattttattatcgttttattccctaaacatctgaagtttgattttgagtaagtaaatatagtctatagtcacatatgttcctgtaccttaaaagttagcaaagaattttgtgcttagaataaccagcaagttgtgttttttttttttttttttgctcttaggaagaaaatataaatactatcaatatctaattgaagttatcaatatctaaagtttatacaacaattaaaatgtagatgtattgaaatatctttatatgagggatatatacctttaatccactaatgtctaatactatattcaaacaaaatatgtaattattacttctttgtaggtttctcttactgtcctttgagcaaaagaatttagattgctctggttaagttatattcttaactcagggtttttaatgtatgagtctgaaaggcagtgtgaattcctttacctataaaaatggcactgctgattctatatcagcataatattttctctgggatgttttcctagtagtgttagtttttacaaagtattgaatattgtcactattttcctttgtgaacaccagggtgattatgtgatatggctaggtcattggctaaacctgggttcccaagtctctggagaagctcataaaatggccatacttccagcctaaatcaagtcactaactggtgacggcaaattatttttttcctatttttaagagcctaaccaaaatcaataagactatactagacatcaagcttctttgcttttgctgaaattatatcaacattggtatgacaatatgttcagctattaatgacattatagaaatagattctacacataccgtcaacacacaacaaaaaggttggaaaccagtgaattagtgagatcaaaaatacattctctgaacaaaaatatgttttcttttgtgaacatttacctcatctggggggtgttgagcaataatattctctgcattattggttagatccagcatttctcaaacatactggtctccagaccccttcatgcttttaacaattattaaggaccccaaattacttctgtttatgtgggttatatctaacaatatttgttgtactaggaattctgagggccaggcatggtggctgtaatcccatcactttgggaggccaaggcaggtggatcatctgaggtagggagttcaagaccagcctgaccaatgtggaaaaaccctgtctctaccaaaaatacagaattagccaggcgcgttggcacatgcctgtaatcccaggtactcaggaggctgaggcaggagattcgcttgaacacgggaggcggagattgctgtgagccaagatcatgccattacactccagcctgggcaacgagaacgaaactccatctagctagaaataaaaatagtaaagcctttacatgttaacataaacaacatattttatgaaaaaataagtatattttccacaaccaaagaaaatctgaaaataatggcattgttttacattttttcaaatatatgttaatatctcgcttaatagaaaatagctggattctcacatttgcttctgtattaagtcttgtaatatgttgttctgattgaagaataaacaaattgagcctcatatagatatatagttagaaaaggaaggactatattgttcacatttttttataattgtggatgttctttgataccataccaaaaatttacaatttttagtttagtaaaggttagttgaaatgttgaatctaaaaccctggctaggaccattccatactcacaccttaaaatccattggtctgtcttgcacttcaaatggatcttttacccaggcatgattttggaacacatatattggtcatttggaaaatataaattcttccaaaagttgacatattttgttatattatatcaaaaagtcaccttcattaatataatcaccaagctcatctaaaaagtctggaatgtactggaagctcttaagctcatagtggcacatagacattttctaagttctaatttatgctttgaagctagaaattgggctgggcgtggtggctcacatctgtaatcgtagcactttgggaggctgaggcaggcgggtcacttgaggtcaggagttcgagaccagcctggccaacatggtaaaaccctgtctgtactgaaaacacaaaaattagccaggtgtggtggtacatgcctgtagtcccagctgcttgggaggctgaggcaggagaatcacttgaacccaagaggtggaggctgcagtgagccgagattgcaccattgcactccagccggggcaaaagagcaagagtctgtctcaaaaaaaaaaaaaaaaagaaagaaaaaaaagaaaaaagctagaaatagtattactggcaaaaaagcaacaaatagttttttcttaaattgacagactttgtttatttttgagaaaatgtataccaaacatctaagtctgaataataataatttattagttatttcattctttcaagtaaaaatggtattctgtattaaaaactagctattcagcttacaactcaaacaattgcataaataagtgattttccttgagacaaccaccatcctttggtatgcagaagtattttgttcatacgccccattttgtcacattcaaggctcaagttttaattaatttaattttcccattttgtcacattcaagggccaagttttaattaattttaattaattaaatttaatttaactaatattaaatagtaaatttaatgtgtattaatattgtcatataatattgtaattactcatgtaaatgtaaatattacattgaggatatagtaaatattaaatttactatgtcattgaggacagtatttcaaactagcttttttaaaaagaaaaacagaagatggcagtgaatagaacagtgattgttcatactacttggatctactgccttaatttatactaggatgtcaatccaccattgattttgtaccatcagtgcaaatgtcaacgtagccaaaaaggcaaataatgtctgagtactattactaaaataattttgactttgtcaagccctgaaagggtctccaggaccctcatgggtttgtggatcaacttaaagaaccattgataaaatcaaatgagcaaactggcttatgtttcttgaaaatattctggatgaaaatgatggctattgaatcctttatatatatattttttttccatagaagcagtattatagtggtatactcagtccaagagatctgatccaatgactaccggtaccatggttaagcattataaatagtttacctgtcctctgtgatccaggttaatcctagggcagggaacacctacacctctctgattccaatgacagacttcattaaatttttgaagatataagaccagaagttataattcccagctaactccattcattttcaatgtggtattacttctgcacttggataataactaattttccccaggatattctgtctactaatagataacatacaaagccctcttttaagaaataggccagacgtggtggctcacacctgtaattccagcactttggaacgccaaggcgggtggatcacctgatgtcaggatttaagaccagcttggtcaacatgctgaaaccctgtctctactaaaaatacaaaaatttagctgggcgtggtggtgggcgcctgtaatcccagctactcgggaggctgaggcaggagaatcgcttgaacccgagaggcggaggttgcagtgagctgagctcacgccactgccgtctagactggtgacagagcaagactctgtctcaaaaaacaaaaaaagaaaagaaaaaaagaaataacctggttgttggcagataattctattgagtatataactggggatagctcatttttgaaatcagtttagaacatttaaaatgtgggaaattcaaataaaaatgcaaattttcactgttttctaaaaagtcagatcaacattgctggcccaccactgatataatactctatatcaatactcagctaatattctttagaccctccagactattttactcacttacattaaatgcctgactcctatggacatttaagtaactgatttctgccctaattctctgttatctaatttctcctcccttataacatgtttgtttggggatttattctcatttgttagcgaagcagaattttgagacttcaaataaaagacaattcctttacacccttttctaatgagaaaggcactacctagtatgggaaagaatttaatattttgatgaaactaaaattacacaataaagcattttaactatttttggtctataacttattttcaatagttttcctctgatgttctgctgggtatgtaggattttacctcgatttttcttttttcgttcatgcaagtgtcccctttgtttttcattataattatcattataatgataattgaaaatgaaacttccccatctatttctaattatttaatggtcacagagctatgtttattactgaagctaaatgtaacaactatgaaatgtataattgccactctgaagtctaaacttgcaaatgaaatttgatatctgagaagatatagcaaaccaaaaattgctaactgtagaattaacattttatagctaagacagactgtaagtggtatagtttctgtatagtttcttttttgtttaaaaaaaatgtacttactcatttggaaaaaatttttaaaattcacataaaaaagttcttataaaatacccttcataaataaccactgttaaaattttgctatgtatcattctcttatgtttttctatgcatttaaattcttatcataccaagaaggcagtgattaagagctcagtttctggagtctgacaggcctgatgatgaatcacttaatacatgtgtggctttcaaaaagttacttcacctctataaccttaattatctcatctgtaaaatgaaaaataatgatactatttgcttcatagggttgtcttaagaatttaagttaaaaatgtatataaatcacagcacaatgattaaaatataagtactcattaaacagtagccattattattaaattgtctatagcttttaacctatcttgcttacttagtaatatgagcatctttctatgtcatgaacatctttatatgttgtaaattaccttctacaatattacttggatttttgatattctaattgatagatgtgacatagttttttcaccaacccgtattttggatatttttgttgtgtcttattttctagttttaaaaacaatgctgtagataatctttcagaagttaaaggttttggagtcatctcttaatcaaactcagtaacttctgttatttctacttttattgaaagtatatgcagaacttttaggtctaagatttctatattttacattgacagcaggaatagatcatttttatgtcttcatgagtttaatgatatattggaagaagcagtttttagcatttgcatttgactgatttactggcagacatttaaaaactataaacccaaagtcgtctgaaaagctaacaagcttgagtgtgtaaaaatattatactgcgaggcacagcatattgagtaccagccctaggctaccatattataactttatgagggctgggcacagtggctcatgcctataatcccagcactttgggaggccaaggagggaggatcactgaagcccaggagttcaggaccagcctgggcaacatagtgagaccctgtctctacaaaaaaaaaaaaaatttaattagctgggcatggtggtaagtgcctatagtgccagctactcaggagaatcacttgaacccaggcggttaaggctgcagtgagctgtgatgatgccactgcactcccagcctgggtgacaaagcaaggctctgtctcaaaaaataataaataaataaaactatgaggactagttgacctcagtttctgttatttgtaacaccaagatattaaataacctctaaagtcccttgtaggcttataattcttttcttttgaaatagttccagtatcaactaaaaaatatttttaagcccttctctctctgatattttattaatctccaattaatacagaataatttacatgtgtttatcttttgcattctgttctagtacataaagtactagagacagagattattaacagaaaatgttctaacttcacttaagatcttttacatttaggtaaagcttgtctctgttaaatgaaatattgatttctctcgatatccactctagttttgttcaagttatgagaagatagggaagtgaactgttgaaatacaagaaattgtgaaattaagaatactagcattcagtataattaaatagctttgattcatttcaactgtttttaattgtttgggacatattttgtataaaacagcccaacaaatataagtggtccgtcctatcattatttcagcaacaaaatttgttagatattggcatgatttagagctatttaatatcccattttgactttaatatagagtacatcccatagtaaactatcctctggatcttcatatcttacaaggatacatattctaaaattaggtattttctggcccaaaatttcaggattatctccctactcattctacttttgttaaagagaaaacacagagtaattcagaaattcattgaatatttcagtgaatatttttaaatgcatattatatgtcaaatactgtattagctattggggatacagcaatgaatagacattttaaccctgttcttaaggagcttatagtggtaatatgtgaaaataaaatatttacaagaaatctaccatatacagggttgacaacctcaaagagctcttctaatccagtaggaaaaagtaaaaaaaggatgagtaaaaggtaagcatagtcatttaataaaataaatacatgcagcacagaaatatgtggggggggggggagtacactctcactagaaatctactaaaaatttaaaacaacacaaattttgcaatcaaattgatgactatttaaaaactataatcatcagtactgtaatgagcaatgacatgagtatttcttttcagactaataggaatataacctttcaagcaataaattcgtataacctttcatacacatgtgttgtatacctgtgttctctacttaaaaagtatatacaggccgggcgcggtggctcatgcctgtaatcccagtactttgggaggccgaggcggatggatcacgaggccaggagatcgagaccatcctgactaacacggagaaaccctgtctctgctaaaaatacaaaaaattagctgggcatggtggtgggcgcctgtagtcccagctacttggaaggctgaggcaggagaatcacttgaacccgggaggcggaggttgcagtgagccaagatcgcgccattgcactccagcctgggtgacagagcgagaccccatctcaaaaaaaaaaaattatgttttaatcagtcattttgtctctagaaatgtatccaaaataaattattaaagaggccatctcaaactatgtacaggaatttttatcacagcattatttatatttgtgaaaaattagaaataattttaatgtgtatggaaaataacttgtattaatagtacacacatatataagttattctataaccttaaaaatcatctcattaagaatatttaatgacatgagaaaatgctgaaactacaatgtatagtttaaaaattagtaaacaatactgtgtaggaatagaatagcaaattatttcacaatatacattatttttaaaaccaggaaaatatacatatctgtttggtttttgtttgtgtattttttagataggatctggtaattacacggatgtcctttggcctatttttcagatttgtagccaaacttaataaagccaactagagttatttatacctatatttacaggcataccttggagatattgtaggttcagttgcagaccactgcaataaagcaaaaattgcaataaagtgagtcacacaaatttttcggtatcccagtacctgtaaaaattatgtttatactctcctgtagtctattaagtgtgaaaaggattatgtctaaaaaaacacactgtgcataccttaattaaaaaatacgttagtcctaaaccgttattacaatcatctgagccatcagcaggtcataatctttttgctggtagagggtcttgcctcaatgctgatggctgctgactgatcagggtagtggctgctgaaggctggtgtggctgtggcaatttcttaaaatcagacaagtttgccagatcgattgacccttcctttcacaagagattttgctgtagaatgcaatgttgtttgaatgcattttttctacagtgaaacttccttcaaaattggagtcaatcctctcaaaccctgctgctgcttaatcaagtttatttatgtaaaatcatttgttgtaattccaacaaagttcacagcatctttaccaggagtagatttcatctcaaggaactcctttctttgttccttcataagaagaaacttgtcatctgtgaaagttttatcatgagtatcacagtaattcagtcgcaacttcaggctccccttctaattgtagttcttttgctatttctaccacatctgcagttctttctcctccaccgaagtcttcaactcctaaacatccatatggttggaatcaacttcttccaactcctattaatgttgatattctgggctcccatgaaccaaaaatgttctgaatggcatctaaaataatgaattatttctggatggttttcaatttactttgctcagatcaattataggaattactatatggcaactgtatagccttacgaaatctatttttaaaataataacatttgaatgttgaaattacttcttgatctgtagggtgaagagtggatgttgtattagcaggcatgaaaacattatctccttgtatatcccaatcagagctcttggatgactaggtacaatgtcaatgaatacttatattttgaaaggaatctttttgtctaagcagtggatttaacatatttagtaaaccatgctgcaaaaagatgtgctgtcatctaggctttcttgttccatttgtagagcacaggcagggtagattttgcataattcttaaaggccatagtacttccagaatggtcactaatcatcggcttccacttaaagtcagcagctgcattattccctaccaagatagtcatccagtccttttaagttttaaagccaggctttaacttcacctctctagcaatgaaagtcctagatgacatctgcttccatttatataaggctgttttatctacactgaaaatctgttgtttagtatagctgccttcatcaaggattttagctagattttctgggtaacttgctgcagcttctacagcagcacttgctgcttcacattgctcttatgttatagagacatcttctttccttagacctcatgagccaacctcagctagctttcaacttttcttctgcagtttcctcaccttactcagcattcatagacttgaagaaagttacagccttggtctggatttggctttggctttaaggactgttgtgactggtttggtcttctatccagatcactcagactttctccatattagcaataaggctgtttcactttcttctcattcatatgttcactggcgtaccactttaaatttccttccagaacttttcctttgcatttacaactcagctgtttgacacaagtagcctagctttctggctgtgtcagcgttcagcatgccttcctcactaaacttagtcatttctagcttttgatttaaagtggtagacatgcaactattccttctacttgaactcttagaggccactgtaggtttattaattggcctaatttcaatattattatgtctcagggaatagagaggccagcccacagagaggtagaaagacaaggaatggtcagtctgtgtagcagtcagggcacacacagcatttatcagttcagttcactatcttacatgggcaccatttgtggtacctcaaaacaattgcaaaagtagcatcaaagatcgctgatcatagacaaccataacagatataatcatagtaaaaagtttgaaatattgtaagaattatcaaaatgtgacacagagacaggaagtgagcacttgctgttggaaaattggtgacgatagattcgcttaacacagggtagccacagacaaaccttgaacttgtaaaaaatgcaattatccatgaagcacggtaaaacgaggtatgcctgtataccacagcatttttacatccaggctaagccagtctcttcttaatcctgctggatagaaaattttatcatatttcagtgaaagttcaaagataaacttttttttggtctcatgtgcaaataataaaaaaaattaagaacatataatgtgctgcctaaaggttatttattttaacccacataataactcttttattaaagatgggttttataatttctttttagacagataagaaatttggaaaaaataatttcagtttaattattctctagttagtgaacaggaaataatttatataaaggtctaattttatatagattagatttaaaggtctaattttgtatagattatactgtcttggaattaaaactatatagaactttaagatcaaaattataaatgtgtaataaaatataaataaataaatgcaaatgttaatatatcattagacatcagaacctttaaaaaagatgatttcctggctgggtgcagtggcttacacctgtaatctcagcactttgggaggccaaggcaggagtatcacctgaggtcgggagtttgagaccagcctgaccaacatggagaaaccttgtctctattaaaaacacaaaattagctgggtgtgtggtgcatgcctgtaatcccagctactcgggaggctgaggcaggagaatcacttgaacccgggaggcagaggttgcggtgagccgagattgcgccattacattccagcctgggcaacaagagtgaaactccgtctcaaaagaaaaagatttcctaaggataaaaatatggcagaggggtttagaggatctgtaacttgccaccatgattctaacttttgacttctcacttcttactctttgcaactttccttgaccttttttatccttttattagtttagttttataattgtatttcctttcctccagaaacacattagcaattatttttccttgacacatttgtatattaatcacctctctttcatttctttcttccttcctttatacttatcttaataaatcacaaattaaaatgttctatgatgaggcaccagctttactgaaagggctgaataatataatattatagtgaagtgaaatattaacttaattccaaaagtactttgttatttataggaatttgtttaaatgttgagctcttaagcaaaactttaaaaaaaaaatctctttctccaaatcatagctaccagaaacgatctatagctgccccaatatatactgagtgatactggttggaaaataatttctaagaaaaaagttttatttcttttcattgataatcataatttttttaaaaagccatgatatggtataataaggttaaaaatattagtctcagaatagttctgaaggtaaactagatctaaaaataaaatggccaactccttagcacaaacaaacagaaagaaatgttggtttaatctatgtaattttattctaaactgatacaaaatgtattatggagagaaggggagaaggtctacattcgttattccataggtaagagactaaatttaattaaacaacctgagagtcagaaggtaatatcagctgtactttcatattatttattgatgcattcagaaagccactgaacttctccagaccttggttcccttatcagtaaaagaaacacacaaaatatacaacattttctaaaacattttcactaaacattttgtaactaaagaaaaatatgaatgtatatacccagtgatatgtgagtgtaccttaatgcagttatcataagcctgaaatttctttgaagttttgtattttattttaaaaattaatatcaagttgatttttaagctatgaaatatatgtttggtttaattaaaatactacatttacaattatttttggcaagagaagtgagggtggggctagatagttttctaccttgttaatggtagaaatcgttttcagtgagctcagttttgggaaactgagctaaatcaaagggaatcaacatcacatattagtttaggatccaggcaatttcttttgttgcataatattactagaatccaaattcttggaaaaaaaagtaaatagaaatgtcaaagtcattttactacaggccagatcctggtaattaatcactgaggatagtttccccagtaattaatccctgaggaaagattcccagaatgttgcaaaagaggtaatacagtgcaacattttcagaatatttctaaggaatactttgttaaatatattctagttgagagactgaatagaagattgaagtattttggatcccatggataatatcttttaacatcttggtaaaatacttgtcaaaagatttcttcatgattaatgatgacattttttgttttgctcctaaattttgattatcaatatatataagtaaactagtaatctcaatttactccacaatcctcacaattatttacattcaattctcagactttgtttataatgccgtgatagtacaatataaacatttacagtttaacctctcttagctactgatagtgttttgcctttagaaaagtatgaataaaaatagctaatgatgtgaagctcttattattaagaatagtaaagtcattcatcttatctgaatgctaatcttttgtgatttcttttaaattcttatctaaaatgtaataatcaagcatttggccgggcacggtggctcacgcctgtaatcctggcacttttgggaggccgaggcaggcggatcacataaggtcaggagttcaagagcagcctggccaacatggtgaaaccctgtctctactaaaaatataaaaattagccaggtgcagtggtgtgcacctgtaatctcagctattcaggaggctgaggccggagaattgcttgaacccaggaggcagaggttgcggtgagctgagatcatgccactgcactccagcctggatgacagagccagactccatctcaaaaaaataataataataatcaagcatttggattagctgtgaatttcttttatgtatactaccccactataactgatgattaatggaggactaaaataaataaggacattacattttaaatctactgatttcacttttctctatttctcaaattctagtttatatagacatccttttcaaattctttctgaagtttttcagtattaggtattattgttacctgtttcagaagctgcaaaaaaatcacatgaaacttgaattgtagccagatgaaacttgaattgtagccatttctggctttgaaaaacaccttggctttctaaggttttcctcttatgatggtttcaaagacaggcttgtttatagaaatttgaaatcaagcattgatgagtggtttgctcccaaagtctctatataaatcagtcttataatctagtttttacattcagagtttagtggtaactgtctttttttcttcttataattcattgtttaagtttctatacttgcatttggaactgaaatggtacaggaaaaatgtcttccatatatatagtaacgtaaaatttcttccacagatggagagagacagacagacatagtacatatacatacacattctgttataagcattaatttttttccatcccatatattttcaggcctgctaagggaatgctactttaaactagaaattagggactgttgatttcgttcttagatttgtcatcaacttccagtgtaaccttgaaaaagatacctaatgttgctgagcttaatgtaattttaagccttctggaaataaaagacaacatagaaaatggtgttcacttattactgtgtaagttcagaacatcttcacagtttctgaaaattttcagaaagcctcatgaggcatcagactcttatatttttataggaatctaccaactctacctttataatctagatattgtgaatctgcatttaagatggaaaacagcttttgatataaagacctcagaaatcaaagaaaacagcacaagaggatgagcagatattatgaactcactctgaattcactccatagggagcccctctcttataggtgctgatgttctagttagtatccattgtttctaaatttgacaattctgttccactaagaatagtaagaattggtgattatcttttggccataacatttagttaatgctgaaaaattagtaaaacttgtttatatccagtagagccaaaagttgatgcaactcttatatagcaatatgcttttattcaaaacgaaaattccattttctcaatatgattattcctcagcaatttccatatgctatcagagatcttctaaaagggataagacaatatatatcctgcttccaggaaataaaattttataggatgttcaggtttctattatttcttgaagactttaactgggaacttttggcatcacactgatatttctgctatctcctaatataagcaggaacatcacagctaacttgacctatgctggtctgaattgagacctcattctggaatccatagtgtaaaaccacttagtctgaagcttcctatcccctttgctcttcaccctgccgttttttttttattgcctccctctttatccaaaacattagttctcattagagctctatttaaaaagtacctcctctaataaaacattttgtgttgagaaacttcccttgctcatttatgcagtaatgtgaaatgagttattttaaaaaaaaagttttacttttcatttcccgtcttacccaagatagcaaattttccaagaggaaaattcagctaaaataactgaaagctttgaggcagtaaatatatctaacattggtctggcattaaaattttctggttgggcagcacaattgtttaattgggaatctcagtgacagctgaacaacctcaatgcttgggtcagcaagcagaggagcttcactctgtcacctatcaagaatgatgcttgtcaggactgatctttccacctacagagcattcatgtttctagtcataccatttatgttttctaatattacaatggaatagacactaaaacactaagagagaaaagtacataggtatatttgtaattctttgttttttgtaagccaaatgcaaatgtaacactactccagatactgcttcatcagaagtccccaagataaccaaaagtaagtgccaatttcctcatctcagggatagtgccataacaaagactgaattctagggaccagcctatttgcagagcatgtcatacagcctctgggttagttaactccttggcctcctaagagctaccacagagagtcaattgatgtttttgcatgtattacttactaatgtatagaaaaatttttaagttcactttttctttattctgtctttcttacccatcttccctcattgtagcaaattagacggccggatgaaagcaaaggagttgctagtagagttggatccctcaaagtaaatatgtttctaacattttttggcaagatttcgtctatagcctacacttcttcctttttggagggtggtgggaggaagggggctttttccatttttcaccatcccattttttttattttaatatttttattggctgttgggtcatattactttttttttgtttcagctacacatagagcaaccagctgaaggcaagctgccaaataactagctttgaatggcaccacaaacaacagaaagggcaactgcctcattacaggtgcctataatttggggttctagaataaaccgttcctctgattgatgtcactgtgtgttaagttcctgttacacagagaactaacatttattttcagaatattatctccccttttagcttttttttgtaaaaaaaataattttaatgttattttggtatcatcaccatttatagttcatttcagagaaaagttattatgagttaacaatatgtattcaatacacataatcttaagaaattgaaagaaagaaattttatgtcatgtagtataatgggcccacatatagctgatagtagttatgccctcttaatcccctctgttttattttttaaatttcaaaaaactgatacaacaatcaacagaaccagatacatacctaaatgtttgtccatttgtgtatataacctgctaatatacaattgaaagatttctaatttgatcatcttgtttgctagttgctaaatatttatttgctcaatatgccttgggcactcagtactcaaacatttaatcataatgaaaaggtaaataagttatcactcttatgaaacacagaccaatcacatttaatgctgccaccttaaatgcaagttagaaaatttgctgaattctaaaaatatgcagaagaattacctcacaaaagtaattattttcttatatctcaatctcatttgccctaacagcaatagtaactgttaaattaatcaaaatgctagaaaattcagtgcactgggatgtcctaaaatttaatgactaccttgaggcctaatattcaatcatttcaaaattttgcacacctccaatttatttccattttacaatttatgaaatactaatttctgcactctttcctctccttgcctcttctgccttcttagctttacttttttgttattgtttatttgtttgtgtgtgcgcacgcacatgagtgcacatggatgaaggtgtgtttgtatgtttgtgtcctttatttcagaaaagccatcctctctgttctctaacactgctttatagtggatagctattttattaaaatgttatttcaccaaggataagaagaggggatgggaagtgttaatagtgtgcctatttcaaaaactaggcaatttaagattattcagtcagaaaaatgtgagtttgtgtatcctgatgatatatcagtagcattcctcactgtctatctgtgaggtatcatattttatctttgtctttaaaggaagataaatccattaatggtttaaactatggattatgactcaaattcaggtgagaaggtacagaacgacatgactttttgaaaattactgaaggtgaaataaagataaaaatggcatccataactgtagcaccatgtactgtaaactggattgtatgtgcgagtgcgcgtgcgtgcagttatctccgagttcaacttctggatgtatagaacttcaagttataaatgtatgtttattgtttttaagtgtatatacaatatgagtatgtatatacacatatatatgtttaagaacaaaagatacgttttataattaaatcagtttatattaatatggatgcagtcttgaatcaaaaagtgtgtttgggaaagaaagtcaaatttcataatatttaaatatctttactccatgtttctacaaaatagaaaatgtcaaagtgaatctctaggggatttataaggatggttatagtatttattttctctaatgctttggggagaaaagatgctgtaattaatcaaaataaaatgttgacttcctagtcacgggtttgttgagcatgcattcttacgttatagaaagacctttgatgtttgaaatgtttgccaaaggcagtgagaaatgtataatgctatgatcttatttttaaaaggaaaaaggaaaaccgaaaagagaacaagttgctttttcaattcattttctgatgtttacatgtagctccatcgaaagctggaggagctcagagatcacctagaaggcaatgtgaaaggatactctctcagagtaaatgtacgatttcacttggtgatttttttttccctaaacttctgctgactggtaactccaaatctgattggtttgtcctctcatctccatctttttcctttctgtctcttttccccctctttctttcttttctagctgcggcttcatgctcccatttatgaaataaagattaaattagcagggtagaggaccctaaagccacactgactaacattgctgttgacttaataatattttggccccagtgcaaaataaaatctttcttttcaaaaatcactatttcttatacaattgtatacttttttgaggatcttgtcatgagacttcatttggagatttttctattggtcatgtcttctaccccttgttagttatgtcagcagaataataaattatgagctggatgtgaggggtatatccttgatggtacaatttcaattttcaaggaaaataatcagtgttagggtatcataggtaatctggcaagtagacacatttgttctgagttaatagacttaactcagactcttttagaataaatgtatgtcattttgtttaaaaataagaaaattagcagtaagtaccttcaccaggaacaccttcacgtagcatcttacaaatacttgagctaaagtctaatatacccaagacaaccattgaaggaggacagtacctcgtatccactcaatcctgtacattcatcatatagtcagaattcatgatagtattttttgtgacagatagttcagactatcaagattttcaagaaaaatctctaaattggttttggtataaatgtagcagaagaaaaactaaattactacagtaatttatggctttcatttctggggtttccaagaaagttcctgtgaatcctggtatccgatttacttctcacaaggttattaccattcatttaattcacacagctgtaatagttttgttataaaaactagaattaaagttagggatatgataattatcttatttctcagcttgtttttaattgtataccacacatagtcatgtgtatctctacgctaaatttctgattattgaaatacaaagtgatttttattaataagttgttaattctaataactaaacagaaggaattaatacacgtgtctcatatctctacttcttcctttgagctactctttgttttctgcacatattcttatagaattttgaaaaccatccataatcactccccaaaacctattttgtcattttttttaaaaaaaagattagtatggattttatgattaaatcagtctggacatacctaattattctagaaacccataaaaatattttaatatgtgtattttagtcttgtgctctttcctaatcagtcatgagaagtaatttttcttttcaatgaaactgagaccaaaaagttgagacttgctgatttctgtatggtaataagttagtaagagaccaacatcaaatttaaaatttgatgccttaaaaattaggttatctcatgccattatttaatttcttttttcaacacctgtactactatataatgattaatctcattttatttcactgagaaacactttgttctgattaccttgtttctaaaaatattaaatataaggtgtatctgtctaaggatcctgttaactgtccaatatagaaaaaaaaaaaaaaaaaacctatccaaaggcaagtagtatcttctctagagagttcagctaaggaaacatgcaaatcaattgcttagctgaattttcagtttctctccttaccctttaattcctactacccaagtataccttaaagtgccttgaatattaaaaattgatgctaaaaagaaaaagttattctcagaaccatagactatattagacaggttttgtttctaaaatgaagtaaattggcattcggtgatgattttgtttcatgaaaatttattgtaggtgtacacacacaagaacaagtgtattagtccatttccacattgccataaagatactacctgagactgggtaatttataaagaaaaaaggtccaattgactcacagttccacatggtttgagaggcctcaggaaacttacaatcatggcggaaggtgaaggggaaacaaggtacgttgtatatggcggcaggaggggagagagcacagggaaaactgccacttttaaaaccatcagatctagtgagaactccctcactatttacaagaacagcatggagaaaaccacctccatgatcctatcaccttccaccaggttcctcccttgacatgtggagattacaattcgagatgagatttgggtggagacacagagccaaaccatatcaacaagtatatgaggtgtcttttacttcattaaaatgctggtgaagatttcaattagatgaaagagtcagaaccatgttccttatacaattgtataattttctgaggatcttctcatgagacttcatttggagatttttctgttggtcgcgtcttctacccttagttatgtcagcatgattacagattatgagctggatctgagggttacagccttgatgattcaatttcaattttcaaggaaaataattactattagagtatcatcataggtaatctggcaactaagcacatttgttctgaattaacagacttaactcagactcttatgtacataacctacagttacttttacataacagcagagttgaatagatgaaacacagattatgtggcccataaagtctaatattttatttaatagttaaattttaaaaaattcaattaaatattttattttatggagaatttaagatatcattcagaagtgcaggatgaagatttaatttgctaatagtttaatttgctaataaataaaaattaaaatattttaaaattaaatatttaatatagaaggtttgacatcattcagaagtgtgagataaggatttaattaaatcattaatgcttgaattggatgatgtagacaatatgttattttgtagaaagggaagagccctgtaccactattgattaaggataatgtaatcaacaatataaaatagaatattctaagatacaatgttttgaataatgtttatttctcatattaaaatgtattatttattcaacattgattcataaaatgggatgtattagattattgatttttaacttaaaaatgcatcatctttttctctatatcattcaaagcagaagtattttgaactttaagtgcgtttttagtaattttagtaataataaaatcatcatcttgtacctaagcagaattttactaccttaatgactacaaaaattactacaaatccttagattggtgatgtgctgatagtaactgaagaataaaaccacatagaggaaaaattaattttccatttagtcaaatggatgaatctattaagaagaatattaaaagtaatgcacaggcttgaaggccagtgaagacaatgttgagaattgaaaaacacaggataaggcaggggacggtggctcatgcctgtaacccagcactttgggaagcctcactgagaaacactttgttccgattaccttgtttctaaaaatattaaatatgaagtatatcagtctaaggatcctattaactgtccaatatagcaaaaaaaaaaaaaaatttaaaggcaagtagtatcctccctacttgcgggctgatcacttgagaccaagggaaaaacctcctgtctactaaaaatacaaaaaattagccaggcatggtggcatatgcctataatcccagctacttgggaggctgaggcacaagaatgatttgaacccaggaagtggaggttgcagtgagccaggatcgctctgctgcactccagcctgggcaacagagtgagaccctgtctaaaaaaaaaaaaaaaaagaaaagaaaagaaaaacatagaataagataatccaaagtaatactttctttacagaatataaatcaaggtaaatttacaaagaatttgattagttgacgagcagtggggccaaagagagcctaaatattaagatattcaggaaaaaagtagataaatgttcatgaaataaagatagttaaaagaaaagaaaggaaaggaatgaaaatactcatatgccacaattttgtattttcatctgaatactcagtttatgtattatgatattaaatttctattcagctacaaatatgtgtagataggttttggctgaccaagtgtgatttttttaagggctatgataaacaaaaaggaatatggttcatgaagacagattactggcatataagtgaaactaagatggaaagtgatgaaatggaaggaatatgacaattatctataagtacttaactatactaacacaaattaaaggatggtatttaaagtgaaaaaagtcaagggaggagttgtcacccaaaataagactacctttttaataagtgttaagaaaaatacctgaatcaagttagaaagtaatgatcttttgaaccatgatttttaaatgtttaacaattaatttcctgaatgccaatatgggatagtatgaaatagtgctaatataaataatgaattgggtaactgtgattttatagatctttaaagatgagtattttcattgcagccttagctctgaactactttcttatatttttgataaatagatacctattgtctttaggggggttttgtacttttatttttattgagttaatgcgataactcagagatcagcaaatcctgtttttttataggcccacaagctaagaatgagttttgcatttataaattgtggagaaacataaaaagaagaacattttatggcatgtgaaaattatatgagattcaaatttcagtgtttaaaaataatgttttattaaattataaccatgctcattcatttgcacataacctgcagttacttacacaacagcagagttgaatagttgaaacacagattatatgtctcatacagtctaaaatatttactctctatttaaacagaaatgtttgctgagtcctgctgtaactggttagtgtgtcaaaataacgttgacgtaggaatggttataatggagtttgtgaaatttcttcattttaaagcttgagaaaagaagcctgctcatttttctgaggatggtttcagattattctacaaggaagcatatgtttggaaaggttgatctcctcaaattgtctacctttacatttttattttcttcttttttattgtcttctctagctattctctctctctcttcacatagatttccccctctacacacacacatacacacaaagtcttcaaatatggaactctaatgtggatagaatatagattataaatttctcttttattggaggctcatttctgggttttcagagtacaaagataaatctcattattgctgtcttaaatgttatataaaatatgttattagagtattttcatttaacacattgcatttttctatttattacttcattacgtcttaacaaagatatttcccctgaagaccatgatgaacttttgatttttgctaaatgccctgtttggcctcacctaaaatcatataccttctatgggaaattttatacaactggaaaagatacactgacatgatcaagtaatatatcataccttaaaaatctaaatggtatttgaatcgaatcagctaactttgagtggggaagaacagatgaaacattagtccctagataagtaaatatttaatagtccttaggtgagcaaacagtttgtaaactctacttactttaagcaaatttgagtgtctcttgattcttttatgtagaacattgtttgagccttccttgtttggcattttggcatttacttatattaataatattcatttatttactatttcatttataataattatgtaacatctgagtatcttggtagatgatgtcttataaatatgaccagactacaataatgatgaagataacagtaagtcaattttaggattatgtctttggactaattttgagtaattttgctacttttcactttattattattctcttaatgtagttagtccaattctaaggtttcagttataaaaataagaaaaaatggccaagcgcagtggctcacgcctgtaattccagcactttgggaggccgaggcgagtgggtcacctgaggtcaggagttcaagaccagcctggccaacatggtgaaaccccatctctactaaaaatacaaaaattagccgggcatgatggtgggtgccagtattcccacttactcggaaggctgaagcgagagaattgcttgaacccaggaggcggaagttgcagtgagccgagatcacgccattgcactccagcctgggcaactgagtaaaactgtctcaaaaaaaagaaaaaagaaaaagaaaaatctatcttatcctgtgctttaaacaaaaaaaaaatctcatgatattaataaaatcacctgcagtggcctaagacattatttagaatggaagtgacccatttctgagatgtttaatgtgcaccatagaattgccctcctcggaactgactttaattcaaagataaagtactaataaaatatctcaagtaaattttcctagcaatagaaaatagagaactgagtaaattttaacaatgacaacactctcaaactgttttgaaagataaagtatttcagttttatgggcatagatatagacacagaacaaacatacacagcaagattttcttagaactagcattttgctaaagaaattcagatatgtgtatggctgaaaaatgtgtaatttctgaacatgtatagaatttaccatattttcaaaagtacctctaagcaataagtggctatgatactttttagcacaaatctttgtgatagttttaaaaattctgagcattatttcatcagttcagttttttaagatagaagaaaaagggtttgtatattcatttattaaataaacatatattgagcacctactacattctgctatgcttggcactggaaatacagttaaagaacaaatcttagataataagtgcatttgtgattcttctactgtcaccttctccagtaccttcatttccccaccgtacctttgtgttttgatacttcctgcagtatttgtaaatagagaatacatacttaacaacttcatcttacatggcattgtgagacaacctaacgagaaaagagtacacagaattgaacatggcagtgtgacaacgtagaaaataagaacagggaagaacattatcagttcagcatcataaaggttaaacattgttgtaagtataaaatagctatttttaaaaatcagtgataaaatagctgttccaaaaattctgtgaatcattctgataaaggttaagtctgttgaagagttgtgtgtttaagtttttatatttttatagtgttgctattgccattatattgtagaaagtgcctcaaagcaataagtggcaatgatactttttcgcacaactctttctgatcgtaagctttaaaattcctgaatgttatttcataagttcagttttctaagaatagaagaaaagggatttgtattttcattcattaaataagcatttattgagcacctactacattctgctgtgcttggcactggaaatacagttaaagaacaaatctgataataagtgcatttctgattcttctactgtcatctttcttcagtggagaaagagaggttcagtaataccaaaaatggaatagttgaaacaggaaaaaagaatcagaatactggctttggtgccctctttaatgaatactgtgaacgtgtatggtagagttattctataaacaacctcccatgtagttcactagtgttaagccagtgaagatcagtgcagtaccgtaagaaaaattgtccagcgttctgctttctttcttaaatgaggatcttctcagcaagatcataccagattctgaacagagggagtcatctccatcatggatttttttttagcaaggtattttttgtcacaaagttttccttcaaataacttgagtcttgacatgttttcaaactcaagtgtctgcttataaagctgttttattatctggccaagtgtgttggtgatggagccatctaaaccctctgtgacccttactatgctatcctttcctctttaacagtgttttcttttccccactgcaaaaccaggctcggcttccctcgtgctcatctacctatagtgtatctgaggtatattttgcacgtgttttcttacatggtcaataacatgctcgccctcaccatttttctcattttattttcctttcgccttaatttattttgccttgcactttgcacttgcctgaaagggatgaggataccaaagggggaaaattcacctgttttagggggaaatttctctatttttatgaatgatgcactgttgtctgaataacttttttttggcagtcactacatcacattgaaataactaaaacccagatagccaacttgattgctgtgactacctttattccataatgactcttttgaattaggtaatttattattaaactcaaattggctaaaggcaagattccagtttgtatatctatatatgtctgtgtctgatagctgaagatttgtattcaattagtgattgttgtgtctcattaaccacagacataggaaaacatccaaaattgattattaaatagaaaataaatatacatctattttatataaaataaaagatgtatcccttttttaaaatctcattagatgactttaataattttttgctacttatattttcctaagattcttgtaatctagaagagattaacagtaaagagattcatgttcttttagtaaaatattttacatgaaatttggcctattttccttgtcttttaggaggtttaattttttatccttactgtgttaaactatagaataaatgagttttcttgttttcaaaaagcagatttattgaaatattattaacagactttgaatatccattaagtctcctttcaaagcaggggcactgtttgagtagctaagaagaaagagtatgtaccttgaaatatgacaggtaaataaaagaacttcaggccaggtgcagtggctcacacctgtaatcccagcactttgtgaggccgagatgggtggatcacttgaggtcaggagtttgagaccagcctggccaacatggtgaaaccccgtctctactaaaaatataaaaaattagccagacgtggtggcgcacacctgtaatcccagctactcgagaggctgaggcaggagaatcacttgaacccgggaggcagaggttgcagtgagccaagatcgtgcaattgcactctagcctgggcgatagagtgagacttcgtcttaaaaaaaaaaaaaaaaaaaaaggacttcagtagcctatgaattttaagaccttcattctttttttacaacataatttctacatgtatttactttgtataggccactgtagctaccatattaaagccagtattatcagcttaattctgattgcagaaatattatctcagaatgtcatcccaaagaaaacccttgaaagatagtactgtttaaaatacgaggtagtatatgcagaaccagaggcagaataccatctgcagatctcaaattttaagaaaaaaccaaaagaaatagcatgacaaacccatagcctcacaaagttgaatttattgagtcaatagaattgcagctatcttcttcaatttttaactttgcaagttataactgtgagatttttttctcttaaaactgatttcctggggagttaacttcttgaaacataccactagggagaagcaaagaaaagaaagccaaatgagctatttttagtatcaacaaagacatttgaaagagaaggttggtatcatctcatcaccacattttctataggtcttttcttaattcccaaagattatgagtgctagtgtaaaaaatatataacccatttctttttgccacttcatccaggcaattctccatttcccatgagagtgtgtaagaagtctaccattggcatcatctccaatcacagcctacagcatccatcagggtattactttctctatgacagcatgtgtgcaggagggctctcacgttggaatgtggaactggcttcttgggggcattatgtatgctgtggcatttgcaccatggcactcagctcttaactctggcttcatctagatttgtttctttcattgtgacacatgggctttctttatttgtcatgaagtgtgtttctctttctgtcactcgtggtagggtttctctctttcactcaatgccacatctctgtggtctccataggtgctgtttatgtttaatttatgatgctataaagaccaataaaatgaagaactccttaagtaatattcgtgataatcctctgcctagaaataattgtttctttttagtcttaaattggtaaatatttcacagaattttagactgtaaaccttaataattaaaatttcaaggaatattcttcttagctttcaatttttcatttggaaacctcttgacaggatcattggtacaaagtacagtatttattttatagcatcactatggaggtagccaaaccttccatggctcgatctcttctttcccttacatttacatcatcatcttcatttaccttcactattgtagaaattaagtctccaatccctaatgtagcacattggtttaccaattgcatatcactatcttctgtgtcattcattagatgaaaaaaataagccttgctcaaaaatgaacctatccatgagttgtataggaacaagatttataacctcagctggctgatactatttagcaaaaacatttctccacgtagttatggtccctttgtaaaaaaaaaaatatatatatatatatacacatatatatatatacacacaattattttacttgtgataagctttgtttttgatatctcattatcaattaaccttcataacagccttgtttggggtaaatattaatgtcatcctcattttaaagatgaggaaattgagacgcagagaggttaactatcttgccgatcataaagctagcaagtgagtggcagaaaattgtcttttcttaaataccatgctttctcctgttaagaagttgttaaaagtcattagctctgtgactagcatgtagtagtcttgtattttcacttcatccatttactttgttcaggttgattatatagtttggggtatatattttgagaagatgcacctataagatacaaaactttaattaatacaaaacgttagtagtgtgtattttcacttcatccatttactttgctcaggttgattacatagtttggggtatatactatgtgaagatacacctataagacacaaaactttaattcaagaaaatgttagacatctaacatttatggttatataatttattgtcatgtaatttattgttatgtaatttattgttatttttctcttatttagtcatttgataaatattgagctacctcctatgccttatttaattataatctgccagttatttcttggcctttggaattggctttacgtttagaatacataaaatattgtgaatgtaatgagatcagtgtctcatacagtttttcatcccttcaagcaaagtgaaaaaaaaagaactcatctttcacgtttctaactgattttcaactttgttccagcagtgttgtagcagagttcccttttcaaatcctttgaaaagattgcttcagaattcccttagtataaaccaaagccagaattaatactttcttctgacagaaactgaattccttctgacttatttgagaagctggaatatatactagatatgaatttattataatttgtaacacaatatctaacccaaagaaaattaataaacatccaagttgtcatgcttttactggtccaaattgaaccctttacagccttatctttaatgtcttagatttcccagtagcaaggttgatttagataatttgacatttagatgctaaataatttatttcctgttgactagacagggactgaaaattgtgtttttatttaatgcttaagaacttctagctacctaaaggaatgatggttttaaagttgtaacatgcaaaatagttgccctttgaactcttagacactattaggacaccaattctgatctaaacaaacttggactgcctaacagttttggagcttttgcaaacagaagtttcagttaaattgcagtgagtaagtctacatattcaagaaaagaagggagagaggaaaaaaggaagagaagaaaggtaaatgaactttaaacaccataccattttctatttcaaaagaaaaaataggaacattttttaaacaccacagaaccacaaactgtttaaactggaagaaactgtagccaaaaaataaagattctatactgtgagataatcacctaagatgttctactatataaaatctcatttagaaaatctttaataatgatttattacttatttcaatatatttatctacagtgctccaccctttcattcacatgtattatttttatgccatttgtatactatagttagaaaactggagatagtgtgaagaaatcttagaattctatcttttgaaaacactacaactgctgctattaaaatttattgattcctacctcactttcaaatttgtagaaatgaactggagtatataaattgtcttgttaaaaataaaattagtatatatctctctctctgacatacatattagtagctaatccatagagataatgggaaaacacattacattctgtttgacagggatatttgatatatccatctaattaaagcattctttaaaaagaattgagaagaattctgtctacttgggcatacatttttaaatttccataataaaaatatttttaaaacacactattgtagttggcactagcgaatttctgcttatccttgtatattgcctcatataatgatcatttacaatataaaagaggtcatcagtgaaaatagggcaagaaaaatttaaagtttaagatgagggaatattaatggatgtgtaacaagtttagaaagttcttaagctcccttaaaactaatatataaactatatgtatctttgagagagaaaggagatatgtatatcctctccttcatggaagtaggaatgaagagagtccataaagtacttatgtgaagtccagctttgtatatacacagattagcttatcatcatgatgttctaaattttctttcctatgttctagagaatttacaaatgaaatagattaattagacatatagctagttagagcccaaataaatgatggcacattataatatgatatgttataatgtcatattataatgtgatagcagtaaaatgacagctcacctgcatttatacttatagttccagctgctgtttgaatgtctttttgtaatatcaaactcagtatgtccagctctgctttctaaatacttctttcaatggtaatgttcttaaagtttccctgcatagaaatcttctagttatcttttactctttcttgtttttcatctttgacatttagtgtgacattaaattttgtcatttttgttatttctccttttgaattatctcctaatccttacttcggatacataaatgaactttgttgccacgtctactttaaaatcctggctttggccaaaaataaataaataaataaataatgaaaatggcagctttctatacattacagaggtttaagaaatgtgaagcagctcatggtcatatattgctatggttcatctccatggatttacacagatttggtttaccaccaatcctagtgtaatttttaaagactcaaataagtatcttcttgaccagcaacaaggcaaattttcttttgctccttttgggttttactcctaaacatgcatttgggtgaaatgtatagcctagactttggcaagtagaattatcaattttccctggtcaccttttttccctttcaaagcatttccttcccaaccagtgttcttcagctaagccacagaacacaggaagtaatatgtgtagctattttcttaagatcctgtaaagatgttgacattctatattcaaaaaacagaagtttattcattacacacaatgaatataaatgcattaaggcttaattctctcccagaattgaggaagatatagtaatcccatcttttaagtagctcagtacttcttgaagtcatttgttatttaaagacgcacttgaaatttcatgtttggaaattctttgtgttgcttttttttttttttttttttttttggatacctagagtctctgaatagcctgtgcttaccatgtgattttagggcttgagatcgtgagacatatttttattttttttaaataacctctttatttttctgaaagaaacagatttaatcagcttctcaccatattctaaaaatgttcctgcttggcagttattaacattttgtcggttttcttgtactgttgaagcagacttactgaagatcaatttaacatactgtttaaagtttggggctagatttgaatcctaatcctggatttgaaacccaaccctgtgccttactaactttgtgaccttaagcaagttaacttctctgcacctcatattcctgtaaaataggaatgataccaccttttggggtatcttaagtatttaacagcttaatattacttggtgcaatgcctgatatgtgtaagtactcaataaatattaactatattattatcagtatttattgttatattaaaggtccaaaggtaaagttattttttgtttcaactaactctttcagatacattatctgttaggtttttcatagagtaaaatacgttttatgtatagtgattagccacaacctgattgaaacaagtattagctccactatcaacttaacctgacatcagcacttgtaccattcctgccttacttctttttcctagtcattgtaaaggatatagaatatgaaatacatgaacacttaatgtctttcttttcattctgccaggtgactatcttctccagtttttcaattgtctttttctccaaaatcactttcccatttagtgtctggattagttatgcacataaacacaccccaaagatgactaataggaatagtggttttttattatcagtagtatattgtccttgtattctattatatgtcatacactacaagcaatcaccagtttataagtgggcaaagcacttcctcacaaaaagtaactttatagtgactagatttctagactagtgttcatataactcttaattagctgatattacactattagtaactgaattgagatttaaattgacatatatggattaatgtaggaatctatctactaattgtaacattatttcttaggaaaatgcactttaacttctaacagaatccagcctacttcaaggcattttacctgacaaattctgagttgcaatgagatctacatcctgttttcttccttggacagctcagtcttccttacagtactcattgtagtggaaggtaaagggaggaggaaactctagaaattgggacaaggacttccccacagcatcatcaatcactgtttgttgaaggagtgtatgaattgaatgtttatattaaagatgtatgccaatatcattaaatttcagttaactttatatagtgtgatattattagtcctagattacttcttgctgcctcttcctggtaaatgatgatatttctgaatgattctttattcatttgttaagtgctacttattaaataccctctgtttcttcatatcttgtaaacaagatatagatctttgagtcagcagagcaaagttaaacagatatgtgactgactgtgattaaaagaagtaatcatttctactgccgggtctgtgtcgatttaatcagatgtggtgagctataattgcatttctctttgccccagtttacccgtctctaaaatttgaataaactagacctttatgttcctcagaagggatattctggtgaaatttcagaaaatggaagggagtcatgacaaagctaattcatcatgaatgtaaaaacagaatttttcaggtacagtatgagaggaattatatcttgttatcctgtgtgcattttactttttacatgaaaattcagtcagagagccaaatatgtttagaaaacatactctgagcttaaaagaccataatggtttggatgtgctgtgtaaatgtaaaacttgaaattgatcttgttttgttatttttccttggttgtttatactttcagttttgctgaaactaccagtaggtcataataagtcagcaagcatttatttaacatctatacattgctacagagtagatattgccatattaagcatatagagaatgttgcaaaaattaaatatggggccttaatgattttacaaattgaaatattgtccattttttaaaaaatcataatgtatgaattcaggctatgttgttctaaaatatgactagaggaaatgtctttggctttgaaaactaaaggtctttactaatcgggtgaaaaaagtctgtaggaaaatcaccattcttgagtcctgtgttcacagaatagtcatgagtgagttattttaaatttcaccaaattattgttaagtcacaaaaaaagaatttggtaaaggcagattttcctagaatagacttgagtttttggaaccttattacataactttaaaatgccgtaatacctctttagaccacatttttctctatcagagatggtgtcaggttggtagtaaggcttatttaattaattttccaagttcagacatcttggaaaggagagataaaggcaaggcatgacattactctttataaacatgacttactggaggagaatgcaaattttcatcctttaaatcatttaatcggctttattgagttacctaatatatttgggtgatagaggagaccctgaaagaaagaggacctcaggaagcattataggtcagaatgagtagcatatgcacagcaaaagtagtttgtgaaagggaatttggtctttttttttttttaattcactaagttgaatttaagggcatattttgagtcttatggaatccattttaaacatagtgatagcatttcctgtgcatttttagccacttaattatgtgaataaatgcttgctaccctttacagttgcagctgtcattctccaaagtagattcatccacaatatttacagtcgtaaatcctaaatctattgtatatatttaagattttttaatagtattctttcaccattaggcagcacctccttgagaaagaatttacatttttattctcatttttaacaagaactatacagctaagatttatagagaacttgagggctttttctacaatgtactccatcatcagaagtaggctaaattagaaatagaaatggagaatatatggtgatgtcttttccattagctttgaaaaattcaacttgtatagttacatgtatttgatgtcagagtattttataagtatgcctgatttatcatactgacttgcttctttttaacttaaatattttgggaacacagactcatgtttcatttttcagtgagttattttatgtccatgaataagcgtcaatgcattggttgataagttgaaatcacctacaccctttgaatatgtgtttttgcatcactttcgaatctaccttttaaagtgaatttgacttaatttccatgtgacttttattagtagagaaagcaaataattatgaaacacagtaagggttattatataaaataattttattttacaataaaacagttggatgtggattttacctagaaagactaatattatatatatattatatttctcccttggaactgacaagggagaaaaagtaggtatattggtactcaagtgttttgtattttaagaggaaaaaaagaataaaaaaggggcaatggaaaaaagagaagagaaggaaggagaaaataaaaggaagggaggcaattaccatagtttttcttcttttttgacatcagtatttaaataataggttacttgttctaactttcccattttacatcgttgcagagcataagcagcagcttgtagaacaaaggtgaattcagaaagaccttaaacatatttttggattaatgtttcatgaaaccctgaatggaattcagattcatgtggtctttttatagccatagttttcaattatattagcaattttccttgtcctatttctgtctgcctcaggataccaaaaaaagggtctattttcgaaattttgttcataccattctgcacccagtattgcctggagtcatgaaaacccagcttgctgctattttttctctttggcaacttgctgctataccaacactcagcaattaaatctaattctgtttgggctaccatgcttaaatgttcttgttgagaatcatggcatgaactaatgcatggctctaaaaaggctactgttgtgtgtctgcactgaaggaaaaattccatagcaatctagcccctttggattttatactgaagctgtagattaatggtgaacttctgtgtaatgcttgacaaagaagggaaatccctagaaatgaaagtgtgaactgaggtaaaaatggtcttcagtcagatgctgctaaattaatcactagtaatcatcagttgtggaggttaggagtcccttcacagaatgcacttgggtggaagagtaggaaagagaaaaaaaggatgccagtgagacctgaaagagattatatgaggaaatgttgagtccatcttcatttgtgtgctgtctcaaacatttagctcagagtctgaaatacttttggtcaaattaggactgattttaattgtcttattatacaatttcacagcctcatcatccagcataaaatatatcaaaaatgacttaattccctcatatccatgacaattccaaactgtttttaataaactttataattgcctccaatattttaaaatttattaggaacactggtttcatgtttaaacaatcagcatcctttattagttcccttaagcattcatcttattttaatgtatacaatttttacttggtagaaaataaaccagatgttatttttccaagtggaaagaaatcttttttctttccttttacattacagtttcaccttgaaaatataagaagcaaatgaatggtcccaaaatttggcatttatttttctaagtcatgtttctgggctatgagttactgaattttgcttaatttattaatgtaaatacagtaattgaaccacacaactgtcagttcctccatcctttgatatgtgggctgatgaaatataaataaacaaaaaatgttgtgtgaccagcagctctggatcatctaaatgacctcctttagttcatttccctttccacatatcaagtttatctataacttcaccaatttattagttttagagccatgtagcacagttcaagagttcaaagggaaagtcaaaataatctggggttattcattcaacttcaactgctaccatatggcaaaggtctctgtagccattcttactattacaggtcaatgacagtagcatttctaaagtgctcttgtgcatgtaagtaccactccttcggtcaacctatgtcactgtgctttcacttgcaattatctaactttcagacataactgaactctatttctgatctgaaatgttccccagctagagttatctacctggcctttgctttatagagtcatatgtcctggtagctgcaaattaatgatgaatgaaaaagagggaggagtgatggaagagagagaagggagggatggagaaaataaaaaagggaggaaggaaactagactcgtttttcattccttttttacttcagcatttaaagggtaggtcacttgttctaactttcccattgtaagtagttgcagaacataagcagcagtttatagaacaaaggtgaggtagtaaaggaagtcatactgtgtatgtgctagagggaatcatactatgtcatttgctttaaaagctgtgtctgaaatcgctttggcttccttttaaacatcccacctgcaaggaggaaatatttgcaactgctcttcagattagtcgaccaggcgtggtggctcatgcctgtaatcccagcactttggaggccaaggcgggcggatcacgaggtcaggagttcaagaccagcctgaccaacatgatgaaaccccatctctactaaaaatacacaaaaaaattagttgggtgtggtggtgcgtgcctgtaatcccagctactcaggaggctgaggcaggagaattgcttgaacccgggaggtggaggttgcagtgagccgagatcgctccactgcactccagcaggtgacagagtgagacaccgtctcaaaaaaagaaaaaagaaaaaaaaaagattagtcatgatgtgggtcaaaatacctgtcttttctcttacacacatctttttttaaaatttatttatttatttatttatttaagacagggtttctctctgtcacccagcctggagtgcagtggcgcagtcttggctcactgcaacctccgccttctgggctcaagcgatcctcccacctcagcttcccagatagctgggactacaagtgcatgcccccatgcccagctaattttttgtgtttttagtagagacagggtttttgccatgttgcccaggctggtcttgaacttctgggttcaagcaatcctctcacctcagcctcccaaagtgctgggattacaggtgttagctactgtacccagccctttttaaattttataagctataccttttgattactgcctattgacttaaaagacagttccagatcaggggttatatttgtgcttttacagtctgctttatgttttgaaggttgaagtaaaaaatgtgaagagaaaaaaattgcaaacagaagaataatctaagaatccctgttccattacttattacctcatttacattaacccactttctcactgcagtttcctacactttattttttcttgtgcttcttttccctttccttgtgtgtttgtttttttcattagaaatcacctgtctctttatttctagttatttcttttcctttcctttttcaatgaaagtaataacccatttcagccactgagaaagagtatgaaccttaataattgttattaatttttgtgtttcagtgtgcttcaaaggaacaaaatgagcttggcatagctgcttttatgttctggtacactgagcctaaattctaggcaagtagctcacaggaatataggagaggtaatctggatgaaactaacataaataaattagatacaatatttctaactgtaaaaattttatgcatcatataatgaccctgtcaaaagactatttataaatagaatatgcctttttcagcttgagttaaaacataacgttaatgggtctagggttacagacttgtgaatctagttagcttcacagttgttctatggtagactgtaaactgatcccaaatgtcttaatgtagatgtgtatgcaggggaaggactgagaaacaatgattcacagggaatctatacacaattgagtaaaactgatttgaacagatagtaaaatggtctgtctatattatactaaaaggtttgaattttataattttttgatcaaatggcattttcaatgagagtttctggggttttttatttgtttcgtttctctttttgtttttttagacacccaggttggtgtgcagtggtgcaatctcagctcactgcaacctccacctcccaggttcaagcgattctcctgcctcagcctcccgagtagctgagattataggcgcacaccactgtatctggctaatttttgtatttttagtagagatggggtttcaccatgttggccagcctggtctcgaactcctgacctcaggtgatttgcccgcctcggcctcccaaagtgctgggattacagacgtgagccaccatgcccagccgtgtttttcttttagataacttttgtattgtttttcatacattcagtaaagaatatagataagcaaagagaaaattaaaattacccttcagctcctcccatgttaactgctagtaacttttatcagaaagaaataataaggatggtgaactgaagaaaagagaagagaaagtagggagttctacagataatatagagtaaatcaagaataggccgggcgcggtggctcacgcctgtaatcccagcactctgggaggctgaggagggcggatcacgaggtcaggatatcgagaccatcctggccaacacggtgaaaccctgtctctactaaaaaaatacaaaaaattagccaggtgtggtggcgggcacctgcagtcccagttactcgggaggttgaggcagaagagtggcgtgaacctgggaggcagagcttgcagtgagccgagatcatgccactgcactctagcctgggcaacagagcgagactctgtctcagaaaaaaaaaaaaaaaagaaagaaaaaaaagaataaagaaacatatgtaaaacaaagaattaccaattaaaaatttcctacatggaaaattttttaaaatttttccaagtaggaattttttaaaacatgtgggatgtaagagttggaaagctctaatggatgagtttctgcagagtttgatacaattatattgcccatatgataactgagcgatgcaagacacagcaaagccacctgaagcaaccacaggaaggaagcaagttggtcaatggtgcaactgtctaggacagtggttagaatttaatagcattctcagttcaataaatacttagtgaaggaaaaaaataatgaaaaaaatatatgggttgaaaacattgacattgtttgtttttaggatagtgtaaatgggtatttagatgatatcaaattctaaatttgagaaatccaagctaaagtgttttggggtattgaaagcctaatgtaaatgtccttgggaaaattagtttcttttttttatagttcccattatttaatgaaatgtttcaaatgttatatatagtaaacaacagataatataacaaacacccatttggtaaccatttagatttagcacattttaatgttttactatgatttattcagatcttttgatatatttttaggaaactgaacaattgtgacaaagctcaaatttcctttgcatagaattctcatataagaacaaaacagaatattaaaggcctggcacagtggcttatgcgtgtaatcccaacactttggtaggccaaggcaggagaatcacttgagtccaagagtttgtgaccagcctggacaacatagggtgaccccacctctacaaaaaaaaaaaaaattatctcggggggatgtcacatgcctatggtcccaagctactcaggaggctgaggtgggaggatcacttgagcctaggaggttgaggctgcaatgagctatgatggtactactgcactgtagcctggacagtagagtgagaccttgcctcaaaaaaaaaaaaaaaaaaaaaaagaaggaaaattaggattgtgttctttccacatatggggcatatgttgacccggcatttgaataatgctatatttcccaggatcctttttactcctctttctctctttctgcttatatttattttcaagtaacctactggtttatagtataactttaatgattttcagtgtgtgctatgaagatagaatacacagacccactaaatatgtgtgtgttgtgtgtataaatacacagattttatatatatatatgatcacttctgtttgttgtgctcagattacaataaaataaactggtcagaagcaggcaagatgtctcaaaactactctggctaatcctaaccaaaccactgtgtcatacctctatactagaaatatataggaaatcaaaaggaaccaaactggaatgcaaatgaaacaaaaatcactaacactgaaccaacgcacctcctggcattattaataacattgttctgtcccaaatgaaacttcatatactttggacatggaggttaatgattgctaaaaagagaaaatctttataattaagttttctctggtttgatggttattccatgtgatgcatctttccataaattttgagaatgcctcaacacttatagggatagatttaacagtcaggagaatactagcaagtgtagtagctatcatggatcaatagcattatgaaatcatagctttaatgcagaaatttatttatggtaaaacttcaataaacaacaaaaattgtattctgtcttttaagagatgccttcattgacttttatgaaatagcagattttttcccaaaaggtacttttgtatcccactttgctggaaccctaagtctgaacacccgtgtgtctttttattaccaatctttggcctttctgaccaattacaacagtcttctttgatgtggaagaggttacaaatatttccaggctaggagggattggggagagtaatttcagtctggatttcggtagtttgtatcatagtcattatagccattattattgtcactttcatcattaccagaaaaacatgtatttgtcctttatacaatgttggatatgataacaaatgctctacatgcattagcttattttagtctcacaataattctatgaggtggaaattcaacaaaacatttgagcctttgcacacctttagctgtttcctcagtctggaaagttcttccccatgatcttcatctggctgtctcaaatcttaactaaaatgatacttattcagagaagtcttccttgcttactcttgtctaaaatagctataccttatcactacttatttttttattccattactgtattttattttctttatagcactaaccactttctgaaactatcttatttatgtacttattagtttaggtgcttatcatctgtctactactattagaatgtaaattccaagatagcaaggtctttatcaattttgttcatgttttacctccagcacctagataagagcctggcgatggctctgggcaactgagcttagctcaacacatactcttttttattattattattattgttaatttcttttttccacatatttgttcaataattgaatagtattatcttgatttttgtagatgtggaaactaatacttgaaataatttagtcaaggttatttagctagcctaacttcctatgtttttcctgctgaaaagaggattcgctacatacacaagtctctagctttaaccgatctaattagtgcatgtctctggacctacaggtatagggcttatgttaagaaaaaaatttacatacatctgaaataatctgacctatattgctcatcctgaaaatgagttatatattatattattaaactatacttgttaactattacttggttagatcatgagaggcttgattaacaacataatgtacgccatacatagctgtaatactaggcatcagaatgcctagttcttatatatttctcgaagaaacttttctacacactttctaagctcttgctactttactagtgcagtatagacatatatttgtacatctttcatgtgccttatgaatgctagttaagcatttagaaaaataaagtcacaactttttcaatcaatctaaaatatgatttagaaaggaaaacaatacagccacactgaaatgagtaaagcattagggtttttttaatgatcaaataggtgataagacatgacatttaagaataaaaactaagaatattaaatctaattaaaaactcagtatttcaaacttcatgcttaatgaaaacgaatgtgactttcttccagaagtgtcacaaaatgcataataattacaaatactcaataattcaagtttttatattattgactgtatctattccttggcctctattttttagaattaatcaatattttctgaaaacttcctgttcacatactcacctaaattaatcttacttgatcttacttttgagaactgtcaaaatcacacacacgcaaaacaaaaaaaaatcagcatttcttattacaggcctagaatatcatccaaacaaaaggataatagtaggaacaacaatatagtaatagctaacaatatatactgttaactctgagctactctctaagcaagcactttacatgtatctctaagcaagcactttacatgtattcttattttctttacaaatatcttatgagatagatgttattattatcttcacttatacgtgaagttatgacttatacagtgttatacagctaataatggtagagccaaaattcaaatctagacagtttttttccagaatactactccccaaagttcttttgttataccattctccgtcacccctacattcaaatccctgttctcagtggttctcatcgctaagagaaacagtcaagagcaaagaagcaatgaaaattcaagttgtgattaggaatgcaatgattgtcattgttaggttagaaaggtggagtgattgatagtgtacagataattaagtttggaagtcaagagaaccaagttctattactactttactgtatgacctaaaaccagtaataattcctaccttctaacctttagaatgaagagtaattactctgtaaaataatcagttattcatcttaagattgggaaataatgaataatctgaaattcctcttagccaaaaatacttcatttagctttataatacattatataatttgggtagtaatttttcttcatatttatgatcaacattaacattttcagaacaagcaccaaaccaaaacgattgttggtaccaagaggagaccagcctgggatttgcaaagtttccagaggtcactgaacatggttcaacttggaattaaagctttatataggaaatacattaagaacatttaacattgatgcttaaattcatatttccttgagtcatggtgataaccagttctaaagaatagaaagtgtgttctacatattatagtattttctttaagaacaaataaggaactcaccaagttacctataaagaagcataaacaagctttgattttcagtggtaattataattaacttcaccagctatataacctgacacacttccgacttctttaagaatgggtcaatactgaaaaggaagtgtttttcacattaacctagaacttaggaaagctcggtggaatttaacaatgaaaatttatataacagtgggaaaacatttaagaatggtcacctggaaaagatttataaaattgttttgcttataaatattgtctatttgccggcattctcttatgttgtacatagatttaaaaaaaacagcagcccaggcgctgtggctcaagcctgtaatcacagcactttgggaggccaaggcaggcagatcatgaggtcaggagtttgagaccagcctgagtaacacagtgatacctcatctctactaaaaatacaaaaattagccaggtgtggtggcgcacacctgtagtcccagctactcgggaggctgaggcaggagagttgcttgaacctgagaggcggaggttgcagtgagccaagatcatgccactccactcgagcctggtgacagagcaagactccatttcggggaaaaaaaatacaaataaaaaataacattgctactctctatcagtgagcaataaatgactgaaaattcaaagaataaatggttatggatacatacacacgtgtgtctgtttttatgtgtgtatgtgtgtgtgtatggaagttcacctttgattagaggtttttaaatgtgattactgttaaatgattagtccatctgaaccaatgggaaaagcacaactgaagcagaattttttttaaccctgaggatttaataacttttttaagcaacagtgttccttttttgtttcttgtttcggtctattaaatgggcacttgtttaattcagtgaccaattttatataattttcttaaaaaaaggacaccttttatatctgatttgataaaagacagcaaatagaggtgggaaaggtttcatatagctataatattctgcagataaaaggaggcttggaaattatctggctcagagacttttaaccttttttctgccatggacccatgtggtacttggtcaaagcctacagatatttttttcataaaaatatttttaagtgtataaaataaaatatataacattagaaaaccaattcaaatcatgatcaaaataacttttaaaacaaactgcaatataataataaatgcctatttttaaatgcattaaataacaaactaggagcagatctaataactactataatttgaaatcattataaacataaaaagatatttataaccattgaagtaaaaggttctgttaatattactgtgatttgttgcctgagctcataatgaaagaagataataaatattaattagatttttaaatataaagattgtaatttcatttctctgtcccagtgaatggacctgtcttttacccacaagattctctcaagggacccattgacctgagttaaaacccctagaaacatccatattttgcaaataagaaaaccaagacccatagagaggagataactttactaaaatcatacaacacagaattagattaatcctagcagagctaatctcagacctttactcagactttttctgtagctttagtctagaagttggcaattcatctattatttgtcactgattcctagcatgatttgtagcaaattctttattcttattgtgcctcagattctacctatataaaatatatgtgacttaaaatattcataaagataataagaacaacttcaatttctattttatttttacttacaatagttttcactttcacatacattaccctacttaattttccccatattatggatgaggaaattaaagctctaagtgttaaatgtcacatccaaggttacacagctaggaagaggaaagtccagtattggaaatcataccatgggactccaaaggacatcctctttatcatgctgcctttcatgtcataaaaagccaaaactctttgagttcttcagttgaatatgtgctgtgatatcataaatctaattaaacacataagagctattattaaactcaaataagccaaatacttgcatcctaatttattccaaaaagtgatgcatgaatggaaccatgggaaaaaacttttctagaacaattatccatttgtgtttaagaagtaagaagagaaagaaatagaatgtaagagtctaagattgtagagttattggcttaatgttatttaaatcaaacttttgcttctgtttctgggtaggctaaagaggcaagtaatctgagtaaacgggtccctttttctccttcctcttaatcttatgagtagatggtactcaaagaagttcattctttcagagactgattactcttaaataagtttaataaggtagaaaaactaaagtcaaaataagccatgatgcatcaaaaatttctatcatctctgtcattacagtgaccagaccatgtaagatataaaacatcctgctctcttagaaaataaggaatcttcttaacctaacctgaaactcttggtatagaaaacttttattggactccaaatgtcactatttgattaaccttaagtaatattaatttctaaattcttgagatcattctgtaggatacccagatatctcttagctataatctacatacttctcatattatctgtcaatactatcagacccaaataagtaaaacttctttgtaagctgataaaacaggtacaggaatggctatgatcatacttatactattaaaaataaattttagtctgctgagattgaaaagaaaaataattactacaaaatattcagatttagcaaatgtttcctctgtacaaagcagtgtatttaatgtagtgggaaataaaaagaggataaagtcatgatccttttcctctaagaacctgcagtctacttggggactcatatcagtaattggaatatgagtaactattaactcctattctatattataaacttctataagtcctatattagaatttcaaataagatgccgtaagaatctaggcaaatctaaacctaggttgtagtgttggttgcacagccatataactttattaaaagtcatcaaacttttaatacttttatacttaaaatgaatgagttttatggtagataaattatatctcaacactgctaaaagagtttagagaaagaagaaattatttctgattgaggaacttgggaatttttttttaatggctggtgtaatctaagctggatcttaaaggacaagtagtatttgcatcagaaaataagcaacagtgtattccagataaaggcaacagcttgtctaaggtctaaaagttcaagaatacaaggcagtttctagaggagctggttgagactttgctccatgccttagattatatggcttgcatgcctaccgtgcatatggccatatggctatgacatttccaaaatgttctggcgtatccctactgagaaacgtataactgtacatagaattttccacctctctttgggttagaaacaagagcttgcctacattataatgaggagggtgtgtaatcacagagttattttacagctgtcagtggcaccactgatcataacaactactgacatttattttcatttttatagcttaaaatcactgatgaatgcattatctcctttgagccacaatctttattttttttctgtgaggaaactgagattatgggagggcccagagcctaaaataccaaagccacattaaagggaaagtcaagatattctggcctgctaagagtaaaaagaggaagagaaaatgagtacatgatcattgaacagtttagacattgctaactaaattgggatgtacacatgaatcaaagttcatctcacacaaaaagaataaaatggataaagttaactactgtcaccaataatatgaaagcaaagttgaattttttcctgaagagctgaaataagcctattattgacaggaatagcccattttaaataccttgtattgataacagagaagagtacttaggaaacagtttctaaatagcttttttgttgtttgcttttttaacaatgtaaaaagattaaaatttaaattgtgtctttccaaaacagaggacttctcagattatataagtaagcagctaaacagaaacttaatttctaatttaaaatgtgattagtggccagtaaagtcatgtttaaaatggaaagatagttttcctaatgtccttcaaagaagatgacttattttgttcttgactttgaccccatctgaccaagtgctcagaatttttcaatatgaaccatactgtataccatttacaagaaaaggaatacaaattagcctggtgagcagcaaaataggcaattttttgaaatcggatttgtgttaacctgcaatcaaatgtaatttccattttaatacttatacattcttatattgttatgaacctattcttaacacgggttttattttctttgtttctctcctccctcacttctgtgaaatacagaagggaaaggatgttattcacacatttgtacccccactaactggtgttacagtacatctggcttccactggagagcccctgacatcgcagggaacggtgatcaaaattccacacactagcttcaagctgggggctcgtagctactgcagcattgaaagggaatcttttcctggcttctttaaaataagcatggtgatgggatggtttaagggaagaacacctctcaaatcacatgaccactgctacgctttcgtgtgtcctgctttcttcataacagcttggcactacattctttccctgtatcttaatgggcttgtgtgtgtacaagtggggtggagggtggggaggtaaatggatggttatacattatgcatgcatctttcactgttaaagcaatgtgccttcccttatatgtcacaaattatggtcacagattaaatcttctgtgtcttgagatattgggccatctctctctttttggtgtgagattcatgtgtttgggtgtgttttgatgtttacaccctcaattgttcttcatgttgcatttaacgtaagttgaaatgttctcccataagagttagcttttcatgttgggctgaaaaagtcttcatttctgtgtagcaattcatgttattataacctatggctttcaattgtacctcccataatgaagagctgactttaaacactgtgctattcttgttatgacctaagcataaggtaagtgatttctctaactgtatctaaagattgttgttgtttgttaaaatttcttcgctttttttaaggcattttcacttttgttccttacatttattatgtgctctcccttctgtttttctgtttcacatcttaagatttcctaatggacgatgtgatcttcagcaaaaattatattacacatgtaaacacatgttgaaatgaattatttgatgtctcaaaacaatcttgattagtaaatgaatataccctatgttttcattaagtccttcatgttttttattttctccattgactttaatataatatgctgttcctacatgttattttagttttgattccagttgaaaggggaattatttgtcaatactgtaaagtcagatgttaactgaagtaaaataacatgatccagtagaataaagtagaaggtaatcagatgccataccttttatttgtaatccctgacaaatttaacgttaggccaaaaactgttttattttgctttccagactttcctttttttcccatagagtaaagccagggtaacataaagaaaaaaacgagaagccataaaacttgagacagatctgtgttaccttctttatagtccataagaacagtagttgtttctcaagtgtatcatttcaagtgtatgccattacattgtgagttaagtaaaattttcattttgaaattgtataaaattaagtacatattataaagagaactagtttcatggtgcaagagaaaaagttatttgctacatgcataaataataaacaacatttttaaatttttcttttcttcagtggtgtataggttgattgattgattgatttatacacacacacatactcaagatcactaaaggaattcttataatcattgatattaaagtgattctccccaaatctggttcaaatagccaatgtaatataaatgggaaagcattgattatactgctgttggcaatttatgaaccttgataaacgctcagattcagggaattgaattgttttcatcatccaaatttctccaccaaagctgtttgaaatatgtagttctaaactgaggtgccacaaagcaacacttgggtttctttattcaattcatgttatgaatgattttgcttgttaattttttaagttacctagggaacgggagagggtattttgttgttgttttggtttggtttgggtttttttggtaaagccaactagttcttcaccaccatttccattatatacattagaaaatgtatataagaggcattatataaatctgttggaacattttatgagacaatttgaactactcatctgaactgctctgttcattgtaaatctcttgtttctatccatacactagctccactctagattggaagggcttaaagatgaactctggaggaatagaggctacgacttaagagtaactattactgatcaaaggagccactttccattcgcaaacattgctttgcgctatgggtttgggctccttctgtttctacatcttgttgaatgaagactttcttgacttccatttgacttctttgaactctgtttttgtcttttaacatttccccctttcttttccttctctctcccagatttttctctcactcttctagctttctcttgtgttctttgaatcactttttgaaatgtagtttctctctttattaagcttgtctattgtctgttagtgtgtgtttcttttctttaaggctgtagtggtatagttacacttatgttcattccatagtatagcaacttgcttatttattttgcagcaagttcattagtcattcttaccctcttggtatgaatttttaatgagaaatagcagaacattctgcatttacatattgtccccttctgtaattccatactttattttccattgtttagatttacaccctcaaacctctctctcttttcttttcctcattcttgtgtcttcttccctgtattattttctttaagcagtcattgatttatttcccatttggtccagaattgtacttaaataagacttctgagtaaaagaatataagaatattatcttcagactagctttttccttctagtatgtttaaaactagttgaacaatctgggccaaaagagaataactaacatttggaattatttttccttttttttttttttttttttttttttggtgtgtgtgtgtgtgtgtgtgtgtgtgtgtgtgtgtgtatttttcttgtatgtatgtttgtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgttaatgacatgtaccatgctccttgaatgtaacagttttatcacatttaaaagaatgtttcacattgacttaaacatttgagtcaaagcataagggtttctgattgataaattctatatacacctaagaactggtaaataaatttgttcaatttcattgattttcaacagaagcatatttcataatcaatattataactatgataaattatgataatcagtaacaggttatcagaatcaaatgtaaatgttatataaggatcaataagtaacaggttatcagaatcaaatgtaaatgttatataaggatttctctattttcctcccattaatttatatacatactaaaaaattactataatggaatacttagttacaacttaattacttgaattttattattattctagtcaagagatatactgaatgccttactattaagggccaatatttacaactaaatatacagtaacaaatttccatataccgattttaaatacaaatgaataaaaaatcacctttggtttatctctgtgtaatttacaatattgtaccccgaatttttttctggaagtcagttctttctttaaggaaaagataaagaaaaaagatgaaacaagtataacatttttactaacatgttatgacatctgaaatactaatatataaagcctttgctcctagacctcaggagcttgcccattaaatatgcatatctgcctattcatgctataaaccctaaattactgagtttatgctctttctacaggtccagtccaggtgcagcagcaaggagaacattctcagagccagtaagtattttaccatttctggtgggctgctgaactagagcttataaagctaaaaatgatattttggtgaaaaaaaagaagaaaagcaatggggaatatttatgtgacaaatatgaatattagggcttttaccttctaaaaatattgccagtatcaatacattaataaatatttcccttaatctaattgtttttgcaagctgacaccagaactttgatgcactcctaggagggtaggaatgagctcctctgtgactctgaacctctctttaattgttccactgccaaaagttatttgaaaacaaactaactgaaaataataataataatattgaaaattcctgaacagagactaattctgaaaaaagaatatgtggctcccaagagggtacatcatactcattttgtgaatatgaattcctgacatataataacttcacaggcagcatgtgttagaacatagaaccttaaaccaagagtaaagaatgctcaatttatttattggtttgatcactaatagcattaactcaggagtcatttaactctgtatatcattcatttttctgtcttataaaaaggaactataataggttttccttatctgtacctttgaaatgatgtcacattgaaaatcgtgtcttaaaagatttgggatcctaagaaaaaagtgctatataaatgctaatggttttattattgttctctatatcttaatagcttaatgacatcattccatcttcttcctgatctttatcaagagaagtacaggggaatcatactgaaataggcctactgatactcataccactgggagttttagcaaattgaatgatttctatttctagcagtatgtcagcattatttttgtgttatactcctggttatgctttattacagtgaaaggatacagattaacatcagcaaaggcaaaaagatacatagggcagagtccaggagaaaccaggtgcaagcttccagttgccctctcccagtggagccatatggacattgcttatttctcccagcagcaatgtatgacagcatgcatcaagtattgccaaccagggaagctcactgagccttaatgttcagggtttttattggggttgggtcacatggccatggagtgctcatgtggctgatctttatttcacaataaaaaaatagagaccttcacaaaggtaaaaattcatggggtttttttgtgtaaatttttccatttttgttttgtaaatctgttatcttagctccaaacccttgggcaaacacaattattgcttgcccaagaccattatattggcaaggcgcagtggctcacacctcaaaaaaataaattcctctgagcccctttgaacctccaatttagggtatggggagtgtttccaattgttacagtgagataagtctcgcattagattgcactttgatttcttttctttgagctccctagttgccaactttattttgtgtcctaggagtaaggaatcctttttaggactcctttgataatctaactaaatttgaaaatgcatttatccttggtaaaaatctgtcttattaccaataacactactatttgtctctgtctgtccttgtcattttttgttgtatctctgtaaggggtacgttcataaggaaaaacatagacataggcctcagtaagtattttgcaagctggccctgaaaaccaagtttcaggtttcttgtaagactggtgtcctttagataaactttaccctggtcattgatcaacctatgagaaccttccttgttctctttctgttttgttagtgagagtcttgctatggaagaattataataggcaccctgaggaatttttgatatgaacaaaattgtttatttaaaaggagcctgagaataaaaaggaaacaaaattgcaaacaactaatgagctagttttttattggtttgaggaaatatcccaaataaattgagattccaaaagtacttccataagaaattccttggccaaggcaaaataaaatgtaataaacttaaaataatgcctcttttatatccctcaaaaccaaatcttggccctaattaagaagatacctgggtctcactggctatagcaggcaatgagtttgcaacttttctgaaattgccatgccattatatgacttaaccaagtccttagaaactgaacctctttcgtggccaccaaatgtgaacaagctctcacaaccccttgccttgctatatccatcaatcccaaatgattacatcaggatctttatccaatcttaatgaagctcctatattgaaagatctactttggaccaaacttcaaaatctcataaatatcctgactttcctttctgtgactctgactctaagactaagtctttgttgaagtgacatttttcctttctagagtcaaactccctatattaaaatctcaatttctctacttatttgctgtgtgaacttgaacaagtgctcagtatctctatgcctcactttcctgatctgtaaaatgtggtaataacttgttcagaaagggcagaaattgtaaagaataaaataaataaattttaaaatgtggtaataagatggtctgccttatagattgttacaaggattaaatagtataatgctaggtacataataatcactcagtaaatgttagctgatattattgttactattactactaatactaccaattaccattattttcttgataatgatgatgataataaaataggttactttttattgaacgttactgtgtattaaatacttttctacatggttcatcccacttaatcctcacacacaacaacaaatcctgtgagtaaaattctattaatttctacattaaatagataaggaaattaaagattccagagttaaataagttgcttgtgtatatggtaaatggtatatgagttgaagccagtatttcagaccttgattttatagcccacatttttttttgtttgtttgttttgttttgtttttgagacggagtcccgctgtcgcccaggttggagtgcagtggcgcgatctcggctcactgcaggctccgcctcccgggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcccacctcggcctcccagagtgctgggattacaggcgtgagccaccgcgcccagccttatagcccacatttttaaccaacatgctgtgctacctaattaatttcaataaggccttcaaaacccgattcaatattgtgcaaaatatctaagcaataggtaagaatagaaattgatagctggtatatccgtgggtacttataaacaaatatctgattatcagtgccaaaattgttttattaccacgtgttatcaggatgatatgacactattgtcttctgtcatctttccacctataattcatttccgtcaaccactttatttttaataaagcaaacttttgttatttttacgaataactggttttatgcaagaaatcaagtaaaataaaaaaattttacagatgagaatttatatttcagcactgtaggacagcgttttaatagctttctttctgccccaccccgagacaaagtcttgctctgtcacccaggatggaatgcagtggcacgatctctgctcactgcaacctccacctcccaggttcaagtgattctcctgcctcagcctcctgagtagctgggactacaggcttgtgccaccatgcccagctaatttttgtatttttagtagagacagggtttcactatgttgcccaggctggaacttgaactcctgacctcgtgatcagctgcctcagcctcccaaagtgctaagattacaggcatgagccacggtgcccagccttaattgttttcttgatgtactttgttcagcctgtgttttatcggacaagtggtacattttcctgggattaacttttctagatttttttagtatattttaatggaattcagaatttttattgatatataatatttgtacatatttatggagtacaggtgatatcttgatacatgcatagaatttgtaatgatcaagtcagggtatttgggatatccatcacctcttgagcatttatcatttcttcatgttgggaacatttcaaatcctatattatagttattttgaaatatacaatacattgatgttaactatagtcaccctactgtactatcaaatattagaacttattcattctatataactgtatgtttgtaccttttagccaacttttctttatcccccacaccatccttcccagcctctgataatatcactctgctcactgcctcagtgaggtcaacttttttaactcccacagattaatgagaacttgcaacatctgtcattctgtgcctatcttactttcacttaacatgccttccagttccatctgtgttgctgcaaatgacagaatttctactattttaaatagtagtccattgtgtgtatataccacattttctttatccagttatttattgatggacacagtttaattctatatcttggctatggtgaacagtgcttcagtaatcatgggggtacaggcatctcttttgatatgctgatttcctttcctttggatatataccaatatagcagaattgctgagttatatggtagttctatttgtagttttttgagggagtccatagtgttttttataatgtcttactaatttacattcccaccaacagtgtataagagttcccttttctccacatccttaccagtatgtgttagtttttgtttttttatagtagccattctaactggagccggattatatttcattatggttttgatttgcatttctctgatgattagtgattttgggcattttttcatatacctattggccataggtatgtcctcttttgagagatgtctattcagctaatttgattactttttaatggaattatttgggtttttgctgtttagttgtttgaattccttgtatgttgtggatattagtcccttgtctgatgaacagtttgcaagtattttcttccatgttgcaggttgactctactctgttgattgtttcttttgctgtgcagaagcttttcagtttgatatagtctcatttgtctgtttttcttttgttgtctgtacttttgaagtcttagccaaaaaatatttgcctataccagtgtcctaaagtgtttcttctgtgttttcgtctagcagttttatagttctcgttcttatgtttaagtatttaatctattttcaggtgatttttgtatataataaaagataggcgtctaatttcatttttctgcatatggctatccagttttcccagcaccatttactgaggaagacaccttttctctgatgcatgttcctgatgcctttgtcaaaagttagttggttccctattctgtttcattgatctatatgtctggctttatacaaataccatgctgttttgcgtactacagctttgtagctgctattgttacaattactactagtactactagtactactagtaatactatgattagtatactggtggtacttctggtattatcattattctttttttttttttttgagatggaattttgctcttgttgcccaggctggtgtgcaatggcacagtcttggctcactgcaacctctacttcccggattcaagtgattctcctgcctcagcctcccaagtagctgggattacaggcatgcgccaccacacccagctaatttcgtatttttagtagagatgggatttcaccatgttggccaggctggtcttgaactcctgacctcaggtgatccacccgcctcagccccccaaagtgctgggattacaggcgtgagccactgcgcccagccttatcattattctttagcgtaaaggcactgtcttaaaagatctactcatttagtgaagatacattaactagttggaataacaaattaagctttaaaatacactagtcttacgtaaatttatcagataatttggctgccacctctgagagcagagttttaagaaaatggatgcatttaggactatgattagggtataagaggaagggaaagcctaaaggaaggcatgtcaagcttgggtacctttataaatcactccctccttaatgaagtaattatctttcttggcacttctgtctcctagtgttccttttaaactatctgtttgcattttctccagcttctttggtagctctttttttttttttttttggcccagtcattaattatcagtattattcagacttctctcatagatcttccattcacactctatattatgcatgagcaagaccatctattaacaagtctttcaagtaaaccaaatctataactccaatccatatcttcttcctaaacttcagttttttttccaattgtctgttgtagatcttttcttaaatattacacaagtatctcatactcaacgtgactaaaactaaatttatcatcttaatttactcttcttccatatttcaaggagtaacatcactagccactgatttgtccaaaccagaaatctttagtgtttattattcctcatcctacaagcatttttatcattctaaaatacaaatctaaacctatcatactcctttaataacattaacccttaaatggctccttattattcttgtgtaaaggcccaactccttaaaattgcttactattggcttctgcttatctctagttttacctggaattcagtgcaccagccatatgaacatttcaatttgcaaatagttccctctttcccaaaatgctgatttctcatttcttccaaaacctggataactcctacttatcctacagttctttcaggaagccttctatcacctcccaaatctgagcaaagtgcccctcccaagttcttttctagtatactgtagtttccctactttattgcaagagtatttacagtgtagtgcttttctgtcttctccactgtcctctctactccaccctaagcatcttgcaagacctcatctatcttgttccctgataccattaccagaatctatcaccatgactctctctcaataagagttgattggatgactgcataaataaatgagaggaagaccttaagcagacagagcaagcaaaagacagcagaattgctaaataagaaaccagtatgggaacagaaaaggaaaataatgaacattagcaaaaactctaatatatttattgaaaatactgggggttttgtttgtttgtttgtttgtttgtttgtttgtttgttttaactgctccttctcttcaaattatctcatgtatccactttggcccttatcccttcattcattctcactactgccacccaggttctcgacttattactacctcttgcctggagtgtaagtcagacttttcagtcttataccccttaatttgtcatagatggataggtcttctggttagttttcttgcatcttactattaagaaacatgaatttttatcttttttattattcccaggaaagaggattttgaaataatccttggagaagtatgttaatttcttatgcctcctatttttagaaaaaaatttctgtttatctcttgctgcaacctaatcccttatcatcttgattggcattcactggatctgacaatagctgcttaccatcacttagattacctttctttatataactaaggataattagcaattgacttccataaatatttattgaggtactatttataagcactatttttctcgacttttttatctagtctaagtaaaccaacttattcaattttccttgctatatccttatgtagtttatttactaggttctcgaaatttaaaaagaaaaaaatattttagagattgtatctcactatgttgcccagactggatttgaactcctgggctcaagcaatcctcctgcctcaatctcctgagtagccatcatgcctggctttcaaatataatttttttatttgtgaaacctatattcccaaagtactattcgctattcaatttaaattttgtcttatttctcttatttttctcggttatcacctttttattttatatgaaaagttgcatcattcattactttgagtcaggctttttaccttcctcgttgtcaacattatagcaggtattgctaagaaacattaagttaatagataggaagccccaaccctcatatcctcatagagacaccaacttaaaagcaatatatggtcataatagcttcatgaaaactccagaaaaaaggttgttgcaatacccccaagctggcacaaagccaagaatagccacattgaaatggataagaactgttttactttacctgtgatagtccctcctccaagtcagcatagcttagcatgataaagagaaaacaccctactcatggtttctttctgtgggggaagagtggaaacatacatccaatattctagcttttcagaggactgcccaaataactgccttctatctcactgcattgatggaactaccacagtttgaatgcctgagggctactgaaagccagggagagtggaggcagcttgctgtagtaccacagggcctacagtgccacacacaggcaccagcacctctcagtgcaatctggagaaagtgcccaattcttgacttttcactcaggagggagagagaagagtggaacatgcattaggtgttctgactttttggagggctaccaagagaatggtttctctgttgcctcactggggtggtaacagagagctggtgtactttggatgtctgcgggccactgagaataaggaacagtgatggcttgctacagcagcaccacagagcctccagtgctgcagacagacaccattgagagcaagagattgcaagctcctgacagagaaacctgcaaacctctctaattgggaaattacatacacagacccagagaagtcacattcccccgctttcaaaaaggtttcagaggccgcctcagaatttctagccaggttgattggtgagagtgtcccctatataaggccagtctgtaaagattgggagacatggctgtttctcaaatgactaaaactcagcaaaaaatcacaaagcacaccaagaaatcaggatacatgcccaatcaaaagatcaaagtaattatctagaaaccaacctcaaagaaacagagatttatgattacctggcaaataattcaaaataattacctttaaaaaggtcactgatctaagagagaacacaaatggacaactaaacaaaatcaggaaaccaatgaatggacaaaatgaagatttcaacacaaagttagaaactattaaaaaagaaccaaagagaaattctggagccaaaggatacaataactgaattgaaaaactcactagaggggttcaacaattacttgaccaatcagaagagatcaacagcaaaattggaagacaggtcatttgaaattattgttagaggagcaaaaagaaaaaaaaggaacagaaaagtaaagcaaagaaagccaaagaggccaggagtggtggttcacacctgtaatcccaacactttgggaggccaaggcaggcggatcacttgagtccagggattcgagactagcctggccaacatggtgaaaccccatctctactaaaaataaaaaaagtagccaggcctggtggtgcacacctgtaatcccagctactcaggaggctgaggcaaaagaatcgcttgaacccaggaggtggaagtttcagtgagccaagattacaccactgcactccaccctaggcaacagagtgagaccctgactcaaaaaaaaaaagaatgccaaaaagatttataaaatgccattttgtggaccagtgtatacattatgagagttccaggagaaaagggacaccaaacttatttgaagaaataatggtcaaaaacttcccaaatttgatgaaagaaatgtacatccagacacttgaagttcaaaggatataactaaggtgaatccaaagaggcccacactaagacatgttataatgaaactgtcaaaaatcaagggcaaagagaaaatttgaaaggagcaagagaaaagtaactcatcatgtacaatgaagttcccataagaatgtcattggataaaccttacaggtcagaagggagcagtacgttatattcaaagtgctgaaggaacaaaatctgccagtgaggaatactgcatccagcaaaactgtcctttcaaaaatgaaaaaagaaagactttcccgggcaaacaaaacctaagggagttcatcacaactagacctggcttacaagaaatgctaaagagagtcctgcaagttgacatgaaaggactctagacaacaacatgaaagtttatgaaaaacacaaagctcactggtaaaggaaaatatatatatatacaaattcagaatactatattactataatggtggcatgtaaatcacatgtaacactgtggggatggaaaatgtaaatgagtagacttttatatatgattgatagattgttctgtttcatgtaagtctcatggtaattacaaagaaaatgcttatagaagatacagaaaagaaaatgagaaagtaatcaaagcatatcgataatgcaaaggaagacagcaagagggaaaaagagggactaaatagctacaagacggacagaaaacaacatgtgccaataataaggcctttaagtgtaattggattaaactccccagtaaaaagacaaagtgaattaatggattaaagaaacaagatgcaattatattctgtctacaagagactcatgctagatgtaaagacacatataggctgaaaatgaaaggacagaaaaagatattacttcatgcaaattataatcaaaagagagcagtggtggccatagttatatcagacaaaatatagactttaggttaaaagctgtcacaagagacaaagaagaatattatactgaaagaacagaaatatataacaattataaattaaaatccagctaacattagagcacccaaatataagaagtaaacattgacaggcgtgaagggagaatagacaataacacaataatggtaggagatttcaatattctactttggataatggatagaacaaccaaaaagattaataaggaaacagagaacttgaacactgttgaccaattagatctaacagaatattccacccaacaatagtaaaatacacattctttcctagcatacatggaatattctgtaggatagaccacatattaggctaaaaaacaagtcttaacaaagttaggaagactgaaacctatgagatcttagtggactgaaactagacatcaatagcagtaggaaaactggaagatacacaaatatgtgaaaattaaatgagacactcttgaacaaccagtaggtcaaaggaaaaaaaaatgagagaaattagaaatatcttgaggcaaaaacacaacacaccaaaacttatgaattgcagcaaaagcaatactaagagagaagtttatattagtggcatgtactttaatgagggggaaagacctcaaatcagcaacctaactttttacctcaaggaatgagaaatagaataaactaaatcaaaagttaggagaaagaaggaaataataaagatcagagcagaaataaacaaaatagagaataaaaatactaggaaaaaaagcaatgaaactaagagtaggattctctaaaataccaacaaaattgacaaactcttagctagacagacagaagactcaaaataactaaaatcagaaataaaaggagacattgcaactgatgcttcggaaatagagatgataagagactgctatatacaattatatgccaacaaattgaatcacctagaagaagtggataaattcctagaaacacaaccttggtgttcagtcacagtcttggtgactgaattatggagaaatagaaaatctaaacatatctataaccattaaggatattgaatcagtaatcaaaaacctccccataaagaaaacctcccaataaagtaaaacccatgaccagatggcttcactagagaattctaccaagcatttaaagaagaattggtaccagttcttctcaaaatattccaaacacttgaagaagaaggaatacttccaaaataaatttattaggcaacattaccctgatacgaatagaaaaaatacaacaataaaaaagataactgataaaaaaaattgatgcaaaaatcctcaacaaaatactaggaaaccaaattggattatacacttcagccatgtgggatttatccctggaatgcaaggatcattcaatgcatgaaaatcaataaatgtaatgtatcacattaacagaacatggaatgaaaatcacatgatcatctcaaaaggtgcagaaaatgcattttagaaaattcagcaacctttcgtgatataacaatcagcaaactagaaacagaaggaaattacctcaatataataaaggtcatttatgaaaagctcataacataacatactaaatggtgaaaaactggaagctttttttttttaagatcaagaacaaagcaaagatgctcatttttgccacttctttttagtataatactggaagttctaatcaaagcagctaggcaatgaaaagaaagaaaatgcatcccaaatggaaagaaagaagtaaaattatctctgtttccagatgacatgatcttatgtagaaaactctgaaaattccacttatatacatacatgcacacacacacacacacacacacacacacacacacacacagagaaacactaactgttaaagctaatacaagaagccagtaaaattgcaggggtacaaagtcaacaataaaaaatcaattgcatttttatacactaacagtgaatgattaacaatctgaaaaagaaattaagaaaatcccatttacaatagcatcagaaagaataaaatacttaggaataaacttaatggagaaaatgaaagacttgtgcagtgaaaaccacaaatcattgctgaataaagttaaagacacagtaaatggaaagatacctggattcatggatggaaagacacaatattgttaaaatatccatactacccaaaggaatctacaaattcaaggcaatccctatcaaaataccactgacattttttatagaaatagaaagtaccaccctaaaattcatatagaatttcagaggtcctgggacaaccaaaataatcttgaaaaagaagaacaaagctggaagtcttacatctcttgatttcaaaacatattacaaagttacagtaatcaaaaaagtctggaactggcataaagacagacatataaactaatgtaacagaatatagagcccagaaatacatgttcgtgtatatggtcaaatgatctttgaagatggtgccaagaccattcaatggggaaagggcagtctcttcaataaacgttgttgggaaaacagctattctctttgcaaaagaacgaagacagacccttatcttataccatgcacaaaaattacctcaaaatggattaaagatctaatagttaagtctaataggtaagacctgaaactatgaaactcacagaaggaaatatgcagaaaaactttatgacattgaaatgggaaacgatctcttggatatgataccaaaaagcacagacaacttatacaaatgtagacaaatgagactacctcaaatttaaatattttctgcatcaaaggaaacaatcagcagagtaaaatggcaacaacagaatgggaaaaaataattgcaaatcatatatctgataaggggttaatatccagaatatataaagaacccctacaactcagcaacaaaaaaaatcaaatatcccaatttaaaaatggggaaaggacttgaatagacataactcaaagaagatatacaaatggccaacacacatatgaaaagctgctcaatgtcactaatcatcagggaaatacaaatttaaatcacagtgagataccacctaacaccattaggatgactactaaaaaaaaaaaaaaatagaaaataacaagtattggtgatcatagggagaaattggaacccttgtgccctgttggtaggtttgtgaaatgttgcagctgctacagaaaatagtatggcgtttcttcaaaaaattaaaaatagaactttcatatgatctgtcagtctcacttctgggtatatatccaaaagaattgaaaatagcatctcaaaaaactacttacacacctgtgttcatcacagcattatctacaatagccaagatatgaaagtaatcttaatgttcattaacagatgaggggataggcaaaatatggtctatttatacaatgaaatattattgagcctccaaaaaataaggaaatcctgtcatatgctacaacatggatgaaccttcaggacataatgctaagtgaaataaactaatcaccaaaaactaatacttcatggttctacttatatgagacatctaaagtaattgaactcatagaaagtagaatggtggttgccaggggctgggaggagagggaaatagggaattagccaatggatgtaaagcttcattcacacaaaatgagaaagttctagcaatcagttgtacaataatatgcatatattgttaattctgttaaattttttaacataaatacttaaaaattgtttaagagggttacaaaatgtatatagattaagcatctggaaaatgtattaaaaagttaagttaatcattgatcatagaattatcctggaatggacatatattgtccttcagtgtctcttttttgtgatgtgtatatgttaccattctatgtgtaacaagtgaattactgattctcattattagattcaccacctacataccaatggctttctattttaagcctgacttctcttccaagctccagattctccttgctgttgtgtactggaatcaccctttgatgtcctgctggcatctcacatttctttcatcagaaaccagatttaggatcctttcctccaaattattcctgtattgttcttttatacaattacactcccacttactctaataactaaatttgaaatctcctcatgatattaccatctccttctcaaagcatagtcagtcagtcatggaaccctctgctgcagctcttctaaatatcctttttcccattcttgttgtaatagttcaggccttctgcatcattctcctttgggattgcagtagcataataattgctcttcctatcttcagtctcttgctccctgacagtcttccatcagtcaagtattacattttaaagtacatactacttttctactgaaaatcttgaatagttctccattttccatagtactaagcctccagaatttgtcctgaactgaattgaccagccttataccttatatttcatcctcttcacctccaacctccagcttcattgggcaatttcgcattctctaaaagtactttcagatctttgtaattttgttcatattttctccagtttcatatgttcttctcccttttctcattgtttaaagatcccccctgtaaagccttatagtttgtcccatcagaattagctgttgctttttctttgttatcttacatagtgttttgtttgtactttaaaacataagcatacacatagtctgttattttttccttaaaacacagcctgatttgtgtgttccttgaaagactgtgtaagataggaatctcatctggtttatttcaacatactcccaggccaggtgcagtggcttgtgcctgtaatcccagcactttgggaggccaaggcaggaggatcacttgagcccaggagttcaagaccagtctgggcaatatagtgagatctcatctctatcaaaaattaaaaaattagttggatgtggtggcacatgctgtagtctcagctactcaggaggctgaggtgggaggattccttgagcccaggaggtggaggttacagtgagctgagatcaagccactgcattccagcctgggcaacagagcaagaccctgtctcaaaacaaaacaaaacctcactcactgtgtttaacaaagtgccctatattgaccagaataaagtttgaagttgtaagtagtgtttgcttatctatacaaccgttctactttgtcagtctatataatctagactgtactgtgtgcataacatctttggaccttgatgttaaggcctttttttcttcctcaaagaggtgataatctagttaagaaaatggacatgtatataaataagtataattactgtgagatatgtggttaatataatatgcaattagaagtcctaaaaattgagtattttatagtacctcagtgcaaaaatagacatacgtgcattgtttcagaaaggagagactattgatgaaagtgatttttgaaattttgaaataatttcaaacttcagaaatgttacaagaatagtatagagaattcctgtatatctttcatccagactcccccaaatgttaacattttgtcacatttcctttatcatttctctctataaattaatatacatattatcccaaactacttgtgagtaaattgcagacatgatgcctctttacccctaaataatttaatgtgtatttccttccaaaaaaatctggagggatggcaaataaaaaagactttctcttacataaccacagtacaattatgaaaattaggaaatgaacattgccacaatactattatgtaatcttattcaaattacattttgtcagtttttctaataatgttctttataacaaaggagacaacattcttctgatctgggattcaatccagaatcatgcgttacatttagttatcctgtctctgtagactcctttaatatggaacaagtcttcaagtttgtctttgtctttcattacctttatatttttgaagcatatagctcagttattttgtacaatgtccctcaaatttatatttttctcaggtttcttaatggtttaattcttgttatacatttggtcaggaatatctcaaatgtgatgttgtatctttctcagtgcatcttatcagggggctcatgatgtcagtttatcctattactggtgatattaactttgatcacttggctaaaagggtgtctgcgagatttctccactgtagttaatgagtacagttaataaatatcttgtagggatatactttgagaccagacaaatatgttttgtttttcttgaggcttttaccttctagtcttagcattaactgattatttttccctaaaccaattattactagatggttgccaagtggtgattttctaattccaatatttcttcatgtaacagctgaccttctgttataaggaagaatttattctcaggccagcatattttcaaaatgagaaaggcatcatagctctactttgggccttattggtatttgcccaaaatacaaacactttctttttttttattttttttattatactttaagttctggggtacatgtgtagaaggtgcactttttttacataggtatacacgtgccatggtggtttgctgcacccattaacccatcacctacattaggtatttctcctaatgttatccctcccctaaccccccaccccccaacaggccctggtgtgtgatgttccccttcctgtgtccatgtgttctcattgttcaactcccacttaggagtgagaacatgtactgtttggttttctgatattgtgatagtttgctgagaatgatggtctccatcttcatccatgtctctgcaaaggacatgaactcatccatttttatggctgtatagtattccatggtgtatatgtgccacattttcttaatccagtgtatcattgatggacatctgggttggttccaagtctttgctattgtgaatagtgccacaataaacatatgtgtgcatgtgtctttaccatagaatgatttataatcctttggatatatgcccagtaatgggattgctgggtcaaatggtatttctaattctagatctttgatgaatcgccacactgtcttccacaatggttgaactaatttacactcccactaacagtgtaaatgtgttcctattcttccacaacctctccagcatctgttgtttcctgacgttttaatgatctccaacctaactggtatgagatggtatctcattgttgttttgatttgcatttctctaatgaccagtggtgatgagcatattttcatatgcctgttggctgcataaatgtcttcttttgagaagtgtctgttcatgtactttgcccattttttgatgggtttttttttttcttgtaaatttgtttgagttctttgtggattctggatattagccctttgtcagatgagtagattgcaaaaattttctcccattctgtaggttgcctgttcactctttttagtttctaaattttttagtttcttttgctgtgcagaagctctttagtttaattagatcccatttgtcaattttggcttttgttgccatttcttttggtgttttagacatgaagtctttgcccatgtctatgtcctgaatggtattgcccaggttttcttctaggatttttatggtcctaggtcttatgtttaagtctttgatccatcttgagttgatttttgtataaggtgtaaggaaggtgtccagtttcagttttttgcatagggctaaccagttttctcaacagtatttattaaatagagaatattttccccattacttgtgtgtgtcaggtttgtcaaacatcacatggttgtagatgtgtggtgttatttctcaggccttcattctgtcccattggtctgtatatctgttttggtaccagtatcatgctgttttggttactctagccttgtaatatagtttgaagtcaggtagcgtgatgtctccagctttgttcttcttgcccaggattgtcattggctatgtgggctcttttttggttccatatgaagtttaaagtagttttttccaattctgtgaagaaagtcaatggtagcttgatggggatagcattgaatctataaattactttgggcagtatggccattttcatgatattggttcttcctatccatgagcaaggaatgttttttccatatgtttgtgtcctcttttatttgcttgagcagttgtttgtagttctccttgaagaggtctttcacatcccttgtaagtcgtattcctaggtattttattctctttgtagcagttgtgaatgggagttcactcatgatttggctctctgtttgtctgttattagggtatagaatgcttgtgatttttgcacatttattttgtatcctgagactttgctgaagttgcttatcagcttaaggagattttgggctgagacagtggggttttctaaatatacaatcatgtcatctgcaaacagagacaatttgacttcttctcttcctatttgaatatcctttatcgctttctcttgcctgattgccctggccagaacgtccaatattatgttgaataggagtggtaagagaggtcatccttgtcttgtgctggttttcaaagggaatgcttccagtttttgcccattcaatatgatattggctgtgggcttgtcataaatagctcttgttattttgagatgtgttccatcaatacctagtttattgagagtttttagcaggaaggagtgttgaattttgtcaaaggccttttctgcatctattaagataatcgtgttttttgtcattggtttggtttatgtgatggattacatttattgatttgcgtatgttgaaccagccttgcatccaggtatgaagccgacttgatcatggtggataagatttttgatgtgctgctggattcggcttgccagtattatattgagaatttttgcatcgatgttcatcagggatattggcttgaaattttcctttgttgtgtctctgccaggttttggtatcaggatgatgctggcctcataaaatgagttggggggattccctctttttctattgtttagaatagtttcagaaggaatggtaccagctactttttgtgcctctggtagaattcagctattaatccatctggtcctggactttttttggttggtaggctattaattactgcctcaatttcagaacttgttaatggtttattcagggattcaacttcttcctggcttagacttgggagggtgtatgtgtccaggaatttatccatttcttctagattttctagtttatttgtgtggaggtgtttatactattatctgatggtagtttgtgtttctgtggaattagtggtgatatcccccatatcatcctagcactttcagaggctgaggtgggtggattacctgaggtcaggagtttgaaaccagcctggccaacatggtgaaaccccgtctctactaaaaatacaacaattagccaggcatggtgacacatacccgtaatcccagctacttgggaggctaagacaggagaattgcttgaacccaggaggtggaggttgcagcaagccaagatcgcaccactgcactccagcctgggtgacagagacaagactctgtctcaaaaaaaaacaaaaaataaacaataataatttgctcacttaatattcccagaaacaatgccttagcccgtgtttgttcgttttgttttgttggtattttttctttttcttatttctttccaggtgaagtagaattcaccaatttttaggaagatgtatattttccccaggacatgttagctggtgttttcttctgttgttgactagcacttttctgaatctctcaaggtatagcaagagccggttgatgtaaactatactttataacatcttattttccagaactccatgagtgctgctgctgcttttgttgttgttgttgttttaaaagcataccccagccaccgtttatggcatcaaaagcattataaaatatgtgtaattatttcttgagtacccccttcctcctcctcctcctcctcctgtctccctctctctgtctctctctctgtctttctctctgtctctctctgtctctctcgtctctgtctctctgttggtgtgtctctgtctgtctctgtctctctctctctgtctctcttgctctccctccctctctttctttttaaaataagctcaggtagatctaatccatttccaaggcctgaattcttaactttagaaaccccagatttcatctccatacagaatcctgtacaaaactgacgagttgatttctggacttggatgcctaataggtattacctattaataaagacccaaccctaaaatctgggtttgcttctcccttgactcacctgtgatccagacttaccgtctcaataaattgtaccactgttcacctaggattctgggaggattttcccaatctgtatttccccgtgtcctaaaggacccatgaccaagccctgtccgttctgtctcaaatatgtatctccaaacacttctctcaatttccacaactacccgcagccccttgtggaacaactggctctttgaaaaacatcccagaagttgtttcagctttttgctatgaggcctaagcctgaggcctaagacgctctctgtctctttttctctatctctgtctccctctctgtctctctctctgtgtctctctctcttgtctttctgtctttgtctctctctgtctctgtctctctctgtctctgtttctctgtctctctgtgtgtgtctgtctttgtctttctctgtctgtctctctctgtgtatttgtctctctgtgtgtgtctctctctgtctctctgtctccccctctgtctcagtgtctgtctgtctctctgtctctgtctgtgtctctgtctctctccatctgtccatctctctctgcctctgtctctctctctctgtctctccctctcttggtctcagtgtctctctctgtctctgtctctctctctctgtctgtctctctctctctgtccatctctctgtctctgtctctctttctctgtcactgtctctctctctgtgcatctgtctctttctctctctgtgtgtgtgtctctctctctgtctctctcctttcctctctttctttttaaaataagttcaggtagatctaattcattttcaaggcctgaattcttaactttagaaaccccagatttgatctacatacagaatcctgtacagaactggcaagttggtttctggacttggatacctcatagatattacatattaatagagacccaaccctaaaatctgggtttgcttctcccttgactcagctgtgacccagacattctatctcgatttttttttaaaggaagaatttatttaaatcatttttatatttagtatatattcataaattcttattttattttattaaatagattaaaatatgttactgttctaatttatgttgatgataaatttgtatcagatttagccaaagggagctcttcaatcttgttccaagatccttttgacatgttcctatcattatttgagcactttcttactgaaaacagttgtgaaggaagagttgtaatttcccaggaaaataaaaggatgagagaaaaattactctaggcagaaacagcatcatatgctatggcagaaaactatgaaatagtacagtgtattctgatatctacaatattatcaattttctgagtgatggaataatgagagatgagactgaaaggaaagcaaataagggttttatatactattctaaggaactgaaattttatcctgtaagtgataatcaactattgatataaattatgaagctaacattttgggacagcaatgcctattttatcatctttatgtacagaaatctcaggagaacttccatattttttaatcagccctagtaaataataattctttcagctatgcttttttggttttgtcagaaatgctttgaggctcattgtcttgaataagcaagtagaaaagttgtaaaactattagattgaagacaatatgaaaattattttcagatgtacaaagtgccctgtagtcctgagcctacaaactctaccattgccagtgtttccctagagctttggaaccactttctcctaattggagagagttatatgaaagtctaaatgctttgtatatctgaacacacattctttaaattaccaaggaccctaactatttaagctgaccatattactattacctatctttgctctttaagtttcctaggaaagctattccttatcttaggcggtttgctcttcagaaagatccaggaaatagaaatacaaggaattgaagctgcaaataccatgtggaatagaggcagtaatattaataggaacagaacaagtctcctgatatttgcagtatatccaaaaaatgaataatgatttacactttatgtagtttagggagcttttctactgcttgttttgaaaaatgaagtttcttgaggttctgaatttaatcaagaaggacctgcatgaacatcagaacatcttgtttctgctatgttctctcctatgatcaaaggcatcttttcttcatttattttgtgtgtgtgtgtgtttgtgtgtgtgtgtgtgtgtgtgtgtgtgtgtttgtttttttttttttttttgagacagagtctcactctgttgcccaggctggagtgcagtggtgcaatctcggctcactgcaacctctgcctcccggattcaaggaattctcgtgcctcagccttctgagtagctgggactacaggctcctgacaccatgcatgactaattttttgtattttaacagtaatggggtttcaccatgttacccagagtggtctcaaactcctgagttcaggcagtccacctgtgtcagcctcccaaagtgttaggattacagacatgagccattgcacccgacccatttccttttcattttaaaaatggattttcagggaaggccggtcatggtggctcacacctgtaatcctaacactttgggaggccaggggtttgaaaccagtctgagcaacatagggagaccccatctgtgcaaaacatcagaaaattagccaggtatggtggtgtgcacctgtggtgccagctactcgatggggtgagacaggaggatcatttgagccagcaggtcaaagttgcagtgagccgtgatcacgcaactgcactccagcctgagcaacaaagccagaccctgtctcaaaaccaagatgaaacattgtatattaagaactgactggtttaagaggatgcattttaactgagaaaaataatttcattggtataaatagctccatttcaagatgaccacaccacaaaaaaaggttactgatagataacaaagatccatattgttactctgctcagtagaaaggaatccatttgtactttctgtgaccctttggaggctttctacatcatagatagtgtcattagtatttaaccatgtctttgatgatgacaatcctgagtgaacccctattcattttgcgctgagttcttacatagtcttttcagtgattataactgtaccatggaggataggaaatctcactaacatttttattacttcctctgcaaaaattctgaactaaaatatagtcaacctcatctctggactaaactggaaaatgtaagagacaagttaagttgtacttatggaactgtaggctcattagagaaacctgtagcatcaatttgtgcccactttagaatagctttaatcctacaaatctacttaagaaaagtaaacccattgcaggggaatgctgtcagtttagatgttataataattcagtctgtcactcttagctccttagctcagttcagacagctatagtggggaagatgtctagactccctcccctacctctgccccaactctcaaataaaaatcctatatcctaaagaaccttgtagtttatttttaccaaacaagctagtctacctgcaaattaacagtaacagtgatatcaccaggtaattttaatattgtaaattaaagtgagtattctcttgaatgctatgatcttctcagtgggacatgtattttcacatgttttgtaatacatatgagtttaataaagctaatgccctcgcagattctctttgtgaccattagtaatcatttgtaaggtagctatcagaatatatttgtggccatgaaatagttttgcttcataggaaactattttttctatccaaaagtaaaacttatttttcattataaccttaccttttttaaaatgtttcattccttcctttcctgtttctgcctaaaggggttttatgggctaccggctgctaggtgataactcactggggccttcaagaggaaaaagtgcatacttttttctcaatttttttttctcttctaacaaacttctgttctacagtcacaatcaacaagagaaacaatcaacattttttggtcctttttcctgctgattaagtttgttgttgttgttgttgttgttgttgttgttttgagagagagtctcaccgtgtcgcccaggctggagtgcagtggcaccatctcggctcactgcaagctccgcctcccgggttcacgcctttctcctgcctcagcctccggagtagctgggactacaggcgcccgccaccacacccggctaatttttttgtatttttagtagagacggggtttcaccgtgttagccaggatgttttctaatggcccaagacagtaagaggtgctttgggtttgtaatttacaaaataagagaagtctgtgacaacttttttttttttttgagacagagtctcgctctgttgccaggctggagtgcaggggcgtgatctcagctcactgcaacctccgcctcctgggttcaagcaattcttctgcctcagcctcccgagtagctgggactacaggcatgcgccaccacgaccagctaatttttgtatttttagtagagacggggtttcaccatgttggccaggatggtcttgatcatttgacctcgtgatccgcccacctcagcctcccaaagtgctgggattacaggcgtgagccaccgcgcccggctgaagtaggtttttttattggcgaagtagctaattactgtataatttggggtgagtcttgagtgggaagaagcctcgtggcacataaaaaggtgcttaattgatattgaaaacacacgcacgcacacacatgcatgcacacacaaccctacctgctgatgtgccagagaattacaatactcctcctttgagacattgcttttagttaatttgttatatatccaaaggtccttgtgttaacatgcaaatagtttaaccaaggaccggtatcaatccaatagcaccacagtatgttaatttcttcaattaagttattccacaatgtatgcatatctcaaaacatcatggtatacaccatgcatatataaaatttttgccaattaaaaataaattttaaataaaatgtttatactataggtctataaaaaagtacaaattatttttccggtgaggtaatcactttatgacaaagactttataaatattcagtggcttagagaagtaaaatgacagcagaaagcactgctttactttttgcttcccaattttggactttgtttgaaagatttgccattcattaaataccccaagtatttactgagtatctactataagtgtaaggaaggcactattctaaaagtgacagagaatacaaagattaataagacataggctctgtcttcaatgagtttaccatctactagcagaggtaaggcaaatatttaaatatctatagcataagatggagagtgatagataccagaagacaaatataaacaaggtataacattactttagtgatggaagagattattcctgccagtagataaccatactgcaatttccaaacaacaagaaaaaaaaacaaggaggggccaagatgaccaactaaaaacagctacggttggaggctcccacgtagaagaatgaaaacagcgagtaaatcctatgccagcaacttgaggtatccaggttctctcactaggactgaccaggcagttggtgcaacccatggtaagtgaggaaaagcagagtggagtgacagccaacccaggatccacacaggggaaggggaactcccactcccagccaagggaggtagtgagtgattgtgctaccccgcctggggaaccatgctttttccatggatctgtgcaacccacagatcaggagattcccctcataagtccacaccacccaggccttggttcccaagcacagaactgtgcagattcttggcagccgctcaggtggagactgcctaagacaaccaagttcctaggggagggggcggctgccatcactgcagctgcctgctgccagagatgactgagctcccagtgggaggagtggctgccatcactgcaactgcctgctgccaagacaactgagctcctgcggggagagacggctgccatcactgcagctccagtctgccagtttagagaggaaaataaataacctgatggagctgaaaaacacaacacaagaacttcataatacaaccacaagtatcaatagctggatagaccaagggaaggaaggaatttcggagcttgaagactatcttgctgaaataagacaggcagacaagattagagaaaaaagaatgaaaaggaatgaacaaaacctctgagaactatgggattatgtaaaaagaccaaacctacaactgattggggtacctgaaagagatgggagaatggaaccaagttggaaaacgtacatcaggatatcatccagaacttccccaacctagcaagataggccaacattcaaattcaggaaatccagagaaccacagtaagatactccatgagaagaaaggtcatccccaagacacataatcatcagattctccaaagtaaaaatgaagggaaagtattaagggcagccagagaaaaaggccaggttacctataaagggaagcccatcagactaacagtggacctctcagcagaaaccctacaagccagaagagattgggggccaatattcagtatccttaaaagaaagaatttccaacccagaatttcataaccagccaaactaaacttcgtaaagtgaaggaaaaataaaatccttttcagaaaaacaaatactgagggaatttgtcaccaccaggcctgccttgcaggagctcctgagagaagcactaaatatggaaagaaaaaaccaatacctgccactacaaacacacactaaagtacacagaccaatgacgcttcgaagcaactacatcaacaagtctgcaaaataaccagctagcatcatgatgacaggatcaaattcacaaatatattaaccttaaatgtaaatgagctaaatgcctccagttgaaagacacagaatggcaagctggataaagagtcaagacccatcaatgtgctgtattaaagagacccatctcatgtgcaaagacacacataggctcaaaataaagagatggaggaaattttaccaagcaaatagcagagaaaaccaggggttgcaatcctagtgttaaagtcttacaaaacagacattaaaccaaaaaaaaaaaaagatcaaaaaagacaagggcattacataacggtaaagggctcaattcaacaagaagtgctaactatcctaaatatacaggaggacctagattcataaaacaagttcttagagacctacaaagagacttagactcccacacaataatagtgggaggctttaatactgcactgtcaatattagatcactgagacaaaaaattaacaaagatattcaggacccaaactcaactctggatcaagtggacctgacagatatctacagaactctccacccaaaaacaacagaatatatattcttctttgtgccatatggcacttactcctaaaaagattgcataattggaagtaaaacactcctaacaaatgccaaacaactgaaatcagaagaaacagtctctcagaccacagtgcaataaaattagaactcaaggttaagaaactcactcaaaaccacacaactacatggaaattaagcaacctgcccctgaatgactcctggataaataacgaaatcaaggcagaaatcaagaagttctttgaaaccaatgagaataaagagacatcatgccagaacctctgggacgcagccaaagcagcgttaagagggcaagttatagcactaaatgcccacatcagaaagttaaaagatctcaaattgacgtcctaatatcaaaattaaaagaactagagaaccaagagcaaaaaagaaaaaaaaaaggccaaagctagcagaagacaagaaataaccaagatcagagcagaactgaaggagatagagacacgaaaaaccttaaaaaaaatcaatgaatctaggagctggtttgttttttttttttttggaaaaaaaaattaataaaatagactactagctagactaataaggaaagagagaagaatcaaatagacacaataaaaaatgataaaggggatatcaccactgaccccacagaaatatgaacaaccatcagagaatactataaacacctctatgcaaataaactagaaaatctagaagaaatggataaattcctagacacacacaccctcgcaagacagaaccaggaagaagttgaatctctgaatagacaataacaagttctgaaattgaggcagtaattaatagcctaccaaccaaaaaaagcccaggaccagatggattcacagccgaattctacgagaggtacaaagaggagctggtaccatttcttctgaaactattctaaacaactgaaaaggagggactcctctctgactcattttatgaggccagcatcatcctgatatcaaaacctggcagagatacaacaaaaaaagaaaacttcaggccaatatccctgatgatcattgatgcaaaaattctcaataaaatactgacaaaccgaatccagcagcacatcaaaaagcttatccacatgatcaagacagcttcatccccaagatacaaggctggttcaacatatgcaaatcaataaacgagatttatcacataaacagaactaaacacaaaaaccgcatgattatctcaatagacacagaaaaggcctttgataaaattcaacttcccttcatgttaaaaactttcaataaactaggtattgttggaacatacctcaaaatataagagcaatttatgacaaacccacagccaatatcatactgaatgggaaaaagctcaaagcattccccttgaaaatcagcacaagacaaggatgccttctctcaccactcctattcaacatagaattggaaattctggccagggcaatcaggcaagagaaagaaataaagcatattcagataggaagagaggaagtcaagccatctgtttgcagatgacatactcctatatctgaaaaccccatcatctcagccccaaagcttcttaagctgataagcaccttcagcaaagtacaaaatcaatgtgcaaaaatcacaagcattcctatacaccagcagtagacaagcaggaagccaaatcatgaatgaattccctttcacagttgctaaaaagagaaaaaatacctaggaatacagctaacaagggaagtgaaggacctcttcaaggagaactacaaactgctgctcaaggaaatcagagagcacacaaacaaatggaaaaacattccacgctcatggatgggaagaatcaatatcatgaaaatggccatactgcccagagtaatttatagattcaatgctgttcccattaaactacccttgacatttttcacagaattagaaaaaaactactttaaagttcatatggaaccaaaaaagagcctatataatgaagacaatcctaagcaaaaagaacaaagctgaaggcatcacatatctgacttcaaactcaactacaaggctatagtaaccaaaatagatggtagtagtacaaaaacagacacatagaccagtggaacagaatatagaagtcaaaactaagactgcacatctacagccatgtgatcttcaacaaacctgacaaaagcaatggggaaaggatttgctatttaataaatggtgctgggagaactggctagccatatgcagaaaattgaaaccggaccctttccttataccttatacaaaagttaagtcaagatggattaaatatttaaatgtaaaacccaaaactgtaaaaatcctagaagaaaatctaggcaataccattcaggacatagatacggacaaagatttcgtgacaaaaacgtcaaaagcaattgcaacaaaagcaaaaattgacaaatgagatctaattaaagagcttctgcacagcaaaagaaactgtcatcagagtgaagagacaaactacagaatgggagaaaattattgcaatctatccctcagacaaaggtctaatatccagaatctacaagaaaaaaataaccccatttaaaagtgggcaaaggatatgtacagacacttctcaagagaagatatacatgcagccaacaaacatggaaaaaagctcaacatcactgatcattagagaaatgcaaatcaaaaacacaatgagataccatctcaggccagtcagaatggcaattattaaaaagtcaagaaacaacagatgctggcaaggctgtggagaaatgggaactcttttacactgttggtagttcaaccattgtggaagacagtgtggtgattcctcaaagacctagaactagatataccatttgatccagcaatcccattactgggtatatacccaaaggaatataaatcattcctttgtaaagatacatgcatgcgtatgctcattgcagcatttattcacaatagcaaagacgtggaatcaacccaaacgcctatcaatgatagactggataaagaaaatgtggtacctatgtgtccagaattggtgagttcttggtctcgctgacttcaagaatgaagccgcggaccctcgcagtgagtgttacagttcttaaagatggtgtgtccggagtttgttccttcagatgttcagatgtgtccagaatttcttccttctggtgggttcgtgatctcactgacttcaggagtgaagctgcagaccttcacagtgagtgtcacagctcttaaaggtggcacggctggagttgttcattccttccagtgggttcgtggtcttgctggcttcaggagtgaagctgcagaccttcaccgtgagtgttacagctcttaaaggcagcacggacccaaagagtgagcagcagcaagatttattgtgaagagtgaaagaacaaagcttccacagcatggagggggaccccagcaggttgctgctgctggcttgggcagcctgcttttattcccttatctgacctcacccacatcctgccaattggcccattttacagagagctgattggtccgttttcacaggttgctgattggtgcgtttacaaaccttgagctagacacagagtgctgattggtgcatttacaatcctttagctagacacaaaagttctccaagtccccactagattagctagacacagagcactgattggtgcatttacaaaccttgagcaagacgcagagcactgattggtgcatttataaaccttgagctagacacagagtgctgattggtgtgtttataatcctttagctagacacagagtgctgattggtggatgtacaatccgctagctagacataaaagttctctaagtccccaccagattagctagatacagagcgctgattggtgcatccacaaacccgagctagacacagagtgctgattggtgcatatacaatcctccagctagacataaaagttctccaagtccccaccagactcaggagcccagctggcttcacctagtggatcacacgccagggccgtgggtggagctgcccaccagacccacaccacgtgcccacactcagcccttgggcagtccatgggactgggcgctgtggagcagggggtggcacctgtcgtggcaggagcccacagtgggggtgggggggggtcactcaggcatggcgggctgcaggtcctgagccctgccccgcaaggaggcggctgaggcccagcgagaattcgagcgggcgctcgcgggtcggcaatgctgggagacccagcacaccctccgcagctgctggcctgggggctaagcccctcactgcagggcccgccgtacccacgcccacccagaactcgtgctggcccgcaagtgccacccacagccccagttcccacccacgcctctccctccacacctccctgcaagcagagggagccggctctggcctcggccagcccagagaggggttcccacagtgcagcggcaggctgaagggcttaagtgcagccagagtggacgtgaggccaaggaggtgccaagagtgagtgggggctgctagcatattgtcacctctcacctatacaccatggaatgctatgcagccgtaaaaaggaatgagatcatgtcctttgcagggacagggagggagctggaagccattatcctcagtaaactaacacaggaacagaaaaccaaacactgcatgttctcacttaaagtgggagttgaacaacaagaacacatgggcacatgggtggggggggcaacagcacacactgggtcctgtcagagggttgcagggaaggagagcatcagaaagaatagctgggcctaatacctaggtaatggattgatccgtgcagcaaaccaccatggcacaagtttacctatgtaacaaacctgcacatcctgcacatgtatcctggaacagtaaataaaataagtaaaataaaaaaataaaacttaacagaaccatcaggtggtttactaccctctttttctttctccttcttttcttgcttccttccttccttcctctttctctttcttgttctctttctctttctttcattttcttacctttctgctggactgttacattcttcatggcaggatatattttactgtcagtatcccaagtccctaactgtttctggttcataaaatgcagtcagtaaatatttgttgaatgggtatgtgtatcactgatcatcaaacttgctgtttaataagaaaatgcctattacaaagcatattcaacagataaaacctatgtaactaaaaagtagaattttcttctcagaaactaaacatatttttaaaagaaacttttgtaagattatatccagtttgcaccataaagtgcagcctatcacaaaaaaaaactgtctgatctgagacctataaagctgaataagaagcagaagcagcaatatcattctgcctagttacactggttgtgaatgatttttttatatttgaatgagtaggtcaagacctcaatgaaaatgagttataaataagtttatatttcaatccttttttaagtgttcacccacaatttgaatagaaaattctgtctagcaataaataatctctaaggtttttcaaactttgaaaattttgcgattttgattgaccatgagaagaaatcacatattaatagtataagcaactttgtatatatttttcttaggtgcctatgacaatgtcattagtcttagaatgaaaaccctttggggtagtgcctttaagtcagttcattgaacatgtctggagcagccactgggttttgacacatgatgtaacattgctaacttgatttaatgttccaccagagcaggctgtattttggaggcaggagaaacagtttcttacctgctaatcttcatctggggacatttgaaattgggagttgtgatattataagtcattgccactttttaatcagtgttacagcatcatattcttagttaattatcttactgtttaggtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattacagttatcatcattctttttttttcttatttctactcaataagaaaaaggctaagggttcagccttaacagtatacagagtaaaatccatgaaactgccttttcattaaaaaaaggaaaaaaaaaaaaaaaggaagaaaatcagctgtgtttctgctgtccatgaaaataccaatactgcaaactaaagaaagggttctcagcactgagtgaggaaagtagttaactctgagtctgtatgatgtcctttctgtcagaaatgggagacaactaatatgtcttgtaatcatctttttctgtttggaaaacctgtatttaaatgtaaaaatgtaaaaaaaaatattaatttatccatggatactaagacaacggaaaggtagcattccccagtattttgtttttaattaacaacttccatttctaaaaattcagcataggagttgtatttaggcatccagttccaggagaccaggctcctgaggagaacttccagccaataaagcttgtggtttctccccaacaccaaaaagagaagttgtatttagtgcaatttgaataaaatatagtttcttaatttgttatgcagaaacaacacaacagaattaattttataaataaaaaactttatagaatcataaaatattcaaactacaatgaacagtagagagcacaaacaccctaatttttttgtcaaggaaactcaaactcagaatagcagaaaatgaataggattaaggtctcaagatttacattcttccttttactacataattgtgctcttcttcaaccattaaattataaaaaataatggcagctaacttactggtgccagattttagctctttcgtctgtgtccccacttagacaaggattgttattatacagtttgcccttatcctacgtctttggttcacattcttttagatatgcatatcattaggcttaaatcgtttgtttttcttttactcctcaataaaggaaagattagaaaactcactagagtaggggattagtcaggaattaactatgtgatttcagaacaattttaatggaatagttttgtttattattaaaggtagaatgttgagatatttattggtatcagtagaaaccaagacattttcagaaaatatgaatgtaaacttaagttataaaaaaattaataatactttacctgttataaaaataaataaaccatccctggttttttcttttttataatttcagaggagtttcccttaacatcagtccttagaaaaatctcaccatgtattccaggtcacatttaaagagacattctaatttaaaaaaaaaaaaaaaagagttggaaattgccatttcatttttcctccagagaaaaatgctgtcatatgtattctcttttcccttcatgtgcttgtttcccattcatttgttcatcaaatcagttgtcacttgtacttgagcagactcttcatagatggataactttttgtcaagtgtttccacctatgatgatgaaaaataataatgaggttcacattaaacctttgaattggatcaaactcaattttttgtgcaaatgggtattgtaattagaccccctaggcactttgattaggtgtttagaaaccatcatacatagaaacttaatttactttgttcaacaaatatttaataaacatcaagtaaatgtcagatactatgttaagtcctgtatttgcaaagatgaataaaaataaaactcctgccccatggatttcataggctagtgcagaagagatgggtaaattaatgtggtacttgtctcctttaattggctcctttacaggcttgccttcctttgtcaattccttgaaaagctttctttacagttttttttctttggctcttttcacatcttgtccattgacttcagatggcctcatgcaggctagtagtttcagataccatttataaagtgaattgtaagtctataccattgcccagagcttgtccaagctccaaactcatattctaaatgtattatgtatctgctgccagtaaatataacatgacaaatactaaacttattttgtcgacaatacttgtttttctacatcctcttaaaactgtcccttgttctacattccctctgttactgttttagtttaggtgttttttttcttttttttatttttctgagatggagttttgctcttgttgcccagtctggagtgcaatggcacgatctcggttcacggcaacctccacttcccaggttcaagtgattctcctgcctcagcctcctgagtacctgggattacaggcatgcaccactatgcccagctaattttgtatttttagtagagatggggtttctccatgttggtcaggctggtctcgaactcccagtctcaggtgatccacccacctcgacctctcaaagtgctcacaggagtgagccaatgcgcctggcccagtttaggtctttattattaacttcctggacaattgttataggctcccctccccccagttaacatcttcccaatccgttctccaatttgatgccaaagtaatctgttcaaatttgctaattcgttattaacactccctacacgcaactcttcagcagttttttcataacctcaagataaaattcaaactccttaacatgtcatgaaaggccctttataatctgatttcttctaatatttttgtttcttctcttacctccttatcatcagaccttgcttctccctaaacctgacatgatgattcttacttcttattctctcttacctctaaggctttatttatatatcctttttttttaagagactaggtctcactatgtttcccaggctggccctcaactctcagcctcaagcgatcctctcgccttagcctcccaaagtactagtattacaggcataagccaccatgcctggcccctttgcttatatagtttttgcttggaaaaactttatcttacttctctacatattaactactgcctaactaccacatattctttaagatcaagcttaagatgcttctcctttatgaagaagtctttcctgatgtctgcttccccctttccctagctgagttaaacactcttcattcgtgttcccatagcaccttcttcatatgttttgtaagacaactgactgaaatatttgttcactattaattttaaatgccctaataaataacatggatataaaaaaaaagcagagttctgtaagtgtgaatcactgtaaattgaattgtcataagtaaaataaagcctagaaaaaaaggtagaagttcattctcactacactttagaatattttctttaccaagtgtatttgcgttttaatgagcaaacctttatagtttgttttgatttcagctagatgtacctctaaactatttaatatcattcattaatcactgagtaggaaaaagtatttgggggaaccaaaaggccttcacattctatgaaattacaaatactttgcctctgcaaacactctaacacctgcaatcacagaagcccttagaggaaagccagtgttttgtaaggaaaatctaggaccaactgaatccatgcatttgaagctgtgacatctctaaaatgatttttatatgtctaagaaggttcaataataatcccagaaaactaaggacttaacatgtagagaaaatgctgaaagtgattgttgtgaaggtcatagacacagggaactctatgaaggaatttcagagtgtatagtacatgaaacactttagatataatagtaagactaagagggtaacttgagatcaaatgagcattttttcttgtgtctgttggctgcataaatgtcttcttttgagaagtgtctgttcatatcctttgcccactttttgatgggttgtttggtttttttcttgtaaatttgtttaagttcttttagtagattctggatattagccctttgtcagatgggcagattgcaaaaattttctcccattctgtaggttgcctattcactctgatggtagtttcttttaccgtgcagaaagttctttagtttaattagatcccattcatcaattttgcttttgttgccattgctttttgtgctttagtcatgaagtccttgcccatgcctatgtcctgaatggtattgcctaggttttcttctaggatttttatggttttaggtctaacatttaagtctttaatccatcttgaattaatttttgtataaggtataaggaagatccagtttcagctttccagtttcagctttctacatatgcctagccagttttcccagcaccatttattaaatagggaatcctttcccatttcttgtttttgtcaggattgtcaaagatcagatggttgtagatgggtggtgttatttctgaggcctctgttctgttccattggtctatatatctgttttggtactagtaccatgctgttttggttactgtagccttgtagtgtagtttgaagtctggtagtgtgatgcttccagctttgttatttttgcttaggattgtcttggcaatgagagctcttttttggttccatgtgagctttaaagtagccttttccaattctgtgaagaaagtcattggtagcttgatggggttggcattgaatctataaattaccttgggcagtatggccattttcatgatattgattcttctatccatgagcatggaatgttcttccatttgtttgtgtcctcttttatttcattgagcagtaatttgtagttctccttgaagaggtccttcacatcccttgtaaattggattcctaggtattttattctctttgtatcaattgtgaatgggagttcactcgtgatttggctctccatgtgtctgttattggtgtataggaatgcttgtgatttttgcaggttgattttgtatcttgagactttgctgaagttgcttatcagcttaaggagattttgggctgagacgatggagttttctaaatagacaatcatgtcatctgcaaacagagacaatttgacttcctcttttcctaattgaataccttttatttctttcttttgcctgattgtccctggccagaacttccaacaccatgttgaataggagtggtgagagaagacatccttgtgttgtgctggttttcaaagggaatgcttccagtttttgcccattcagtatgatattggctgtgggtttgtcataaatagctcttattattttgagatgcattccatcaatacctagtttattgagagtttttagcatgaagggctgttgagttttgtcgaaggccttttctgcatctattgagataatcatgtggtttttgtcattggtttggtttatgtgatggattacgtttattgatttgcattttttgaaccagcctttcatctcagggatgaagccgacttgatcgtggtggataagcttttcgatgggctgccggattcggtttgccagtattttattgaggatttttgcatcgatgttcttcagggatattggtctaaaattctctttttttgttgtgtctctgccaggttttggtatcaagatgatgctagcctcataaaatgagttagggaggattccctctttttctattgattggaatagtttcagaaggaatgataccaactcctctttgtacctctcgtagaatttggctgtgaatccatctggtcctggactttttttggttggtaggctattaattattgcctcaatttcagagcccattattggtctattcagagattcaacttcttcctgctttagtcttgggagggtgtatgtgtccaggaatttatccatttcttctagattttttagtttatttgcatagaggtgtttatggtattctctgatggtaatttgtatttctgtgggatcagtggtgatatcccctttatcattttttattgcatctatttggttcttatctcttttcttctttattagtcatgctagcggtctatcaattttgtcgatcctttcaaaaaccagctcctggattcattgattttttgaagggtttttcgtgtctctgtctccttcagttctgctctgatcttagttatttcttgccttctgctagcttttgaatgtgtttgctcttgcttctctagttcttttaattatgatgttagggtgtcaattttagatctttcctgctttctcttgtgggcatttagtgctataagtttccctctacacactgctttaaatgtgtcccagagattctggtacatcatgtcttcgttctcattggtttcaaagaacatctttatttctgccttcatttcattatgtacccagtagtcattcaggagcaggttgttcagtttccatgtgcttgtgcggttttgagtgagtttcttaatcctgagttctaatttgattgcactgtggtctgagagacagtatgttgtgatttctgttcttttacatttgctgaggagtgctttacttccaattatgttgtcaattttagaatacgtgcaatgtggtgctgagaagactgtatattctgttgatttggggtggagaactctgtagatgtctattaggtctgcttggtccagagctgagtttgagtcctggatatccttgttaaccttctgtctcgttgatctaatattgacagtggggtgttaaagtctcccattattattgtgtgggagtcgaagtctctttgtaggtctctaaggacttgctttacgaatctgggtgctcctgtcttgggtgcatatatatttagaatagttagctcttcctgctgcattgatccctttaccattatataatggccttctttgtctcttttgatctttgttggtttaaagtctgttttatgagagattaggatggcaacccctgcttttttttttttttttgctttccatttgattgttagatcttcctccatccctttattttgagcctatgtgtgtctttgcacagagatgggtctcctgaatacagcacattgatggggcttgactctttatccaatttgccagtctgtgtcttttaattggggcatttagcctatttacatttaaggtccatattgttaggtgtagatttgatcctgtcattatgatgttacctggttattttacctgttaattgatgcagtttcttcatagcattgatgttctttacaatttggcaggtttttgcagtggctggtaccagttgttcctttccatgtttagtgcttcctttaggaactcttgtaacacaggcctggtggtgacaaaatctctgagcatttgcttgtctgtaaaggactttatttctccttcatttatgttggctggatatgaaattctgggttgaaaattcttttctttaagaatgttgaatattggcccccactctcttctggattgcagggtttctgcagagagatccgcagttagtctgatgggcttccctttgtgggtaacctgacctttctctctggctgcccttaacattttttccttcatttcaaccttggtgaaattgacaattatgtgtcttggggttgtttttctcgaggagtatctttgtggtgttctctgtattccctgaaattgaatgctggcctgccttgctaagttgggaaagttctccttgataatgtcctaaagagtgtttttcaacctggttccattctccctatcactttgaagtacaacaatcaaatgtagaatttgtcttttcacatagtcccatatttcttggaggctttgttcgtttctttttactcttttttttctaaacttgccttctcactttatttcattaatttgatcttcaatcactgatatcctttcttccatttgatcaaatttgctattgaagctagtgcatgcctcccgaagttctcgtgccttggttttcagctacatcaggtcacttaaggtcttctctacactgtttattctcattagccattcgtctaaccttttttcaaggtttttagcttccttgtgatgggttagaacatgctcctttagctcggagaagtttgttattacggaccttctgaagcctacttctgtcaacttgtcaaagacattctccatctagctttgttccattgctggtgaggagctgcgatcctttggaggagaaaaggcgctctggtttttagaattttcagcttttctgctctggattctcaccatctttgtggttttatctacctttggtctttgacgttggtgacctacagatggggttttggtgtggatgtcctttttgttgatggtgatgctattcctttctgtttgttagttttccttccaggagtcaggtcgctcagctgcagatctgttggagtttgctggaggtccactccagacactgtttccttgggtatcaccagcagaggctgcagaacagcaaatattgcataacagcaaatattgctgcctgatgcttcctctggaagcttcatcccagagggacacctgcctgtatgaggtgtctgctggcccctactaggagatgtctttcagttaggctacacaggggtcagggactcacttgatgatgcagtctgtccattctcagagctcaaacgacgtgctggtagaaccactgctctcttcagagctgtcagacagggacgtttaagtctgcagaattttctcctgccttttgttcagctatgccctgcccacaaaggtggagtctgtagaggcagtaggccttgctgagctgtggtgagctccgcccagttcaagcttcctggccactttgtttacctactcaagcctcagcaatggtggatgcccctccccccgccaggctgcagcctggcaggttgatctcagactgctgtgctagcagtgagcaaggctccatgggtttgggacctgccaagccaggcatgggagagaatctcctggtctgccagttgctaagactgtgggaaaagcacaggatttgggcaggaatgccccgtttttcgaggtacaatctgtcacggcttcccttggctaggaaagggaaatcccccaaccccttgcacttcctgggtgaggtgacgccccgccctgcttcgactcgccctccatgggctgcacccactgtccaacccatcccaatgagatgaactgggtacctcagttggaaatgcagaaatcacctgtcttctgcgtcggtcatgctgggagctgcagaatggagctgttcctattcggccatcttggaacagagtcccagtgatattcttaaagttagacaaatagttatggttacaacaactggaacccgggatccttaactcccagtctggtgttcatttcactatagcatactgcatctcaaatcaatgtaaacattattcttataaagcaagtgcctagacgtgtttgcatgtataaagtgttttctgtttttctattttgactaccgatgaattttctattttctctggtctgtcttttagcctattactattttcagctcctatctgcaagtgaggattttaaggaacaagtattccactgataggcattcctggcataactatggatgataacatttgtaagactaacatttatgattcattttctttatttgtaaaatgcatgacatgaataaattacaacttcacacttggtacagtatcaacttctgtaaggcagattaaaatattctggcaccattccctgaaattcccaatctttttctatatacaatggaaaaactatgagcttttttttaatagaaaggattttgctttcttgggaattttatgttagattataagctgtaagcttttttatttaagattacatgattaaagacttcagtgtctctgacctaggttctctgcttttccactttagcagttctagtcaaggaaactttaagttttgctgttggaagtaagtttggagcagtgaaatatctcttttagaatactgaccacagcacaaaggcacatgttcccgtctctgacttctagctagttagctgcctgagcataggcagttatcttaagctgagattggcttccctttagaagaaattctgaagctcttgattccaagcagtaggaagtcctcaccaaggtcatactgggagttcattaactcttcctgatggttcaggggctgttagagaataagggaaaaggaaataaggtatacttagaagtagctttgtcaagacactctttggctcttttacttgctctaccttttactagccaaatgaccctggacaagctacttaacctttctaggtcttatctccctcctatgcaaaatggaaataatgtctacccaatgtagggttattgtaggatactattaaaggagataatattgtgtaaataattttattttcgctaacatgctctatttggaattcagcaactgcttccctttcctctactctcctaacatggggattctaagatcataaccctgagataagcacttgtaaattacagagtatttacagtatgaccttggtgaggacttcctactgcttggaatcaagagcttcagaatttcttctaaagggaagccaatctcagcttaagataactgcctatgctcaggcagctaactagctggaagtcagagacgggaacatgtgcctatgtgccgtggtcagtattctaaaagagatacttcactgctacaaacttagttccaacagcaaaacttaaaggttccttgactagaactgctaaagtggaaaaacaaagaacctaggtcaaagacactgaagtctttaatcatgtaatcttaaataaaaaagcttacagcttataatctaaaataaaattcccaagacagcaaaagctaaaattggctcaactccatttgttggcctgcatctggatcctgtatgcattttgatgtaatcaaattttaattccacccacccaggtcattcaggaatatatctctgtctcattagaaaatttaattaagcagcagtttttattttattttttatttttgctcttctctgattgagctgtacaaaattgaagcaaagaattgagatacctattcaaatatttcaagtgaaagcatatatttttattatccaaatcactgccttaagtttctaccttcagtctagtaaggtcttcacttagaatgattctacttgcaaagggatgttggtctgtgctggcatttgctgtctattttttaatttttccatgaatgtggcctcttaaactcattcataattcccttcaggtattcatatctctttagactcatcattccatgaacttcattacactgctaaaatatgcacatctcattatatccttctacttctgcatcttattatatcattacctttatactccctgcattcttcaaaatgtatatcttaatccctcaatatatttttgtgacatatatgtgtgtatatatatgtttgtgtgtgtgtgtatatatatatacattttaaatatttttatatatatatatatacacacatatatatataaaatcacaacttgtaactaatcatggtatcttcatattcaaaaattatattaccggccgggcgcggtggctcacgcctgtaatcccagcacttcaggaggccgaggtgggcgggtcacaaggtcaggagttcgaggccagcctggccaatatggtgaaaccgcgtctctactaaaaatacaaaaattagctgggtgtggtggtgcacacctgtaatcccagctactggggaggctgaggcagaagaattgtttgaacccgggaggtggaggttgtagtgagctgagatcgtgccattgtactctagcctagtgacagagtgagacttcatctcaaaaaaaaaaaaaaaaaaaaaatatatatatatatccaatcagcattctgtatatgtgctttcaggtgctttttcccccagtactgtgggtcccacttgtgtgcttttaccaccgtacttattaagccttcttgtttaggggggttatttttatagctatgtaattgaataaaattacctattcacacagaaatcaggcctataccatcagagaaatgcaaatcaaaactacaatgagacaccatctcacaccagttagaatgccagtcattaaaaagtcaggaaacaacaggtgctggagaggatgtgaagaaataggaacacttttacactgttggtgggactgtaaactagttcaaccattgtggaagatagtgtggcaattcctcaaggatctagaactagaaataccatttgacccagccatcccattactgggcatatacccaaaggattataaatgatgctgctataaagactcatgcacacgtatgttgattgcagcactattcacaatagcaaagacttggaaccaacccaaatgtccatcaatgatagactggattaagaaaatgtgacacatatacaccatgaaatactatgcagccataaaaaatgatgagttcatgttctttgtagggacatgaatgaagctggaaaccatcattctgagcaaactatcgcaaggacagaaaaccaaacaccgcatgttctcactcataggtgggaattgaacaatgagaacacttggacacaggaaggggaatatcacacactggggcctgttatgggatggggggagtggggagggataacattaggagatatacctaatgtaaatgacgagttaatgggtgcagcacaccaacatggcacatgtatacatacataccaaacctgcacgtggtgcacatgtaccctggaacttaaagtataataataaaaaatttaaatttaaatttaaaaaaaaatcaggcctataaccttggcctaaattgccctatgtcgcaatcaggtagactgatcttcctttttcacacttccttctatgcataccattatatatgttcctatacatattcactcttaaaaaaaataaagtatattataaataaaaagtaaagtaggaaaatgaaatagaaaattgaaaaaagcacattacaaatatatctctttaagcaattttagtagaaaacaatacttaatccaaaaaggaagggggggttaatttttcaataggatttttaaagttaatttacacagcttttattgactatacttgtggttaaaataaggtacagtctttagatatgattcttaatatttccattatttataggtacctcattatgttttcacattttctatatacatgtcttatttgctgtagtttatcttgcaatttttaaattctgtatctattttgaagttccttagtctatagaattacatgaggattcagaatgtatgcagtggaaaaaaatgttttaagttaaaatggaaaaaaatagaaattttctcagaagtaatggcataaaaataccttattccagtaaagaaggatctccaatatttttagaaattacaactcatccctgtctattcctaatgttttattggtggaattatgaaaattagtgaaaattaaaagagaaaaccttaggtgacagtaaaggatttgccagtaccagcagggttatttttttaagtttgagtgattcactttctcattagagcacctagtgctgcaagaattacctttttgactgttttctcaagtaaagactttgcaactcctaggagaccattagctcatcccaagcagcagagggtaagtatcagggaaacccagttcttccttttatttaattgtgagacaaaagcataagaagaaaatcagagacacaaagattctaatcaacaatactctttcttatgtgtctgaatgtgtataagaatgtaacttagttgcaataatctttaatactttaactcaattttccaaaaatggaatttattgactattttctaaaatctcgttttcagtttctataaactcctcttctgcagaatcccagtctccttggttaacttcctaaaaaaaaaaaaaatacaaaccattaatgtcttatcatttggatataacagtgaatgatttggtaatactgttgcaaccctgtgactataatgccttgctaatttccttactttcattctagcaatatggaaataagccaccagtatttcttcaaagtcagtatcatagttggcatattggtatgtatttcttcttacatcccatctaggagctttgtttcatcatgcattttattttattttttattttataaaatatttcctgcatataaactttgtttttttaattaatggccacagtaatattctaacacaggaccactctttgtgggaaaaaacttaacagttatttttagaatactaagatccagggttcaaaaagaaaagtacatggttcaaaattataggacagtgactgagaaattaccattaaagaagaatttaaattattcagactacagagtgaacattttctttctttctttgcacaaaatcctgaccaacaaattcacccattggacgtaagtgctacccatttatcagtgatatcctactcatttgaccagggtgtggcaaggttttcatcattaagtactgaaaaaagtaggcatttgctctcaattgaagcattttctgtgacctcaaggacattttagatatttttaaaaattattcttcctaaaaacgtacccctttcatgttaattaagttaaatgctttttatatttacacagttattttaaaagtttaatgttttatacatagaaatgaatatatgtaacacagatggaagttgtagtgataaaataaacatgaaacaccaacccaacttaataactaattcattaccaattctgttgcatctttttgtaccactaaatcatggcttaatcatttctggtaatcataacatttgtatttattccaaactctataaccttacataaagcttattttattttatgacataagaactgtaattgccagataatgagcatctttagatggaaaaaagtgcacaacacaatagcactttgagaaagctatgtattttataagcataggaattttattattccattaacacaacttctggagtaactagattaatgaatgtactggttttcaacaaaggagatcttaaccctaaatgattcaatctttttcactctacgaatatataaagcctgtaatacataagcaagacctgcagtacaccaaagttttgtctagttggtctttcaaataaagaggtgaggaataaattatactggaatagacttgagggcatccaccatgttaaatgtttattttagtatctcataaatagccgtgaaactttccttatgaatgttatacatgcatacctcactttattgactttgcagatattccttttttttttttttaacaaattgaaggtttgtggcagtcctacattgagcaagtctcttggcaccatttttccaacagcatgtgttcctttatgtctctgtgtcacattatggtaattctcacaataattcatactttgttatttttatatctcttacagtgatctgtagtcagtgatctttgtttttactactgttattatttgggggcaccacaaattgcacccattataagatggcagacttaatcgataaacctgtgaattctgactgttttgccaattggctgttcccttttctccctctccttgggcctccctattctctgagacacagcaagattgaaagtaggccatttaataactctacaatggcctctaagtattcaagtgaaaggaaaaattacatgtctctcattttaaatcaaaagctggaaatgattaagcttagtgaggaaggcatgtcaaaagccaagagagccagaaacctaggccgctggtgctacagccaagttgtgaatgcaaaggaaaagttctttaaggaaattaaaagtgcagtagaccaacattcccttaagccaaagcgtaatccagagcaaggccctaactcttttcaattctgtgaaggttgagagaggtgaaaaaggtatagaagaaaagtttgaagccagcagaggttggcttatgagctttaaggacagaatacatctccataatataacaatgcaaggtgaagcagcaaatactgatgtagaagcaacagcaagttatccagaagatctatctaagatcattgatgaaggtgactatgctaagcaacaggttttcaatgtagatgaaacagtcttatatataggaagaagatgccttctaggactttcattgctatagaggaaaaattaattcctgtcttcaaagctttataggacaggctgattctcctgataggggctaaagtagctggtgactttaagttgaagccaatactcattggccattctaaaaatcctagtagctttaagaattatgctaaatcttccctccctgtgctctataaatgacaaagcttggatgatagtacatctttttgcaggttggtttactgattatgttaagtcttttcttgagacctcttattcagacaaaaagatttctttcaaaatataactattattgatattgcatctagtcatccaagagctctgattgggatgtacaagattaatgttgttttcatgcatgctaatacaacatcccctctgtagtccatagatcaaggagtaatttcaatattcaagtgttattatttaagacatacattttataaggctatacttgccatagatagtgattcctatagtggatctgagcaaagtaaattgaaaactttctggaaaggattcaccattctagatgtcattaagagcatttatgattcacgggaggaggtcaaatatcaacattgacaggagttgaaaagaagttgattccaaccttcatggatgactttaagtagttcactgcttcagtggaagaagtaactacgatgtcgtcaaaatagcaaggggactagaattagagatgaaacctgaagatgtgactgaattgctgcaatctcatgatgaaacttgaacagataaggagttacttcctatggatgagtaaagaaaggggcttcttaagatggaatctactgataaaaatgctgtagacattgttgaaatgatgacaaccaaggatttagaatattacataaacttagttggtaaagtagtgacaggatttaagaggattgactccaattttcaaagaagttctactgtggattaaatgctgtccaacagcattgcatgctacagagatatctttcatgaaggaaagagtcaatcagtatagcaaacttcattattgtcttattttaagaaattgccacagccaccccagccacaagcaactaccacccagatcagtcagcagccatcaacatggaggcaagaccctccaccagcaaaaacgttacaactcgctgaagactcagataattgttagcattttttagcaataaagtattttttaaattaaggtatgtacattgttattttcacataatactatttcacacttaatagactacagaatagcgtaaacataactcttacatgcactggctaaccagaaaattggtgtaaatcactgtactgcaatactcagtttattgcggtagtcttgaactaaccctgcaatatctctaaagtatccctgtaattcactttaaagtttttttaatgatgtagagactcaaatctgtacatgcttcacctttcatagtaaccctcttaatccttagccttagttaatattgttcctactgatggtcattttagcagagtaaatatatgttttgacattgccttttcagctcttttggtaagcgcagtgaatagttgttatgtgaaaaaagatcttacagtaacctctcacatagattatgtataatggtggcttttaaatgttgcagcatcaatgccgttacaatgggcatgagtaaacttttgaagaatttataatcaatagcagatggatttatgtccacattttatatttgaaaggcttaggtagtatgttttcctttcagcattctattacctaccacactctttctccactctcgattcatataaatgataaatcttggttagccaaagtgatgacaaggaatcaatttcctggaccactgaacttagagctctcccttaactttctaaaaagcctcttagagctaactacacagggaactttataactgtgggattattttgataagtgactttgagaaattagaatgcttttcactcttatatccaaaagcctttcagttcttctaacatcttaacttggacagcaagaagaaagtatagacagtcactgacttgtgataatttgacttgtgggttttgttttgttttgttttgttttgttttttacttacaattatgtaaaaccatcacaatttcaacatacttcaaattttgcattttgatatttttgtggtctgttgatatgtagtacctgagatattcaacactttgttataaaataggctttgtgttagatgattctgcccaactgtatgttaatgtaagcatcccgagcacatgtaaggttaggcaaggctaggctctgatgttcactctcttagctctatttgaatgcatttttgacttgccacatgttttcaacttaaaatgcgtttatcaggatgtaacctcattgtaaatcaagaaacatctgtattatctgtgtcagaataaatgcccaaccaaacaaattaactattaattttcccctttagagaatatatttgagctcaatgctcacaaatcatacttaattttagacatagttccctgtctttatttttcttgtgtgtatgtccattgtcagccatttgaatcgataaagactttttctaaagataccttaggccagtcatctcagttttaaaaagccagtactccagctagtggggaattcattaatcactgttatcatatggaaaactgaattttatatgtgtactactaacaacataaaaagactaccctttttgatccaaccagactgccactgttatcttgcagcacaagtaagcatggcacacaaaacaatgtatcagccagtctttttccactctttcttcttgtctaccgcctgagatcacttaattgtatatgtggcccagggtgcccagtgttacatagccttgcctttaagatttctgacactctgtagaatccgtaaatatgcatgtgtgtttatggtcttcatcttcatcaaattgaagacattattttacagaatttatgcaatacaatatgtggaagaaagtagaacagaataaacattgtctagtcagaccatgaaagcaggaccatagcttcttggcacacagcctaaccttcagcaaaatgaaatgctcacagcagtctgtgaaaagctgcaaattcccgacatcaaatgttcctaagcaagcatattagttatattaatcgcctattgggaaagccatcttttgcttattataaatggggctcttcctggaatggggcaactggtaaaaggaaattttgcttatgtttttctgaaattacatttttcagtaagccctttggctcccactgcttcagctgctcactgctgtttctctaccaaatgctaaacttaaaacagtcataatatccaggtgagaagttactgctccccggttcccatttaagtttgaagccttaggatacctttctaaaatcacaagcacaagttttatccaacactactgcttagcttctacctatgggcaaagggaagggatggtttcacatctgtgtaagtatctgtacgaatgcaagagagacagtcccatgtggttaagtaatttgcagtactattatattctctttacattccaaatggatcatttggcttgacattgaatgaagtctaatactgactggttggaaaagctagaaaattgtttagtcctaaactttaatgagagatacggatatagcagcttgcagagaggtatatctggcatttattccttcaagattccttttgtatctgctgccgactgggagcccttaccattttccacttgattgcctatttctctccatatttttttcccttcccttaagctctcagaccaaaacttgaggtcatgcatgcttttctctttgaggagacttaaatctttgctgacaagttgactttataccaactccaaaatcaggactaatccactagggatctaatttaccttaaatatagcaaccactatatatagcgtgagttcaaaataaaaagctggttggttatatatattgtaaattttatattaataatattaacaaaagaccagatggtatatgtgtgctataaatatgactttcctaaatatcacatatagaaatgaaatatgcttctttaaaacaactcttgtacttgcctttaaaaaaaattatcaagataaaattcaaagtattcagtgtttttagtatattcagacatgtgtagccatcaccacaattttagaagatataattcatatgctatacaattcaaagtattcagtgtttttagtatactcagacgtgtagccatcaccacaattttagaacattttcattaattcaaaaagaatgcctgtcccttttagcaatcatcctcctatcccctcatcttcacatctagccctaaataaaccactagtctacttcctgtttctataaatttgcctatttgggacatttcatataagtaggatcatataatacatggtcttttgtaactggctttttccacttagcttaatattttcaagattcatccatgttacagcatgtatcagtaattcattcctttgttgtggtggtaaaaacacaacacaaaatttatcatcttaaccatttttaagttcagcagtgttaagtatattcatatttttgtgagacagatcttcagaattgtttcaattcgcaaattcaaaactctctatccattaaataactcttacacctccctctagcgtctgataactatcattctacttttttctattaatttgactactttaattgtttattcattcacctattaatgaacatttgagttgcttccacctcttgactattgtgaatatagtttctatgaccatattcaagaccttgcttttaattcttttgaatacatacccagaagtggggttgttggatcatatgatagttctatttttaattttttgaggaacttccatactattttacaagtggttacaccattttataaccccaccagctgtgcacaagggtttcagtttccttattcatgccaaaacttttctgggttttttgatggtagctatcctaataagtaaggtgatgttctcattgtgattttgactttcatttttctgacaattactgataatgagcatctttttatattctcattggctatttgtatagcatctttgggaaaatgtgtattcaagtctttttttcattttaaattcatgtgattttttgttgttgagttgtaagagctctttatgtattctggatattaactcttactagatatatgatttgcaattattttctctcatttcataggttgcctttttactctgttgattgcattctttgatgcacaaaatatttctgttagatgtagtcccatttgtctattttgctttagttgcctatgtttttggtgtcatatcccaaaaaaaaatcattgccacattgaatgtcatgaactacttcctgttttcttctagttttatagttttaggtcttacatttaggtctttaatgcaggttgagttaattttctttgttgttgtttttttcactgtcttcttcttattattaatttccataggttattagggaacaggtggtgtttgtttacatgagtaagttctttagtggtgatttgtgagattctggtgcacccatcacccaagctgtatacactgtacccaatttgtattcttttatccctcacctgcctccgaccctttcccccaagtccccaaagtccgctgtatcattcttatgcctttgcatcttcatggcttagctcccacttataagtgagaacatacaatgtttggtttttcattcctgaattacttcacttggaataatggtctccagttccatccagtttgctgcaaatgccattatttcattccttttttggctgaatagtagtattctgtggtatacatataccacaatttctttatccactcatggattggtgggcatttgggctggttccatatttttgcaattgcaaattgtgctgctataaacatgcatgtgcaagtgtctttcatgtataattacttcttttcctctgggtagatacccagtagtgggattgctggatcaagtggtagttctactttcagttctttaaggaatctccacactgtttgccatagtggttgtacaagtttacatttctaccagcagtgtaaaagtattcccttttcaccacatccccaccaacatctattattcttttattttttcattatggccattcttgcaagagtaaggtggtatcacattgtggttttgatttgcattttcctgatcattggcgattttttttatatatttgttgaccatttgtatatcttcttttgagaattgtctattcatgtccttagcccattttttgacaggatagttttttcatgctaatttgcttaagttcctcgtagattctagatattagtcctttgtcagatgtgtaaattgtgaagattttctcccactctgtgggttgtctgtttactttgctgattgtttcttttgctgtgcagaaactttttagattaattaagtcccacctatttatcattgtttttcttgcatttgcttttggattcttggtcatgaagtctttgcctaagccaatgtctagaagggtttttctgatgttatcttctagaatttttatagtttcagttcttaggcttaagtccttgatccaacttagttgatttttgcataaggtgagagaggaggatccagtttcattcttctacatgtgacttgccaattatcccagcaccatttgttgaatagggtgtcctttccccacttttatgtttttgtttgctttgtcaacgatcagttggctgtaagtattggatttatttctgggttctctattctctttcattggtctatgtgcctatttttataccagtaccatgttgttttagtgactatggccttacggtatagtttgaagtcacgtagtgtgatgtctccagatttgttctttttgcttagtcttgctttggctgtgtgggctccttttttggttttatatgaattttaggattgtcttttctagttctgtgaagaatggtggtggtattttgatgcaaattacattgaatttgtacattgcttttggcagtgtggtcattttcacaatattgattctacccacccatgagcatgggatgtgtttccatttgtttgtgtcatctgtgatttctttcagcagtgttttgtagttttccttgtagaggtatatagtataattgtaagagtccaattttattcttttgcatttgggtatctgattttactagcaccatttgttgaagagactgtcctttccccattgagtggtcttgacacccttatcagagatcatttgactatacacatgaaggtttatttctaagttctctattctattccattgatctatatgtctgtttatgccagtaccatactgttttgattactgtggcttcataatatgttttgaaatcaggaaacatgactcctccaactttgttctttttcacaattgttttggctatttggagtcccttgagattccatataaattttaggatgagtttttctgtttttataaaaaatgtccttgggattttgataggattgcacttaatttgtagattgctttgggtagtatgaacattaacaatatgaacacaggctgtctttccatttacttgtctctgttacttctttcagcaatgtttagtagttttccaaaaatacatcatttctttttatggctatgtaatgtttcattgtatagatgtaccacagatataccacagtttgttcattcatcagttgatggatatttaggtttccatcttttggctattatgaaaaatgatgttaaaaataattatgctcaagtttttgtgtggcatttgttttcacttattttcagtttgcccttggtttttaagaataattgaacttaaataaaagtaaagactgttctggaagtccaggatagaaaaagacattttgagtaagacctatatttgttgctttgagtagacacaaaggaaataaaaattgcaattctttcaaaagcttgaggaaccacacacaccaacgtgagacctcttacatgtcaattttgcaaatagttgctaactgattgatagtatttggatctatgcccccccccctccaaatctcacgttgaaatgtaactcccagtgctgtgctggaagtggggcctagtgggaggttactggagctgtgctgtcatcatgatagtgagttctcttgagatctggttgtttaaaagtgtgtggcacctgccccctctctctcttgctccttctctggccatgtgaggtgccactctccctttgtcttctgccatgattgtaagtttcctgaggcctccccagaagaaaaaagccactatgcttcttgtacagcctacagaactgtgagccaattaaacctcttatctttataaattacccagtctcagtatttctttatagcagtgcaagaacagactaatacactgatatattacaaattgaatatatagttgacaaaaaatatatacatgagtagtattcagagtggcaatgatcaaggagaacttactatcttgaatgaagtcttgatatagataacggatgtagactggcagcaaaaaggaaaataacagtctgggtttagggaagccttgaccatatgcatggaggtgagcaagtatatacagaaacatgacttggctagagagggggtacagcttcaaagaaatgagattagagattagcaaaatatccttctctattttatatcctctttgatcgaagctggttgtatttgattgatatgacctttttctctacttatctgatattttcttgtagtcataatcattaatgcactcattcattgactcagtcattcaaacagtgactgagtgccttttacataccaaacactgtgcttgatactagggttacaaagatgaatgatatatactgtgacaacaaagaattcaaagcctgatgcagaagtcaagacaatttcacaaacagccacaatacaatatgaaaagtgtgcaaaaatagatggttacaaatcttatgcaaatattaagagtaaatgtagtccttccaaccaattctctgttttatcaccaaagaagttccaaaaagacaaatctcattacctttcaagagacttaaattatgctagtaaattaacttgaagtcattagtctgcttaaaaatcccttattggattcccatttttacaaaattaggtttaaactcccttgatcctgtttcatttgtctaaaacgcccccctctcctacctggttttgagttactctttaaaactcagctcaggtgtttatctcttctaggaagattttctagatgttccacaagtttttggttaggtgattttctgtatgtctcccatatcaccctgtacattttcctgccactgtctatgtcatactatcttgtaatcatctctatttctctgtctttctctttctctcatgcactgtgcttgtgaattccttgaggacatcagccaggccctacgggtatttttgtctccagtgtctagcatatattatgttcccagtgtttgatgaatggatgagcaaatcagtcagtgaacttgttggccttggtaagagacagaagatcaaagaggtaacatctgagctgaaccttgaagaatgcatgatacttactaggaggagaaaaaggaaagaaaaaaggccttcctgtccaatgcaacatgatctgcaaaagcacagactagaaaaagcccagaatgtttaagatgtgacaaatcatactttgtatcagaaactggacatttgtcagaaataaaggtcaatcgcagtgtaaatatttcccacattgtgctaaacgattcttaaactagcactgcagaattattataataggatatgtttattaatttttagcctactaaagttttggtgggttgtagcatttaaataactacattattccttgtcatacatacatttttctcatttgagcctcctcagaaacttgagggttattttttagtatttatgtgtatgttagaatggggagtaaatattattgcaaactaccagaacaaagtttttagattccagaatcaaatgttatcaaattattattgagtagattctataccataggaaccttccagaatggaattgcacaataagatatatgaacaactcaggcattcaagacagaaatcaagtgagctgatattcttttatccaaattgtcagtgagaccttactccactttcttctacttccacgtatctaaatcttgcaaaagcagaagataatcattatttctctcctcagagtggtcaaataattcattcatgtgcatttcaagacactgtgagatctataatacagctgtcagtatcaactgtctttcaaacttagcatattaaatataaagcccctgtcttagaatataggaagaaagagagccatgctgagcctgtttctttggggctactggcaagaacttagggtgtaaaagtgactatactaactgttgattcttatggcaaacagatttgtagttttttgttgttgatgatggtgtatgtagtgataacatatacataacataaaacttaactattttaaccatttttaagtgtatggttcaatagcattaagtacattcacattgttctgtaaccatcaccaccagccatgtctagaactttttggtcttcccaaactgaaactctatacccattaaacactaactcttctttccctcctcatcccagcacctgccaccaccattctactttctatctctgtgatttgactactctatgtacctcatgtaagtggaatcataaaatatttgtctttttatggtcagcttatttcacttagcagaatgtcctcaagattcatccatgttgtagcatagtcagaatttccttcctttttaaggctaaataatatttctgtatgtatataccatactttgcttatccattcatctgtcaatggatacttgagttgcttccaccattgattattgtggataatgttgtgaatatgggtgtacagatacgtgttcaattcccagcttttaatgttttggatgtatacctggaaatggaattgctggtttatatggtaattatgtttaattttttaacttgcaactttttaaatgtgagagatataaaggaagagcagtgggtagagggaacatgagtggtagtagttattactatggtggtagtatggctgaaaagttctggtcgggcgcggtggctcacgcctgtaatcccagcactttggaaggccgaggcgggcagatcacgaggtcaggagatcgagaccatcctggctaacacggtgaaaccccgtctctactaaaaatacaaaaaattagccgggcgaggtggcgggcgcctgtagtcccagctactcgggaggctaaggcaggagaatggcgtgaaccccagggggcggagcctgcagtgagccgagattgcgccactgcactccagcctgggcgacagcgagactctgtctcaaaaaaaaaaaaaaaaaagttctaaaatctagtttttccatcttactttagccacctatgaaatatattgctgtgggtaagtacttactgtatttaaacgtctcttccggccaggcgcgtggctcacgcctgtaatctcagcattttgggaggccaaggtgggcggatcatgaggtcaggagatcgagaccatcctggataacacggtgaaaccccatctctactaaaaatacaaaaaattagccaggtgtggtggcgggcgcctgtagtcccagctactcgggaggctgaggcaggagaatggcgtgaacccagaaggcggagcttgcagtgagccgagatcccaccactgcactccaacctgggcgacagagcaagactctgtctcaaaaaaaaaaaaaaaaaaactctcttccttcacctgtaaaatgaacataacagtgctctactagattttcatgggattaagtgagattatatatgtgattcatacagtgttaataaacatttactgtatcattggggctagccaccagaaaaactcagcccttgtgctatctctgataattaaccactattagtgcactattcaaaatcccagcaaagtcattcatgtagattctgagctgatgtatagcttacattttgatctacaccccccagtgccaggacaaactacttccagataaggaaccatcccatgaggtttactgtgatcctggacaagcaccactgggcccactgctagggactatatagcttcaggttcatgtgagagttaatgttatatatgtgaatacaaactagaccctatggtcccaccactttgcttgtctgacatagtatggcccaaacctccagtatagctccagaatagcttcaacatcctaggagtatctgaaggtagaatctgctaagttctcccttccaattcaggtgccaaaagggaagagtcaatatcactataggatatagtgatattcagaatagaaatttgaacatcagatggtccgaatataaatttaaaaatctctctacacttacttctaggtcctaggatctggaaatcagagaccctaggtggctaagaaggtcaaagataaaaaacacagactcacttatccagctccggaaacaatgaaattttataaattatacaaatacttcatgtaaatcaagtcctatattacttgtcttggtttcttttcttccttcctcttcctctttttttaacctcatttatttttgctttcctttttttaaattagcaataaagacagtttctgactagaggatttcaggaattggttatgactcctgaaacttttattcttattggcactagttcaaatttctgagccaaaagtgattttcatccagagtagtctgaatacttacttcacacaaaaggttactagtgctcttcttataggcactaaattatttcaattaatgaagccaaaatcaaaggctaaaactcaaatggaatgactgggatattccttcctttttttttaagctttctcttcttaagaaaaaaacaactttaggattaaaaaatgatgcattcattgtagaaaacgtggaaattttgggaaaagtagagcaaagggaataaaaaacataaatctaacattctgaagtaataaatgctttatattttcatgtatgttctttccttttctactgatatatacacatatatcttaatacagttaagactatatgctgcagatttgactttgcatgttgtaaaaatatgtatcataggaattttcctatgtcaatgaatattcttcataaatattactttagcctccataatattttaccttaagaatctatcatttcttatttaagtacctatattgttgatagtttggtttctttccattttttctattgtaagcaactgtgaaataaacatatacagaaacatttatccattttcctacgatagatttctagaagtgaaactactaggtcaatgggtatgaaaacgtttaaagttggctttccttttaaagaaaatcatatttgggttgttaaaggattactgacacatcaactgagcacatctttgattactgtatagcacctcatattcagataatctctgcaaacattgccatgaattgactgagtataatcttttatttcaggcaccagaatgcatctcttctatctcctgtttcttgggacagaaatcaggagttctgactgagcccatttacaagctgtgtcagacaagcactcatgcccatcttgtttatgactgcctgcttacccattgctctccatatttacattttccttcttttctcttccttcagatggaatggggcgagtccttgctcaagatgtatatgcaaaagacaatttaccccccttcccagcatcagtaaaagatggctatgctgtccgaggtaaatattttggttttcttaaacataatcaggcactgtatttttttttctttttttctttttttttttttttttttttttttcagatttttggcttagcccaagcacccagcaactgttaggtttgtttccccatgactgtcaaaataacttcattcacagataaccatgttaatctgcacctgtaaattttctggcacaatcttgattaaaacttttgaggtaaagaaaagttacatgaaaattctcgttttaaattttttatttttaatatttgtggatacatggtaggtatacatatttatggggtacatgagatatttagatacaggcatacaatgcataataatcacatcagggtaaatgtggtatctgtcacatcaagtgtttatcctttgtgttactgaaattcttggctacaaataaatatataggaataaaattaaaacactgtacttcaatttattctttccgttcctacacatgccagacagcatacattcttagtgtgaaagttttccagatgttttctagttgaaaacatctgatggtctaagaaaaaagagcagattcccaacacaaggataaagttgaggtggtctgttctgctttcaactcaaacatcagtaaagggcttcatgaaaagcggacatgagggaaacctctaattctctagaagacatcatatttcaaaattctggcgccccagcagctcacacaaagttgcctgagattgcataaagcttaaaagcaaatactaaatagcatttttctgcctaaattccaatctaagaaccccaaatgtaaattctgaattgcttagaaactgttgttgatttttttggttttgtttttgtttttccatgtacaacatgatattttaaaatatgtagtacacattgtagaatggcttagttgagctaattaacacatgcattacctcacatacttatcatttttgtagtgagacttaaaatctactctcttagtgattttcaaactatgatacattgttattatgttattggttattaattcaaggttgatatcattgaagaaacatgtttaaaaagtttttcagtttatcagagctgttaagcatgccaattcctttttaatggggtacatgagatatggagttatggagtctcttacttggttttggttttggtttttttagctacatttagccatgaaaatacaggttgggcatccctaattcaaaaatccagaatttgaagtactccaaaatctgaaattttttgcgtgttgacatggcaccacaagaagaaaatttgatacctgacctcatgtgaagggtcaccataaaaacacactcaaaactttgtttagaaaaattatttgaaacattgtttaaaattacctaccttttggctatgtgtataggatatatatgaaacataaattaattttgtgtttagacttgggtcccatccacaagatatctcattatgtatatgcagatattccaaaatctgaaaaacatcaaaatccaaaatacttctggtcccaagcatttcatataaaggatggtcaacctgtaatttcctttttcctgtaattaaatacttcattaatctcctctgtattccatcatctcttagtagttatctttttatgttggagatagcatagcaaatgattaaggctacaggcattgagcaaagctcaagtgatctgggttttagtaccagttccatctgtgtaactttgagcagctcacttaaattttttagcttcagttttcttatctctaaaattatgataattacaacaatacttaccccagcaggttgttgtaagaattatattaaaaattaattgtagaaattaattagttgtagaaagccttagtaaactacctggcacacatttaaaaaaaaaaacacttgataattgttttttaaaatatttaatgatagtaaccattattatcatattataaatacattttcttaaactatctctgaaaaatggctaacatttgaattgctactctcattttctgtgtaaataaaatggtagagagattgagcttatgttttttcatttccactaatgtattctttctcaggaagattatcttggattcacttcattcagcttgatctcactagattagaatacttctgaaattggcaaagccaaaacttaaataccaaattcccaatggctcctatgtttttttctttcaaattgattccttctacagtgttgattagaataaatattatccagacagaaaattattttattcttgtgatagcttcactggctcttctagtttcttttttttttcccaatgtcattgttggcttgaaatagtttcttattgcccatctaaaaagtaaattctgtgttgatcttacaatttgtagccatacaggattactataaaatgacaaagaattcttacttccagagtagagcaaacagctacagtagatgaaacaccagagacaaagaagtctgttttttatagtctttgtaacataatgtgggagagagtgagaaaataaattatttgaggcagaattattcccaaacagaatattgttctgtgatttttacatgagctagcagcagctcaattaaaaaaaaaaatggttgctgttagcttttcttgttgccaaagggagccattagcccttatgagcttttctgacactgtacaactcatcaaaaaatttttatgtaaaattaccatttagtatcctatttatgcttttgtttgagaggtttttttttttgttatttcaccaaaaaaaatctaaaatggtatctcacattataaacagtccaagagattatctaccgtgaagctgattcacattgtttctttcttgcaaagggttggtacttctccaagatatgtaacatataagagcgacataagtgataatcattgcataaatggttaaatctcaaagtaggaatggttagtatgtctgtgtatacaatatgaacatcataattaaagaagcaaaagtcttctgtagacaagtggcatggtcttagaactatgctgaattttccagtttatacctcctcacttttttgtctgtaattcaggaagataaactctatgaatcctaaaagtgatttttactgtatttagtaataaagatgattttcatttctttaaaggtaaatgtattcattagcctcttttctgttataaataccacccccaggcagtgttttggtaaagaatatccttgaggccaattattgtggctaagaccctcctttgagtacctccttctctctacccctgtcttcctttactctggttcctttctccctgctcccttgattctccctattttcttctcctctgcctttaccttaggccttccagtaataaccagtggcactcgtgggcattgctaaccctctaggtgtaaagatgttgctaacttgctctggatcactaagcattagccagtatccttcagaaacatgtgggataaaactccaaaccagttggaggatcacttgctttaaggtatgtgagttcaaaaatcaagacagtaataaaatgactaaggaaataagtagaaacagctcaaaataaaacattaagaaagaatagaatgtaaagaaggcaggaataaagtaatgataatataaaataataggaagacctgtaaacctaaaactgcattcacgtgggagtgaatttgaaagataaaagtagataaaataaaaatgaaagtggcatatttacaatttgaatcaatacagtatttttattcttcacatttttcgattttgtttctcccttcacactgatgaagctaatcatcctcttgatgcattcacatcctcctatatagatgtaggtgactattttatcacactttctttgtggatattaataagggcaaaaatatgttagaactccaagttcagctttcttgaaaaagttcaatttgaaaggtttatcccttcagagcttattttgggatcatttggaaaaaaggaatattttgaacaaaccaggaattattttcagagtcataggtaacatacagttctgaaaagatatattaagagaaagttttgccatttgggtagagagaatttaaaaatttttttttcttgtttacattctgattgaaattacttatgaaaaatgcaaaaataatgaaaaagaacattttaaaattacccattaacttaccccctggccactattagcattttgtgcatttacctcacatacagtgggttagaatacaccaaaattcaatatagacaatccacagccattgtgacttagacctagttcttattctttcaacagtaatcatatttcagggcttttgttgtatccatttgaatcctctttcgctacaactggttctgcaattcatttgacagcctattttgccctctactataggatactttcagtgaaaaagagggccttatgatatgggagtaatactcatgtgaatagataaataatttggaataatttagtttagttaattccaaaaagaaaatatttctgaaaataatgccttctttcccaatactaacaattaataggcattttccctggaagataatggtaaagaatacacgatgccttcttactcatgtatcctatgcccacctccctgcgttccataggaaaaggtagccagtttaaaattccaaacaatttacctaatgtaatacttgagtgtaattgcagcaagtatgaatcctcttattccagctttgtcaccttctcttgttacctttccctaccaacccctcctataatcttaactttagtatgcatataaatactattaccctgtgcccttcttgcagtctcagacagtgtagttctataagcagagcagacaaattactattccttctgccttatttctctatcaactatttcctaggacctctgaaagttatgccatctctatgtgctctaatttgttcagccttaaagtggaaatgatgagactctttagtattgaaaataaatgactagctatacagtatttcaagagacttaaagaaagatcactatggctggaaaatgaaaatgaaggataattccatggcagatgatttgaagatcatcgttttctgtgtacacaatgagtagttatctagtgttatcaatttcatatcaaataatataaccagaaatcttcaaataaatgggtgaacagaactaaaagtgttttctggatattagaaaaaggaggaataagaaggaacagcttcagggtcttgcattaaacattaattgtttacataatgcatatgccattagggtttggtttatattgcttttatcacttctttcaaattaaattctacagttgcaaagcagaaaagaaattcattagcagatatgtcagaattacaagggaaacaattctaaatctgcagaagtccttcaaatctattcatcttttctaatgacgtactgtggtttactttctttttttctttccaagctctaggttcatgtgctatcatgcctccgcttctgccctctcctacctaaacttgtagaattcatcttgaaaaactgcaactttttaaaacctgtttctttcatagatatttttaaataaatatagccatgcaccacattagcatttgagtcaaaaacagactcttacatgatggtggtcccatgagattacaatggagctgaaaaattcctattgccaagtgagattgtagccattgtaaggtcacatagtgcaacacattacctttcctatggttagatatgtttagatacacaaatacttaacattgtgttacagttgcctatagtatttagtattgtaacatgctgtacaagtttgtaacccaagagcaataggctataccatgtagcctagttgtataataggctataccatctaggtttgtgttagtacactctgtgatgatgttcacacaacaaaattgcctaacaatgcatttctcagaatatatccccattgttaagtgactcatgactgtatcaggaagttagatagattgatacttatttttctgtcttcataagacaaaccttggtgttaatgtaaaatttggactcctgtagttcactaatttttttattccttaaattttctcttagtctgaatttgtctatattcagtttgatcttatagtgctctgctcctcaaaaagggtaatccatggaccagcagcctcagcatcagcttgttagaatttagaatctcactgttggtgggactgtaaactagttcaaccactgtggaagtcagtgtggcgattcctcagggatctagaactagaaataccatttggcccagccatcccattactgggtatatacccaaaggactataaatcatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaacgatgagttcatgtcctttgtagggacatggatgaaattggaaatcatcattctcagtaaactatcgcaaggacaaaaaaccaaacaccgcatgttctcactcatagatgggaattgaacagtgagaacccatggacacaggaaggggaacatcacactctggggactgttgtggggtggggggagcagggagggatagcattaggagatatacctaatgctaaatgacaagttaatgggtgcagcacaccagcatggcacatgtatacatatgtaactaaccggcacattgtgcacatgtaccctaaaacttaaagtataataataataaaaaaacaaaaaaaaagaaaagaaaaaggcaaaaaaaaaaaaaaaaaaaagaatttagaatctcagaccttgtcccagccctactaaattagaatctgtatattcacaagatctcgagatgatttgcatgcacattaactgttgagaaataagagaaataagaaaaatgactcctctcttggtaccaagaaacttctatgtagttgtttgactgattcttccttagctagcaatatagagacacatttaccaactggaaaggttcagagtaaggttgagaacatagtgcaagtgagcacatattctctccacaattggtatactttccctgataacaaagaccttgctccttagaatcgcttcagagtactttcacatatggacctccctggaactccatactaggcttgccccagatgacctccccagatgacctccagctactcattattcagtttatttagaggattatgcagaatattgatatgagcattttgagtttatgtgcatgtgtgggggaacaggagaaaagagaaatacttcccaccaaaaactttttgagaatgccaacttcatttctttattcttttaacaaatatttattatcagcgatgacttaggcactatgctagacagaataatgacataatctaagttatacagaattaatcaaagcagtctttttttttttttttttgagacaggatctcgctatgttgctctggctggagtgtagtggtacaatcccagctcactaaaacctccactccccaccccccacccggttctcaagccatctttgtgcctcagcctcccaagtagctagactacaggcacacaccaccacacctggctattttttgtatttttgtagaggtggggttttgccatgttgcccagctttgtctcaaactcctgagctgaagtgatttgcccagccaaagcagtctttctaaacattcttaagatgttgactcaaattttgaaggaaacaatatatatggatcagcaaaaagtatatataacaaatataaaactttgtgttagaaaatattacttatttggtcattcgtgcatgaatcttctaagaacgtttttgtagccacattcattcgtctgccaaccatttttgaatacttaacatattgaacatttatttaacacctattgtacagcaagtgccagggattagcaaatactgtaaatatatttagaagccataattgatttcaggctacactggggaaacaaaagaggatgcacgcaactcttgaggggagaggagtcagatatgacttcacagagaagatgacacttgagctgagtcttaacagctaaaaaatctttaatcagaaggcaagaataagaaaaggacgctttaagtagtggaagtagcacatgtcacggagccaacatatgagttatcttggtattctcagggatagtactagcagttgataatagctagagtataagatataaggaagacatgaaccaaggcctttgcacatatgttctctttgcacacaatgatggagcacttccacttcatgtctatcttttcctctctctccctctccttctttccctccctatttccctccctttgtctctccccacctacatacctgcacacacacacccctacttagctcttactcattcttcatattcaaatcagaaatccttttatcatgcttttcatgactctccagtgtagctcaggtactttaattatatactctcataaaatcatgtttctttgctttggagtggttttcttaatttgtatttatatattcattaatgtgattatttgattaatatctgcctctcctgatgcatcagtggctttaagagttttattttaaccacacccatgggaagaaatacattaaatatattatacatcaaaagccaatgatatacacacacatatataacatatacagtacatataaatatacatacatacacgtatataaacaaaaataagttttatgaaacaagagtcatccttaccatgtgtgttgaaatatatttttatccttttcattagaaaattgttcacaagttgattttacagcctatctccatttgtcatccagagtttgaaaaaccttgtaacacacaccatcatggcacatgtatacatatgtaacaaacctgcacgttgtgcacatgtaccctaaaacttaaagtataataataataaaaaaaaagataaacctaacctggaaaaaaaaaagacaaaccttgtaacaggttggcactgcactaaaatagaagcagcgtctaggtttaccccctactctctctccagcccttagtttaacacttggggcataaaagacactcagtagacatttactgaatgaataaaaggaataaagagcttcaaaggtattgttttaaaagtgtgattatccccatttttaccaacaagaaaactgaaggtgagagaggtttagtaattttgctgagagtccctgaagctaacaataaacagaaccaggattcagattcaggtttttttactctaaaacaatgctaatttcccccttgtgcaggaagtaaaaaaaaagaaaatgggtcaggcgcggtggcttatgcctgtaaccccagcattttgggaggccgaggcaggcggatcacctgaggtcaggagtttgacaccagcctgaccaatatgatgaaaccccgtctctactaaaaaaataaaataaaatacaaaaattagccgggcatggtggcatacgcctgtaatcccagctactcaggaggctgagacaggagaatggcttgaacgcgggaggcagaggttgcagtgagctgagattgtgccattgcactccagcctgagcagcaagagcgaaactccatctcaaaaaaaaaaaaaagaaaaagagagagagaaaatacctaggttgctataggaggtagcaagctgataattatttatctagtagagaaacaattttaaataagtttattcacgtttgagatgcagttggtgtggaactctgaaagataattgatgttttaattttctacagtaagaaaattatcatttgctctgaaagatggcaaaaataagtggggggatagatgaaacaagattggtaaaatgttgataattgttgaagcaatgacgtctatgtctgttgtaaaaacttttttttttttttttgagacggagtttcactcttgttgcccaggctggagtgcaatggcacgatctcagctcaccacaacccccgcctcgcaggttcaagcaattctcctgcctcagcctcccgagtagccgggattacaggcatgtgccaccatgcccggctaatttttgtattttattttgtatttttagtagagacgaggtttctccatgttggtcaggctggtcttgaactcccgacctcaggtatctgcccgcccgggcctcccaaagtgctgggatgacaggtgtgagccaccacacccagcctgttgtaaaaacttcttaaactttaaaaaaaaaataacccatgaaaatggcttaataaaataacattacaataaaactcttctataatactttttacaagtaaaaactgaacaatgtaacaggattcaaaaaaaaaaacacaagaaaggcaagagtttattaactgagataatatctgtaaagcataaaatacaacatcctgtgacagaagggacccagtgttaatttttgtccctcttcacatcaggctaaccaaagccatttatgcaaaaaagggatgacttcattataaacggtgttttatataagcctttagaaaaaaataacactttatagctacataaacgagcaattaatctaatgtccttttaaaaagagaaaatatcattattagtatgattataaatgtaatctaaatattcatatataatgtatatattttttgtagatatgctcccaaaactctgctgtttgcagataacatgaaggtaatggtcatgattttaaaacttactagataggcacttttgcccagtcgtattggtctgaaagccacatcatatgtcaagaaaactctttgaatctccaagaatgtttcttcatctagccattgttatactgtacatattttttaataaattttttatcccaattatggaattttttttttcaatttaaaaataaatagccaatggaaaatgtgatgcagtactgcctatgtattctaactcataaatagaattttgatacattattttaaaaaactgtgctacaattacaagactggattttagtcctagctctaccattaaccagaaattgttcagagtactttaccttttctttccacctgaattctttcattctataattcatttccttcagctgtcaaatgaagaaaggaatgttcttcctatttcacatcaggaagcccagactgggagacaaataagaaaacagtatgaagttgttaaaatgttatagaaaaatggagacatatggatatgtatacaaatagtgataaatccatttatatatatatatatgtccatgagtgtacacacacacatcacacatacatacacatggataaggtggcatttatttaggaagattggctagaataacttattagaaaagcacaagtgtggaaattacgaggtgacaggaagaccacctccagtgacaccatggcacaattaggcaccagtggtacaattaggaccacttctatcagtgcatgtgagttgcggataccaaacattaaatcagtcgtaacaaagccattgtcaagtctaggagatcagaaaaatattccacttctctaagccttatcaaataatttgagtcaaattttagaattccaattttaggttcttgttccatgctgtaggtccatactgatgtttgttcttggctctgttccatctcacagctgctgatggcccaggagatcgtttcatcattggggaatcccaagctggtgaacaggtgagattgataggcctgaaaggcactgaagatttcagcttcatggactttgggcatctaattctaaatttctcctatcagtttagtggaaattagagagagattagtcagaagattatcaaagggatgaaagtatagttcccaggagaaccaaaagaattatttcttaattgaaagtatctacatctattaatatatgtcatagtattattagtatgtctcacagacatgccttacaagcattttccagacctgtgattgggtgattctttttttcctgaaaaaaaaaatgttctgaatagaacaatttctaggtagtcttctcagacttttccccaacttgtgttacaaatggggaaacttagaagtagattatttaaactttttagctaattatttaatttaatttttctcacttgggatctagccagggaacaggtttacatatatttttattaagaaatgaagcaataataggccacattggaaatacaagtccatttgacactttgagaccagtaattggccacttaattgaaaaatcagttaaagtgggaaattattttatatatttaaaataaatataaatttaacttaaatatttattagtcaataatttgatgaagaaccaaggtcttccttttaaataagtatgctgttttaatttctatcaggtctttcttacgtaaaccacacaaaaggcaatgtctctgatttccattttgatttcttcaaagtagaaaaaaactgaaggatacttgcaatacatagaagagcagaatccttttagggttttattatattttacactcttttagtttcctcactcacacctaattttacagcatttctttttagcagcatttttaatggaggtttccaaaaggttttacttaatttttataggaaaaaaataacatatatcattggtttatgtattatttatttatttatttatttatttatttatttatttttgaaacgtagtcttgctctgttgcccaggctggagtgcagtggcgcgatctcggctcactgcaagctccgcctcccgggctcacgccattctcctgcctcagcctccccagcagctgggactacaggcacccgccaccacgcccgcctaatttttttgtatttttagtagagaggggatttcaccatgttagccaggatggtctcgatctcctgacctcgtgatccgcccgcctcggccttccaaagtgctgggattacaagcgtgagccaccgcgcccggcctggccattgttatgtttaagaggaaatagcatctgtcaatccggtgagttacgaaggttgatcaacagagctcctaccttattaaatggaactagaaggaaaccaaagaacttttttcctttccctgctgcttcccttcaaagtttcctcttcctgagatggaatacccaactgctactaccaagcaatatataaaaataaaagtggcagcgggcgtggtggctcatgcctgtaatcccagcactttgggaggccgcggcgggcagataacctgagttcgggagtttaagaccagtgtaaccaacatggagaaagcccatctctactgaaaatacaaaatgagccaggcgtggtggcacatggctgtaatcccagctactctggaggctgaggcaggagaatcgcttgaacctgggaggcagaggttgcagtgagccgaaatctcaccactgcactccagcctgggcaacaagagcaaaactccgtctcaaaaaaataaaaataaaaataaataaaagtggcaagaaataaataaataataatttttaaaatgaaggcagcagtttggcaaacgctatgttccatgcctttcttccttggcttagcatggactaacactagaaacgagttgagatatataggagaaggatgatgccaatggtgttgacactagcttcttcattttagcatccaaaaattgaggagattcgcatgcaactctctgaagctaagttggcactatagtgatacatattctcatccatactgcaccaagctggatttcattaccatgaccatttttctgacaaaaagaacagctaggcttgattcttttttataaatgacttgtcttgtttgtttgtttgtttgggtttttttgaggggagggaggttgttcttggttttgggtttctgggttttttcttgagacagagtcttgctctgttgcccagcatgatctcagctcactgcaaccttcaccccagtatggactctgtgtgggggctccaaccacgctgggttctctattctgatccattggtcaatgtatctgttttgctgtccaaaccatgctatttcagttactatagctttgtagtatattttgatttctgacagtgggaagcctccagttttcttctttttattcaggatagctttggctatttggagtctcttgtggtttcatacaaattgtaggattttctatttctgtgaagattgtcattggtatttttataggaattgcaatgaatctgtagatcgcttttttcgtagtatggtcattttcacagtattaattcttccaacccaacgacatgggatgctgtttctttctcttttttttttttttttttttttttttgtggcctcttcagtctttttcatcagtattttatagttttccttatacagattttttacctctttggctaaatttattcctaaattttttttgtagttattatacatgggattgctttctcattttctttctctgctagtttgttcttggtgtgtagaaatgctattcatttttgtgtgttgattatgtatcctgcagctgtactatatttatcagttgtaagagtttttggtggagcttttagggttttctatatataagatcatgttatctgcaaacagggacaatctgacttcctcttttcccctttggataccctttatttctttctcttgcctaattgttctggctgggacttccagtactaggttgaataaaagtgttgaaagtgggcatccttgtcttggtccagatctcagaggaaaagctttcaactcttccacattcagtatgatgttggctgtgggtttgtcatctagggccttcactgtgtacactcattctttctatacctaagttgttgagagttttaaccatgaaggattgttgaattttatcagatgttttcctaagtctgttgagatgatcatatggtttttgtccttcattctgttggtgtgatgtatcacatttattgatgggcatatgttgagccacccttgcatccccacagtaaatcccacttgatcatggtaaatgatctttttaacgtgctgctggattcagttgcaagtgttttattaagcatttttgcaccaaggatattggcctatagttttccttttttgtgttgtatccttttatggtttgagtagcagaataatgctgacctcatagattgagtttggaagaattccttcctcttcagttttccagaagagtttgagaagaattagtatgagttcttctttaaatgtttggtaggattaagcagtgaagtcatcagatcttgggcttttcttcagtgggagactttattacagattcagtctcattactcatgattgatctgttcaggttttctattctttttggctcaagcttggtagattgtatgtattgaggaatttactcacttctgctaggttttctaattttttggcatgtagttcttcatagtagtctctaatgaccctttgtatttctgtagtatcagttgtaatgcctccttttccatttctgattttgcttatttgggtctttttttattagtctagctaatgctttgtcaattttgtttatatttgcataaagtcaactttaatttcattcatcttttgtggttttttagtctcaatttcatttgtttctcttatctgtattctttctttccttcttctgattttggatctggtttgttcttgcttttctaatcccttgagatatatcactatgttgtttcattgaaatctttctactgttttgatgtaggtgtttattgctataaacttccctcttaatgctgtttttgctgtatcccataggtttttgtctgctgtgtttctattttcatttgttttgggaaatctatttatctcttaatatatttattgatccattggttgctcgggagcatattttgtaatttctacatgtttgtacaattttgaatgttcctcttgtattgatttatagtttcagtccattgtggttggaaaaaaattcgatataattttagttcttttaaatttgttgagacttcttttgtggcctaatatggtctatctggagaatgttccatgtgcaagtgaaaaaaaaatgtgtattttatagctcttggatgaaatgtactttaaatatctgttaggtccatttgatctaaaatgcagtttaaatccagcgttcctatgttgattttctatctatatgacttgtccaatgctgagagtagggtgtcaaactccccaaatattattgtattggaatctgtctctccttttagataaataatacctgctttatagtgggtgatcccatgttcaatgcatatatgtttgcgattattgtatccttgtgataaattgatccctttataattatagaatgacctctcatatttctttttacagtttctgacttaaagtctattttatctggtataaatgtggctacttttacctgattttggtttccatttgcatcaaatatcttgattcatttcttcactttcagtctatatctgtataggtgaagtgagtctcatgtaggcagcaaatagttgggttctttttttttaaatccattcagcttgtctgtatcttttaactacggaatttaatctatttacatttaaggttattactgatagatgaggactcctgtcatttcattgtttcctggttttgcttaccccttgctccttctcttattgtttatcattgcagttgggtggttttctacattgatactgttttattcttttctctttctcctttattaatctggtctaccagtgagttttatgcttgtgtgtgtttttatgatagtgattattgtcttttttgcttccagatatatgactcccttgagaatttatggtaaggccagtgtagtagtaatgaattctctccatttttgcttgtctgggaaagactatttctccctcatttccaaaggatagctttgctgcatatagtattcatagttagaaatttttttatttcagcactttgaagatgttatctcctttcttcctgtcctgtaaggtttctgcagagaaatctactgttagtctaatgtggatttcattatatatgacttgatttggagacctttggaattcctggacctggatatccatacctttccccagacttgggaagttttcagctattattttattaaataagtttcttatgccttttcctttctttttttctgaaactccaataatatgaatatttgttcttgtatggtgtcccataagtcttacaagctttcttcactctttttcattcttctgtttctctctgtctctctctcttgctgggtatttcaaacaacctatcttccagttcaaagattctttcttctgctttatcaagactgctattgaagctctctattgtaattttttatttcattttttgaattattcagctgtaggatttctgtttggttcttttttatgatttctctatctttgttgaatttatcattcttatgaattgttttgctgattttgttgaattatcgctaggttttgtttttgtttttgtttttgttttatctaattgagtttccttaagatcattattttgcaatttcttttccaggagttcattgatttccttttcattggagtctgttactagagatgtattcctttagtggtgtcatatttccttgcttttttgtgtttcttgtgtccccatgttgatctgtgtgcctagtggaacttttgcttctttcagactttctgggtggttttgtagagacgcctgtagttgggctttagtgtgttggttgcaaagggtatggtgactttctggacaggtgcaatggtgtagtctccttgcagctttttcagttgcattcaatgtcagtaataactgtgagtacctcagtggcctaatccatagaagtttgtgtcagtggtagtagtggcataggctgttaatatccttggtgtcaagggcttttagagtcctcctcttcttgttttccacacaatagggagaatcagctgaagggatccctcttggtgttaggtctgacatgccctccaagcagctacagtggcactgggctcaaaatatggtgcttggagtgactgtggagccaggatccaaggctcagggtcttgtgaatccattgtggcacctggttcttggggttcaggttcactctctgtggcagagttgggtgtaggttatccaaagaaccaaggtttatgactgaggcaccccctagcagcttggacccaggtgccctggttgtacctgtgattttatacctcatgggtagggtgtagtactgaccaaactccaaagaaaaaggttttggccaggggagcagggtatggccgcagctcaggaaccagagccagtagggctcagcagcagctcgggtcacagtggataaggtactgtgtagtagtgaccctagacccctggatggtggggctacgcaggtcctcacttcagactctgaggccaggtgcagaagcagcagataccttagaatggcagagcgcagctgtggtttgatccccgggggggccaaggatcaacacagaaatgactcaactccccagagaggggggtatctcagcagctcagactctaaggggctatagtctagctccagagaagcagggtactagagttatttggcctgtaggtcaggatatcttggctcaatcagcactctgtttccctaggacatgagtgactacatcagctcagcctgggatgcgtaggtgctcagcttggcaaagtgtgtgcaacatactttctaagccttgccataacagagcaatatgtctggaaaaaggatgattaaagaagattagaaactatctccaatgtctggatggagttaagggaaaccaataaaggaatctgcagcacccaggagctagcaacagtgagatttccttaccacatcttagtctgaaggagcaaagaaagacaatggtacctgaacctgggaagattcatatctgtgggagaggactgcccaacagcagctcttgctctcagtaggagagatgccctaaccatcaccaaactgcagcccaggaggaaaagagcaaggggaatgaaaactctacttttctgtctctctcctaccctctacatctcttactgacccctccctttggctgagtctcaccagacgccaaagtggtgggaaactggttaaaatagtccatagaggtcagcttctggaccacagcacagagtagagaatgatgatgtgatctggagaggcaaacagaaaatgaaacaaatctttgtctttgtaaggcttatattctgtaatatataatgcacttaacattgtacctagcatagattgtgggttcaataaatattagttattggtagtattgcttacagtaataatattatggagagaagatttttaagacttttgtaataaatttcctgttttactttgattgtactttcagtagtaaggtatttttttttcttaaccattccctaaggggtgtgtgtgtgtgtgtgtgtgtgtgtgtgtgtgtgtgtgtgtggtttattttactttgtcttattttggtggttaaaataacaacaatgacaaaacatacacacacataacattaaatataccatcttgacagtttttaagcttatagttcagtagtggtaaatatattcacattgtagggacttaagattttaaatagagtcatgagttacttaatgaagatatattctgagaaatatgttgttgggcaattttcttgttgtccgaccatcatagagtgtacttacacaaacctgcatgagtagcccactacacacctagcctacatggtgtgacctgtagctccgaggctacaaacctgcacagcatattacagtattactgaatacgtaagcaattataatggtatttgtttatcaaaacaaaaagtacagtagaaaatatggtaatcttataggaccaccatcatatatgcagtccaacattgagcaaactatccttatgcagcacgtgactatacttatgaggcagacatctttagaaaggaatcttttggcaggggggattaatattgtctcaggattttttcttagggagaatttgaagcattcattttccaaactccagtctaaatcattgcccctgacaagtgactttcagatcacttctctatcagatcaaatctatcagatgaatcttacagaaaaatgcttttcctcatgttgtaagaagttagcagggaaggttctgtctcttataccatcaatatgagagcacaaacaatgaaaatcttgtttttcattttcaaaagtaatgtttaacctaggtcattacagacactggaatcatttttaaatgatttaattatatttgctcaacctctattattaattgataggtgagctaatgtgttttagaatattttcaaaggcaataattaaaatatttctggcttgcctttatttaaccaaaaagtttagttaataaagtactgcatttctcaaacattagaacttcaataagttatgaagatttttttttgtaattgttattcacaatgtatgtcctagcaatttttttacttacagactctcaaatcactttacatatattaggaaaatgtacattatttgagaggcaaaagtggcaaatgtaaatggcagttcttcaaaagtaaagcagagcaccaagacaccgaatagtcattaccttaaagtacacataaaatcagcttaaatgaacctaaagcccctttagtgtgagtgcacctgtttgtggatagcttttattacactggcccaaaatgaataagactgtaagactttcttttatggtttattttttaatattaaaaaaattaacatcctctgcagacttttcctttgcagcagcaaagtacatcaactgtctttttcatctttatttccagccaactcagacagtaatgccaggacaagtcatgcgggttacaacaggtgctccaataccctgcggtgctgatgcagtagtacaagtggaagataccgaacttatcagggaatcagatgatgtacgtcatcaccaagtcttactgtgctgttgttcctatggcagtattatgtcacaaccattttctgcagtgtttgtgagattaacccagttttttgggttgtttagttttgttttgtttttgcttatggtgggatcttatattgtagtatatgagtctccagtaaataagaaatttccttaatcttgaaaatctgttgttacaggaggggtttctatgatcattgctgttatagcagaatttgaatcatatttgacccaagcagtttcacatgcaaacaacgaaagaaagtacctcaagaaagaaatgcagagatattaatggttgacataccttccagagcagagatattaatggttgacataccttccagctgagaaatttgccattgagactagcttctgataaaatgtcaaggagttcatgaaatcagaatttactagagaagaatttaacaaagagcacttgggcaagttcttgaatattacactaagccaagcatttgaaccaaatgaccctttcacctctggttttctgtaagtctggaaaaagctgtgccaccaaatgacagcctggaaatattaagtgtatgtcagttctccctccattgcctcaagtaaaagatgctggaatctttttggacctaagcaagcctttatctcactgaaaatagtggcaggttattgaaaccagagtataagccagtaataaaagtagaatagattcaactgaggttttaataatcagctctcttacttgttttatgaagaaagtaaagatatattttaaagctgaggtgaaaaataaacatatattctcccaagccgagtagatagtaaaattggccatgccaagagacagacactttccctgatctggagattttctttttaatcacctttccatatgtaaggcttataaaattcaacccttggcaaacagatcacattgcctgctgttaaaactgcctaagcagatttattggcatcagggaagccagcaaagcactgaattccagaacacatacatccacagactctgccagatgacaagacacagttccaatgtcacaatattattcacagcccataaatgtaaaattgattactgcaattaatggacagaaatctactaccaggcaaactataagtcctttactgaaatttctgcaagtatttggtaaccttggcatggtattgaacccatgattcatgggaaaagaaggaagatattacctccacacacgttcactttattagggtagccacctacatatgtatataaaaatatataaacaaattctatataatgtattagttcaaatattaaatcttataaacaagatttaatatttgaattggtacattttttaaaagcataaaaattggagaaaaaaattttttatttattggcaccaaaccttctaatttttcaggaacctgtgttagaaattcagtgttttcaaagggtgtagcaaatagttttctttttgtctatatttgtatatatcctgggcctatctgatggtaaaagtatcggagtaactaaattctactgctcagaaattctgtttgaaattacatgaccggctgttattatagggcactgaagaacttgaagtgcgaattctggtgcaagctcggccaggccaagatatcaggtaacttcaaaacacatagaatatatagcctacttttgtttctacatgatcatttactcaggaaaccctggctactataaatctgcagccatgtcagttagccattaattttcagggctttaacaaaaagcaaaatgaatgttatgaattctgtatcacatatctgccctgcctactttttaatgaagatggtaaaggcgagttagtcaaaagcaagatgagaaagaggtaaagtcatgagcctacatattctacagttaattctacttctagataatccagaattacccaatcccatccctaaataatctggaatttggtatcaactcagataataccagaattgggtatttacacaattaactaatagcatatgctctagtgactaccaataataatggaataatctgttccttgttatatacaaagatgaggctatttgctatgataaatagtgcatataccttaaattatttttcttaaaatggaatatgtttaccctgattccattaatactaatttgctgaacatccctttgtaacgaagctacacttctcccatccctatggcagcacaccaaggttaatgtacctcagtagccacagatcaggaccaacctaagtggtccatatggaaattacctctatgactgtagcctcattagcattattctccttgacaaagctagccagctgtggacctcttatcattaatgccgctagatattgccatacaaattcttgccttatcaaagaaagtttacaattggtatttttactataatgtaacataaaacaatttgtaaagtaattttattcacaggtactcatgaaaaaaaatttcaaatatgaagtaacatgtttttctttagcagtaatacattcaaatcctatttctgttttctgttgtgtgatttaacttttaaaattaaaaaagcataggatttttagaatcccttcaattcattgttttcctactactttatttctagacttttttgtcttcttgaatgtccttttttgacactaaagtttccctctgagttgagaaaatgttgttctctaatcacactgcttatggttctgctttgactttcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgaggtattaaaaataaaaatggagggagtggggagagggcccataagataaaggtatttctgacatatgttctgtgttgtaaatagaatgttgtagattatagatcataccagtggatccacattcttataacagggaaacaataaattggctttaggatagtttcaagttcagaatatgagaacaaagaagaactagtaaaaattatgtattatgaaatgttctcttctattagaatgaaatattataaccaatggcctttccacaaagtcagtacacataagcaaaaaactttagctgctagctatagatattaaactatacaaactcagtactgtttctgtttagacaatgaattgtgcccatcctgctgctgaaatgatgagctacttctgtgtgggaagtatcaatgaatcaggacatcatggctagcacttcttgtgaaaagttccatttgatctttaatcactaagagggatttgataatcaggttttttttttcctctctctctccctaaagatagcatctctagtggcatgatatttagaatgggtcaaaatgtcttttcattcctgatttagaaaagagaatttagtccatctctttctgagaactcttgaaaaacttcctattgcttgttttgcttaggttgtgcaaaacttcagtcagaagctccaaggtcaaatggagaatactaaaaagtgaatctgctggaaactcaaaaccttataaaagaatcagaaactattgagatttttaaaagtattaataattcctttgaccttactattaaagaaaagattagcgggattttttaaaaatctctttgttctgaaaataaacccatcattatttttaatttcttgaagtcttggaaatgaaaattttcagaggtctttttatgacattatagtccttttggttaaagcaaaagaatagactgttttattttgcaaatagatagctaaatcaacattccagatgtgcttacttcccagtatatatgcactagtcatttccaaaaactattgattgacaaaaaacattcttttcaatttgatctacatagtaatgattttaatatccttagaaccaaataacactatatatagcatcagaaataaatttttgttaaactggttgactcagtgaactattcttttttatgatatacttacatgctttgtgcaacaagtaagttcatggagtttgagaaagctaaacagtagcacactcatggaccaggcatggtggcttattcctgtaatcccagcatttagggaggctgaagcagggggatcaattgaggctaggagttcaaaaccagcctgggcaacatagcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctctcaattatccacagagtatattgttagtgttttgtttaagctaccttttacactcaattaaaactatttactggaagtaggctaaggtaatggggtgagaatagagatggtattatatcatgaaatctagggaagagtttgtagtcttagttccctgcccccacagagcttattactcttgaagaagctttgactaattctacatgacttattcccctactttaacagacctgctatactaaactataccacagttttccaagagaataatgcttctaaattatattatctctggttccatatagctcaacattcctccctttctcttattcaaagttagtttttattatgactctatgatcatatagtttagttttgttcagcagataattgggtacctctgtgccaggcactttactggaaattggtgataaaaaaaaaagagataaataaagcatattatctctccagaaggcttgaaattctcagatacctagaaaacaatagcaaaaaaaaaattacctattttcagagagggcaaaagaaattgcacttaatgtagcaaggccataatttacccagtcacagtacaaactttccttaagtattggttttagtttcctttgatacatatggtttcaggccgggcatggttgctcacacctgtaatcccagcactttgggaggccaaggcgggaggatcgcttgaggtcaggagttcgagaccagactgaccaacatggtgaaaccctgtctgtactaaaaatacaaaaaaattagctgggtgtgatggcacatgcctgtagtcacaactacttgggaggctgaggcagaagaattgcttgaacccgggaggcggaggttgcagtgagctgagatcgtgccacggcactccagcctgggtgagagagagagactccatctcaaaaaaaaaaaaaagatatatatggtttcacatatgtccacttcttgaatctcatatgacatattggtaagcaggacagttgccttggcaacccaaagagtgccgtacaagatgtctatgtatactctaaaacttgccccagtattttattactgtatgagcttgttaaggaccagcaaattatttcaaaattggggatatagagttatcaactatagctaacatggaatagctgatttctgtattcgttgatttcaacaaactgtgcatattaaaatttagatatgcaacctgtggtgattcatgtctgtaatcccagcactttgggaggccgagatgggtagatcacttgaggctaggagtttgagaccagcctgggcaacatggcaaaaccctgtctctacaaaaaatacaagccaggcatgatgctatgcccctgtagtgtctgctactcaggaggctgaggcagaggttacagtgcgcaatgaccattccactgtactacagcctgggaaacagagtgagacaaagaaagaaaagaaaaagaaagaaagaaaagaaaaagaaagaaagaaagaaaaagaaagaaagaaacagaaggaaaagaaaaaggggaaggggaagcaaaaagaaaagagagaaaagaaaagaaacaaggaaaggaggggagggcagggcaggactgcttaggagatgggtgcaccaaaatctcactaattaccactaaataaattattcatgtaaccagataccacctgttccccaaaaatctattgaaatgaaaaatgtttaaaaaatagaaaaagaaaactcattcataatccaaaaaagaaagaaagagtctcgccattttgcccagactggccttaaactcctaagctcaagtgatcctcccacctcagcttcccaagtagctgagactacaggcttatgctaccatagccacttcacaggacaggttttaagccaatcaaatctgtccagagtcatcttaatggaaatattatattaattattttctaatacaatttgtaaacctctgtatttctaaaccaaattcttaaagactccttaaattgtttaaaagatctaaatgtttctcttcccttcttatcttgtaacctagtaagccaggcaattagcttaacgatcagttaaacctttttttccccagagttgtgttaaaagctatttgcaacaggaacattcttcatgagagctcattgacttttctccctctttttgtgttagacctatgtatctgaactatctgggtgtatccataataacaagaattgagttttgatcaattaatagattaagttttctagaagacagagaaagaaagtgagatgattaccacaaatatgtaaagagttactgaccactataaaagtcaaatcaccttctctttgcaaagagtgggaaagccttaaatgcaagcaaacccatttcaatacatgagaaagaaaggaagtcattacaaccagttcaaatagtatcttgggcacttgataattccatcaagactataggattaattaagtctttaaaagtactttcaagtgaataattgtagtcatatcaaaagtacttcaaaatgaccactgcaattccaggttgtccttgatgaaattatgctttttagaaagataaatgtgtgaaagagaaaacagaagccagagttatgcctggagatagtgcaagtttattattaaatgaacccatgaattcattagctactggtcattcaaaagggaaaaatagcacttaaatattgtacctaaagtcctcaacagtaaaggttgaacccctggcagctaaccctgaaacctaacaagctagaatgggtagagaggaaatctctcccaaagccagtttctcatagacaaaactaagaaaagttcttataggcacacaacaatgtggccaactgacagataggatggccagtttcaaatctttactaagaaaaacaaaaattagtataaatccaatcagataaccaaacaattctggaaaccttataacaaaaacaatatcagctgtctttgggagttcagcaaaaaaacgatcagacctcaaaacaagggctggagttaatctaagcatcatagacaaggaatctgcccaagcaaaaaggcagaagagacctcactgaaatacagtataaccaataatataactggtggcaagagttcctgcctaagtcttggtaggattttcataataccaaaatcctaatacaaagaccaccagggaaacctgttgatcatacaaaatggttatattaaagtttctgagaaaaagaaaacatcaccttgacaatgttggggagggaaaaataatttttcctctacccttgtgagttcttacctgggacctctataaacgatagattaacaagaaaaaaagagaagttagttaacatgtatacctcgtgtatatatgggacatacccaagggaaaattagtaactcctaaagtgatggctgagaagtctggcttaaatagcatcttcagcaaagaacagtacattcttagagaagtgatgagacaaaggaccttgagtctctagggccggcaatttgtgggaaggcaaatatatgggaaactaatgatagattaaaggctagttaataaagtttgatatataaattcctctggcgccatctgcaggctgataagtgtccaaagatttatccctcgggccaggcgcggtggctcacgcctgtaattcaagcactttgggaagcctaggcgggtggatcacaaggtcaggaaattgagaccatcttggctaacacacggtgaaacccctactctactaaaaatacaaaaaaattagccgggtgtggtggcgagggcctgtaatcccagctactcgggaggctgaggcaggagaatggcgtgaacccgggaggcggagcttgcagtgagccgagatcgcatcactgcactcactacagccagggcgacagagcgagactccgtctcaaaaaaaaaaaaagattcatccctccaggggtcgcggggggagttacctttcttaatttatgtcctacttttaggcaaacaggagaaaagcagagagcgtttcttatatttttcttctcaagtgccttcggctaaaaaatatttgttatgctggcatattttggggtagtatattctgctacccttcaacagagtctcagtggtgtttcacaactgggaagtcataagatttttatgagggtatttataggattttgaggactagggttggccatgggatagttttaaggtagaagttattaagcaaagtccgagcagagattggtcggaatttgtaaaataggtgaattggtggatcacagtcagtcttatcttcagagcatatgaatccatgtggaactactgttaaaacaagttgtccatgatcttatcttaaagtatatggatctgaacaagcttgtgttaaaaacaatttatttcaagttacatgtcctggtttggtacagtttagctgttatgcaaataatggtatagttttgcaagttgatgtttctgttttatttctcagaaggaaatagtttgtaggcaaggcagccaattataaggctttcacagaaattcagacataatgtaatgaatgtctagaattgttttgggaggtagtaaaagagtgaatgaaaatgtagggtcaaggaagagatggattagaatattcttaatgattgaggcttttgggaagagtgggctacaaaggggaaaacaaagttaaatgtttaggccaggcgcagtggctcacgcctgtaatcccagcactttgggaggccgaggtgggcggatcacctgaggtcaggagtttgagaccagcctgaccaacagtagagaaacaccatctctactaaaaatacaaaattagccgggcgtggtggcgcatgcctgtaatcccagctactcgggaggctgaggcaggagactcgcttgaacccacgaggcagaggttgcagtgagccgagatcacgccattgcactccagcctgggcaacaagagcttgatgctgtctcaaaaacaaaaacaaacaacaacaaaaaagtttaatgtttaaaaagtgggaagatagtggccaggtatggtggctcacacctctaatccaagcactttgggaggctgaggcaggtgaatcacttggggtcaggagttcaagaccagcctggccaacatggcaaacccccgtctctactaaaaatgcaaacattagccaggcatggtagtgtgcgcctgtagtcccagataggaagctgtggtaggaagatcgcttgaacccagggggtggaggttgcagtgagctgagattgcgccactgcattccagcctgtgcaacagaataagactccatctcaaaaaaaaaaaaaaagaggtgggaagatagtggtaccattgataataccaaaaatgggaaattgaacttggtgacttgatatggagatgatgggttatgttttgttttacctcatatttttttcttttgaaactgtaataaatttcagacatcattcccaagatgactggaagtataacagaaaataagattcagttttaaaaggaaaaattgtgagtttattctagtatatttagccttatactcttccatttaattctgtattgttttatttgaaattatttaaaatacactgtaaatcccacaccctcatttaactagctattttttcgttatgtcagttttacagacaaataatgggttctccagtgatctctaattttccgttatttctggaactgtttgcagcaaaataacagagaggaacataaatagcaaagaaaacaccctgataacagaggaatcttacttagttcgtggtcaataccctgctttgaaaaaaatgatataatcacacatttttctttctaaagcaactagtttgattaatggagttaaagagctgcaagccttgccccttataaaattataatcactttaataactgtgttaattaagatcagaaaattaatctatgttagcattgcagtagcaattttccaagtactgccagggagtaagaatgaaagtgggttacaatgtcacatggcatctgattaagttaaattagtaagtattcgaagggaagactccctggtgacactgaataagatggtcacagttttcctgtagcctattgtaaggggacagttggttgcaaagctactacttttccaatataaagtcaaaaatctggccacatactatcactaatgagtctgaaggaagattaggacttgtggttattgtctgggagaattcatataataagctctggtgttggccatattagtagctaaaacatcttaaatgtgcaggcttgcctttaacctcctaaaataatagtccaggttttctcacttcaagtaagtacttctttttttactttataatttctgaaatcaaagcatatcttaaaactgatacataaattgttgtaagaatgtatctgtgtatgtgaaggaccccctactcttaggtattttataatctaatagtctatgttcacattataaactgatgtcatctgtactagcatctaggggtaacaatatgagaacaattgggaggaaagtaggtgatcctttgacgtcatatgtcataaagaaaggaaagagaatcacatttattgtacatttatctgcataaactgaatgttcattatctcactcctaacaattaccttgcaaggtagttattattactatattttataaatgagaaaattacgacaaagaattttgtcaacttgaatttgaaccctgttggaatccaaagctcttcctactctacaatctgactacctcattggaacatcctaaggtagaataagcttcgttaattttcttcgtagacatagtagatattaaatctctaaagattaattcagttcagaataatggaattgtgcatacatgtagctaagtattacttaagtttgctagtatcagagacaaaacatctgtcttcctctccttcacataagcttagcttctttgatactgttgaccccacttcagaaaagagacaaaaaagtttgaaagaaaagataaactattattctgttcagacttaaggatatcatgtcacacaatctatacctcaaatattcccaatggaagacaaattggaaaataatattgggagaaaaaaagataattgttttatttagtttggccagtatctccagagcattattatcaaattggagcccaacctggtgggatattttgcatgcagttcaatcgccagtgaaatttcagagtgttttttgacttccataggaacattttctcatcctcctatactttcaatatttatttaaagatcctttgggcattcaccttcaaaatgccagataccattgtaggtgctagatatgctaaactcagtttagtagatttttttttcattagaaatatgcaacattaacctaatagaataatttgtggtggttttttggctttgtagctgctaaatcctgaagatgacctcttaccagggaagattcgagacagcaatcgttcaactcttctagcaacaattcaggaacatggttaccccacgatcaacttgggtattgtaggagacaagtaagtatttgatgtcattctgaaaagtttgtattgtacaaatacgagtttttggaatactcattaggtggagttgctgctaaagagacagaaatttaatgtcataattttcacttatctcattcttcagaagccaaagaatattgaggtatctatgtcctttagagataaagatttcttggaatgtctctgaaaacaagagaaatactttactttcctgtagtatgttaggtttcaaaggatgtttttgtaatagttttggttttatcccaatggagctaacagtgatggcattattctgatgcacatttttacttctttcaagaaagacaggaaaagcataggtaagaagagaaagagagattgtcaaaagtagcactacctaattctttgaaatttaagtacaatttttttctaggacttctatattgatttttgtgtctttatgtaacctgtttctccaggctttacctacttgaaagtacaaagggaagcacaatgactataattactcaatttttaagagcctattacccccatctactgaattaactcagccctctgctaagttttctaagtatttctgtgaatctccagtgctgtctcatgtgtgatcaaaagcaagtctacactttctaaacatcctagtatcatgcaacactgctgcctggctgtctttcaaaagtcaccctttccatttcactagagctacacctgcttttagtaatactcaaatatcaacccaatggagacaaggctcagagacagatctgagtgataaatactcatgatgtatctatcacccataatcccctttctctcttatcactacctcatcactgtgtagacctcattaagcatggatccttcttcccttatgttgagtactttcccaaaactcagatgtgcttttgaagaggttctgacctaccattcacaaggtaggatctgacaaggcatgctgtgaactttatcttaggctcacactggacatagtctaacctaagcttgtccaggccaggcacagtggctcacgcctgtaatcccagcactttggaaggccaaggcgggtggatcacttgaggccaggagttggagaccagtctgactaacatggagaaaccccatctctactacaaaatagaaaaattgcctaggtgtggtggtacacatctgtaatcccagctactcgggaggctgaggcatgagaatcatttgagcctggggggcggaggttgaagtgagctgagatcgtaacactgcaccccagcctgggaaacagagtgagactctgtctcaaaaaataaataagtaaacaaattaagcttctccaacccgtggcccatggaccacgtacaacccaggacagctttgaatgtagcccaacacaaattcataaactttcttaaaacattatgagatttttttgcgatttttttttttagctcattagctatcattaatgtattttatgtgtggcccaagacaattcttcttctgatgtggcccaggaaagccaaaagattgaacacccctggtctaaaccttggacacaagcatcttgccagtaacctgaaaggtagtagcttttatgtcatctaaccttttgaagttctcttctttcctcctgatttttttttctttctctgaggacactggagtggaagctggtgtattttcaaatgtcattctttttaaaatcttcaccatttgtatttgcatggatgtttagctctaaagaagtttggccaggagtggtggctcacacctgtaatcccagcactttgggaggccaaggcaggtggatcacctgaggtcaggagtttgagaccagcctggccaacatggtgaaaccctgtctctactaaaaatatgaaaattagctgggggtagtggtgcgcacctgtaatcccagctactcgggaggctaacacaggagaatcacttgaacccgggaggtggaggttgcagtgagctgagactgcaccattgcactccagcctgggcaacaaagcgagactccagggcccctcgtcctaagaagggaaagtaaagccagtgtacaggaaggaaaggggggaaaaagccagttatttgaatttgggccttagcagtaacctatcctttaagatacaagtacttaaaaactatcctatccagatacagcttttccaaagaccaaaatcaacttctgagaagagaagtgataaatccaagagtttgaaaacacaaagataaggcaagcaggcttgaaacttcatggaacaaacaccagattcttagggttatttccctcctaccaatggctctggccctacctctaagtgcgttaatgagctctaagaaatagtataaggaaaaagggagcttttaaattgtttttaccctaatttgttctggactataattctgcccattctccctcttactgttatacttttttttttaaagaggttacttaatatactgtatatactgccattatcttgaagtactctaaaggccaaaacatcattgaaaggccaacatgttggtatgctgatatttttctgggatccacactgttaatttgtggtggacatttcctaataatggtgatattgcatttaactccaaaatatactttgaaaacagtataaagaacaacaaaactataaacaggttaaggcaattcagtgaatgtacaaatctctagtgtatacccttttcttgaatagtaataccttatatcaaactgagaacaatttaaaaaaaaaagaaattgatgcaaatctaggctttcttagtcttagagtgctatattgaaggggtccagagtgaatggtgtagaatgcagaggtggaatgtgggaggaaagaatttataattgttctaatggaaatctgtgctgggagtttagcaaagaaaacaaggtatttaatctacagcctattgatattctgtgaaggctaccctccttcattcttcttcatcctattcagccatttgctaaggaaagcaaatattgtcacacagaagcatctgggtaaagctctccagggaaacaagcagagtcatgggagaaactgtaccctaggtttaaagcagggagagaaatagctcaagaatgtcaataagggcgaggtgcagtggctcacgcctataatcccagcactttgggaggccaaggcgggcggatcacctgagatcaagagctggagaccagcctgaccaacgtggcgaacccccgtctgtactaaaaatacaaaaattagctaggcatggtggtgcatgcctataatcccagctacttgggaggctgaggcaggggaatcgcttgaatgtgggaggtgggggttgcagtgagccaacatcgtgccactgcactccagcctgggtgacagagcgagactctgtctcaaaaaaaaaaaaaaagtcagtaagcacagaaccttactcaactatgacagataagggtagagagtgacagctctatttgtatcattaaaaaaggtttgagtctggtttttaaattctatatgattctatttctcagctcttattcttatcacctgccataattttgacaatcaaagtaaaaatagaagaataagactttgtagctctttgaagtgagttggactaaatggcctttgcttactataccttttattttaaaaggttaatttaatagtactatgaagattactggagggatgcttcaaatacctgagaattaacaactgtatttgaaaatcattcatttgtaaacattatatatatattaaaatacatttcttgttttctcacactgtttggaacacagtactgttggagttcctatagtctttttctttaaagagacacattttgaaacccagagatattaagtaacttgcccagcattatactactagttagtggcagagataaaaatggaatctaaatttcctgagattgacaatccataattctctactatcattataaagacaagatattgtatacctgtgtactactgtgggctggattggtcagacagagttttataaacctctagtttcaagctagaacttaaaagaatgagtaggatttagataggaaaagagagtgtgttaatccaagtaggaaactgaatgcacaaagtagagaagtagaaacaaatagtgtctagagaattagaaatgaacaagagattcaggtagaaggataagacaggtaaattgagtagaaatttgaaccagattttgaaaggatgtggagaaataggaacacttttacactgttggtgggactgtaaactagttcaaccattgtggaagtcagtgtggcaattcctcagggatctagaactagaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcctgtcctttgtagggacatggatgaaattggaaatgatcattctcagtaaactatcgcaaggacaaaaaaccaaacaccgcatgttctcactcataggtgggaattgaacaatgagatcacatggacacaggaaggggaatatcacactctggggactgttgtggggtggggggaggggggaagggggagggatagcatcgggagatatacctaatgctagaagacgagttagtgggtgcagcgcaccagcatggcacatgtatacatatgtaactaacctgcacaatgtgcacatgtaccctaaaacttaaagtataataaaaaaaaaaaaatggctttgcaatttaggctgccaaactacccaattcagttaaatttgaagtttgggtattttttggtttgtttgggtttttgtttttgtttttgttttgccgaattgacataaaaaacaattattttaaaaagatcaattgacctagatttatcatataagctaatgatggagactggaaataaggagaacaatacaatttgtttactcattgtttaatcagtcaccaggaagtattgattgtgtacctgtgagtcgtctggagatcttattgaaaatgttgattatactttaacaaatctggggtgggctgagattttgcatctctgacaagctccaaaattataccaaactgcaggtctgtggaacacaggaagtatcaagaatatagtaagatcagtcatgcgtctgctatgaattttaagccaaaggctatggaagatacaaaattgaaacagatattgatcttacttttgaagaatcacaaattccaagcagtaaaaatattttagaaggttccagaacttaaactcaaatttggaactataagaagaaagagattaaataaagagaaatattgaagtctattatgtagaagagagcagtgtcactgttgaattatctttgtctggattacaaagcctcaaaatggtatgtgtatgtaaacacaaaatgcctggaaaagcaagctgttaggcctctttaccacaattttatattcctgtgtagcaacatactatttccatgtcttcattctccactcaaaatctattatttcttggcttttatagctctttttgctatgctcattcccctaaatataggtctccccgtggcttacccttggctttctgtccttttcattctgtatgctaatgactgactaccaaatcttatatccccagcccaaatatgaaactagtaaagcctagatattctgaattggcacaaatttatgtgagtttatatacttttaagcacaaccctatttctacttttttttttttttgagacggagtctcgctctgtcgcccaggctggggtgcagtggcgtgatctcggctcactgcaacatctgcctcccgggttcaagtgattctcctgtctcagcctcccgagtagctgagacgacagacacccaccaccgtgcccggctgctgtttctacttttttcccaaaatacattttatttgaaaaaagcaagttgcagaataacatgtttaattttatctcacattgaatagcaactgaacaaacatatatttataaatatggtatatgcatgggaaggtatttatatgtagaaataccctatacacccaagtgttatttctagtagtaagagtttgcatatggggtagaagttagagaattaaaagtgatggtaagggccagccactgtggctcgtgcctctaatcccagcactttgggaggccaaggcaggtggatcacaaggtcaggagttcaagatcagcctggccagtatggtgaaacgctgtctctactaaaaatacaaaaattagccgggcgtggcggtgggcgcttctaattttttttttttttttgagacggagtttcgctgttgttgcccacactggagtgcaatggtgcgatctcagctcactgaaacttctacctcatgggttcaagcgattctcctgcctcagcctcccaagtagctgggattacaggcatgcaccaccacacccagctaatttcgtatttttagtaaagacagggtttctccatgtttgtcaggctggtctcaaactcctgacctcaggtgttccacctgccttggcctcccaaagtgctgggataaaaggtgtgagccatcgtgcccagccacttctactttttttttttaatatttctgaaatacttgaatatttttaccctgaggatatactgtatttcttttgtaataaaagaacctcctaaaaattccccttatgcattattaaaaatttggtggaccagtattgacaactgtaatcaaactttccaaaacggacaaaagaggcaagcagctcatctaaggaatctgaatctaagtaagagctattaatactattaggtgtgtaatgccataaacatagtgataagtaggcaaattaaaaagaagccaaagtcttgctgcattttaagtaaaattataatattttgtaatacaacaaaagtttaaatcaaaagattatagaaaacatacttaaatgcaaaatcttaatgtctatattgactttgaattttatttctcatactattttgcaattgctcaaataataagacttgaaaatttagccatagtatatatttgtagaacttgacagataactaatgtaatagaaaccttagcctacctacattttgttttctccaagcataaaaagtatttcatagctatgttttgttttccagaacccatggtgataaactgttcatattagatattttcccccaatagatgataggttggcagcatcattgactagaaagaaagaaagaaagagagaaagaaagagagagagagggagagggagggagggaggaaggaaggaagggagagggagggaggaaggaaggaaggaaggcggagggagggaggaaggcaggaagaaagagaaagaaagaaagtctttaatgttacccttgacaaaatatcaactattttacctcatctagaattctacaaaataataatgtaatatattggctttgaattttcaacctctcattataaattctttttcttcattttcatgtcgttctttcttcttttgattgcacagtgcctttctattctttctgttcttttcactcaaatgcattctttatatatttacatattttctactttttaaattttagatgcaggggctaatgtgcaggtttgttacatgggtattttgggtgatgctgaggttttgagaaccaatgatcacgtcacccaggtagtgaggatagtacccaatagttaggttttaggccccttacccctctccctccttccctcctctagtagttcccagtgtctattgttgccatcattatgttcatgagtacccagtgtttagctcccacttacaagtaagaacatgcagtatttggttttctgttcctgcattaattcagttaggataatggcctccagctgcatccatgtagctgcaaaggacatgatttcattcttttctatagctgtgtactattccatgatgtatatgcaccactttttttttatccagtccaccattgaagagcattctatgtctctgctattgtgaataatgctgcaatgaacttaagagtgcatgtgtctttttggtaggatgatttgttttcttctggatatatacccagtgatgagattgctgggttgaatggtagttctcagttctttgagaaatctccaaactgctttccacagtggctgaaccaatctacactcccaccaacggtgtgtaaatgttctcttttctctgcagcctcaccaagatctattatttactttttagtaatagccatttggactggtgtgagatggtctctcattgtggttttgatttgtatttctctgtgattagggatatgttaaatgatcatatccctaaacatatgttcatatgtttgttggctgcttgtatgtcttcttttgagaagtgtctgttcaggttttttgcccattttctaagggatctaccttaaatatggaacagcagatgtcctagttttcttttccccgaggctggttcaataacctattagcctcctttagtcctcctagacagtgtgagctactgtaggggaagagttgaagacaaagaaatgtagatgggtaaataagtactgaatgctatatgtgctagccaagcagttgtggccagaacttagtaagatattggtcatttgagcacatatatttttctctgttactgctttttttttttcttttttctcagtttcctaataaatttgctttgagaagttgttgtcttgtatggcttaaacagggtggaaaaaggatttgtgagtattgggccagggttgttttctttcccaccagataagctccatgaatactaggacaaagtgtatgttggtaaacactatatccacagcacttagtagggatacattaaacagccctgccatcttttcctataccattctctctttccatgaaacctagaaactttcaattatacaacagtccagaagaatcttacagggccccttcaaagtaagtccaaaagccttgaccataggagcaggccagaaagtatggtactgacagtagagttgcattcctgagacacatccccaaaaaatgtacagtgtaaagctttgtggctgggtggttcattttatatttctgaagaaaagcatcttgggagaaattccaaatagatttagcaggcttttaatttaaaaaattgaggagcagctctctcaggcttgaaaagatcttacaaatttacttcttgaatataacaagcggtaatcattatccaaatagaatccacttggggaaatttttttaaataaatttcagcattaattgagtttatataattcctcaaactgattttaagtattgaataaggattcaactttatgacagctcagcaatatagcttctgaactgccaacttggaccttctagcctttcaaggcctgaaggaagggctgggaaattcccatcattaagaagatttcccccttctggaaaattgccatcacagaagcctgccccactcaaatcctgggcttacttgactatgtcatagattgatgttttgtatttgaactgcctcctcttgctgctgcgaatttgtgaagctacctctttatattaaagcaagaagcagaaggacaaatactgagatagaaaattgggttcttaaaaacctggcacatttagcaggaattatcaagatagacttaacagcacagtgattatttgggcaaagccgagtgccttacaacttccaatttgtgaaccaaacacatcctaatttttcattgcttacccaatgttcttaaagtaggagttttctaatcatcaacgataatttagatctgaatttaattggttcttgtcatttttataaactatctgctctccttatggcatgaacctccttttctgctcaaaatgcaaagttttcatttttgagtcaacataatagatttattttcttctttttttttcttttactcctagcaagctgggatagatttattttctgatcatttttcagcagaggtttctcattttctattggttaacaaagaacattctttctaccttaacaaacgtgtttaatgacgagaggttctttccgatctcagtgatagactttttatgtagctgttagagttgccctcctttatctttaagcgttgctattgcagttgacatttctgtttcttctatgaataacctctaggtattactgtagctttagacattgttttcctaccccaaactcataaaaagtaatgtcttccagaaagcctgtcctaattatctccaactaattctaatcattctatcccatttaccctttttgtcatttctttatattatatataaatatatgatatatattttttcattttaattaatgtatttgaattcaacagatgatattaatgtcattgcttatttcactcatttttctaactttttttcactgatgagttttctgcactagcttataaacttaaaggcaagaaccatgctttcttctttctttacatgactccatggtcccagaacacccagtgagactggaaaagaatgaaatgatggctatatgtgtagtatgtagtttgattccatacgtgaagtagacacccagaaaagatttgtagttaatgaatttatctttgacctctgaagaaactatgatatgataatagatgtcctcagctattttttgttaccttggtatgattaactgccaacattctttaatccacacatcctagactttttctctgtgtcatcttcactcatcttaaaatgatgcagcttgcagttggtgtaacagatgaaacaggaaactaattagcagctgttgtccatctgtgtgtttatattaaatattttaaaatagaaatgtatttgcattctgaatactgtttctgaaattcataaatcctaaacttgggtaaatgctgtaaaattcaaaaccaagacagagcctttaccatttatcttcatgataaagcaaaaataattttatgccagaatcaggattatagtaatttgaggcagatgtaaattttaaaaagcaaaaaaagtcttaacttttttaagttgctttggaattgagcccccaaagcaatcaaattgaaatctgaaaagatacagtgttcaaaagatgtcataccctctgaatatattctttcttcacagaaactgatgagtacatacacttttgagaaagctgcattcattctctgacagatttattttgaaacatgctcctcctttctctttttctacctttctattaagtgcgtggttctttgacatgtgatcaacttagaactctacagagagtgctattaatattggtagccatcttccaagttgaagatgaatgtcatggctttaggaagaaaagataccgttattcatttcactcaagtcaaataggcaaatgtttcttatgttcaaaaatgaaagggagaagagtattatctacaagacaagtatcaaattgcatcagtcaggtcagattggtgtttccctctatgcttcagtttatatgtgaaaagaaaatagtcattgtgtttatgtaactttcagtatttccatagaatcacagtatcttattctgatgttagctagtccagactttcacccaagggggtgttaaggaaaatctgcaacaacttagctgttaggtttttgtttgaattcttttagtgagaaagatctctactgcctcatgaggtagcacattctattgttcgatggctgttaaagtaagtatgtttttccattacacagagccagtctttcttcctgtgtctttcatctgttagccctaattctgccctccaagcaatgccaaataagttggcttcctcttttacatgatatttgaatatacagttgtttcaccttaatcccttctcaaagtactgtttatgattatatgtttagcagtatcttttctttcatcccagacaatattattagcctatgatattataattgagtaactaaactatttactcccaaagctactgtggatagactgacttgaaatcaagtttcattcagcccatttactgagtgcctacaatgtgcaggaatttggtgggacaatcaggaagtctggatgaaatgagacgctgtcttgtgagagagttgtatactgctgcatcacctttacaaagtttccttttatcacaatttgttgtgtctctttattcttttttttaacatcaaatcccgttttgacattaatattactactcctgcttttttgcttatttacatttgcctggtgactttttgccctacttgttattttctttctttctttctttttccttctttctttctctttctctttcttttttaatttttcttttctttcttttttcttctttatctttcctttctctctctttctttctctctttttttctctttctttctttcttcttttttttttttttttttttttttttgacagagtcttactctgtcacccaggctggagtgcaatggcacaatctcagcttactgcaacctccatctcccaggttcaagtgatcctcctgcctcagtgtcctgagtaacgggcattacgggcacctgccaccacacccaactaatttttatatttttagtagagacagggtttcaccatgttggccaggctggtctcgaactcctgacctcaagtgatccacctgccttggcctcccaaagtgctgggattataggtgtgagacaccatgcccagcctagatttagctatattttttataaaggactgtgtgtgtgtgtttcactactgttttctctcctccaacttcccctaccttgaagtctatgttctgaatcattttttcatttacagtcatttttccagaacattacttggtgatttgtcatctgaatctttgcattctaacaagtatcattcttccattttgattagtgaatgactggatgtaagatttgagggttgtatggcttgaagagatatgttgatgttaatttactattttctagtttttggtattgtaggtaagaagtccaaagccaatattactttttcctttgttagtaacccaatcttcctattaaatatttggtagcttgtaagattttctgtttatttttgaaattccaaaattgtaccaggacatatttaggtttatgtttttgttttgcttttttttttaaatcaatcttggctggaacttagtaaaccttttcaatttccaagtccaactcttctcaaataaataaaattttcctcttttcccccctatctcttcctttatttccttatggaattcctattggtagtatgtcagtctcttgctctgtcttcttattattttctgcatgacttctatcttttgcacttttgcacaatccttggagatatttctaccacttgatcttccaagcaactaattgaatttttgacaaggactgtaattaccttcatctactaaatcttaaaatttgaaaatcacatattttgttccagaacacagtgttaatgtcataattgaatctgtattagtgttttaattgcttattattgttattaaaattatctattgccccagaagttttatttctctaggtatcctaaatattatgctcattcttccactctccagttggttgttacttaggttgctggtattttcctctccctactgaaagttcgattcaccctaagggttctggaagctgctagggtactttgggcctggtgagaatggagttacagtgggaaagaggatcatgagtggcaaaaggaagagaagtgtcaattcctgaattagcaaagcacaaaatggcaagctgctagtcttctattaaagtacaaaaaataaacagtccaagcctctgtgcttcctggacggttttgttgtgaaggctggactttcccagcctttaaaggatagggcagtcttagtattttttcaagtagacttcagacttctgggtcaacctaaaaaaatttatagctttgcccttgatctggatcccaaccaaccacaaattcttagaatcagtgaatgttagagatgaaaaagacatactccaaatgtcctcattttatagataaagagaataatacccccttccccaaaaaaatgatactagtttttcaggatcatctaggtagttagcagtagagataaaacaggattctagactttgtgacactcaggtcttcaattaatggctttatcttctgttgcctagtacatacattcttagcattaaagcaattgtcttacagaatgttttcatgtaatattggtactctaagagaacaatggttaggtatttaattattcaaatgaaaatgaatgggaagtgttagtaaatcaagattcatgttagtattagaattatttttggctaggcgcagtggctcatgcctataatcccagcgctttgggaggccaggagttcaagaccagcctggccaacatggcaaaactctactaaaaatacaaaaaattgccaagcatggtggcacacacttgtaatcccagctacttgggtggctaaggcacgggaatcacttaaagccaggaggcagaggttgcagtgagtagaggtagcgccatgcactccagcctgggtgacagagcaagaatctgtcttttttttttgagaaggattcttgcactgtcacccaggctggagtgcagtggcacgatctctgctcactgcaggctccacctcccaggttcatgccattctcctgcctcagcctcccgagtagctgggactacaggtgcccgccaccacgcccggctaattttttgtatttttagtagagacagggtttcaccatgttaaccagaatggtcccgatctcctgacctcgtgatccacctgccttggcctcccaaagtgctaggattacaggcatgagccaccacgcctggctgactctgtcttaaaaaagaaaaaaagaattatttttcggccaggtgcagtggctcatgcctgtaatcccagcacttttggaggctgaggcgggcagatctcttgagcccaggagttcaagactagcctgggcaacatggtgaaaccctgtctacaaaaaacacaaaaaatattatccaggtgtggtggcgcactcttgtggtcccagctactcaggaggctgaggtgggaggatcgctttagcctggtatgtggaggctgcagtgagctgtgatcacaccactgcactccagcctgggtgatagagtgagaccctgtctcaaaaaaagaaaaaaagagatttatctttaaaggaatggctaagcaccatccaaattaaattaaaactgcagttgttaatgaagaaagatttaagtgatatcatgatatccctttaagatatgccactctttgtgaaaagggaaactactgatatatacctagaaaacttaatctgcttaatccaatagcccctctagtggcagtggtgagaataagtcaaattttagaagtacaaattttgtttctatcagtatttggtatatacaaataagatttatatatttatataaatgctgataaatagcttttatctgaaggtgttttatgtgtaacaaagtgtctttcataatgcaaatattactatatttagaagaagaatagagaaaacacaggatgagtttgaacctaatactacctatgtgaacctcagtgtcctcttttgtactgccttcctcacagagttgtgagattaacacataggtgtgaaaatgtattttttaaaaacattagtattgtcattaattatatttcttggatattaattgatcttatatgtgggaagttctgtcttaaatataaggtcagattataatgttttgtagttttagcctcctatcattgagaaaattaatataccctgcttgctttatgtgagaaaactgagaaaatcatgaactgttttctctctattatattattcatgattataacccttgttacctatttcctcttatcactattcagagtaatctttgagttttagaaagaaaactcagtttttatatgttaaaaatgaagagtctgggggaaggaatatgaagtaaatattggaaaatattagcatttgtcaaatctgagcgatggatacatgggtgtttgttatactgttatgttggaaatgttttataatttaaaatatagcatgaatcataaaaaagaaagcaaatttatgatgtgaataggcccttaagctatggttaaccaaaatcatagttttcatctgaacatgggattctgaatcatgttcatttcattccacagagtgatagtaaaatgttcacacatgcagttttctgctggttacctcagacaaatccatacctcttgccacagcatcctctcctttttttttttttttttttttttttttttaaattattaagagactaggtctagggccaggcacggtggctcatgcctgtaatcccagcactttgggaggccaaggtgggcggatcacttgaggtcaggagttcaagactagcctggcaaacatggtgaaacccatctctactaaaaatacaaaacattagccagccatggtggcggacatttgtaatcccagatgcttgagaggctgagacaggagagttgcttgaacccaggaggcggaggttgcagtgagccgagatcgcgccactacactccagcctggtcaacaaagcaatactccatctcaaaaaaaaaaagagagagagagactaggtctcactacatcacccaggctagaatgcagtggctattcacagatgtgataatagctcgctgcagtcttgaactccggggctcaagcaatcctctcacatcagcctctcaggtagctgagactacaggtgtgccaccgcacttggccagcatcctctctttctgatgattctggacaagggtccgttctcattagactctttcttttatggtatattacatgcctttaaaaaactacacaatcacttctgattaggcagggagtggaacaagcatttaataagaagccagagtttgtagtcctggctctgccatttactgctctatctacactttgcctctctgaatataacttgccttttcttaaaatgagcatagtaataccttttcagtctagcatacagatttgttgagagattatagcatgcaacataaatgaagttatagatcccctggctgttgtcatatgttggtacctgtctctctagtaaggcaggatgtctgatcaaatctccagaagccagaagcgtacaacagaaaggagagttacagagagtagcaaagggggatagagtatggcaggacccaaataactggcccagcagtgacaatggacaagataacatttacaactttgagattcaatgattttgtgaatatactacccacagagtacaaagtatcattgagcatattctttgaaacatgataaatttcagtaaggatttggaacaaaatccctttcagctgatttctgcaaattagaaaatttcatgtagagaattgatgtctctgaggtttcacaaaataggaaaaaaacatgtttcccagataacatgaaaataatgagtaaggctggcacggcggctcacacctgtaatcccaacactttgggaggccaaggcgagcagatcacctgaggtcaggagttcaaggccagcctggccaacatggtgaaaccctgtctctactaaaaatacaaaaattagcctggcatgttggcaggcacctgtaatcccagctccttgggagactgaggcaggagaatcgcatgaacccaggaggcagaggttgcagtgagccgagattgtgccattgtactccagtctgggcaacaagagcaagactccatctaaaaaaaaaaaaaaaaagtacgataaagcactgaaaagtacttatttatagtaatcagctaggctccagaacctttatccccctacagagatgaataccatgatggtgtgcatctcactgctgctttgtttacagtagctttacaataattctatagaatcaacatattgtagttatatattacaaggtttgtaaaattagctaatatctttttctactaacataaaattatatttgttgatagtattcattacccagtcagtattttgaaccacattccatgtgatgctgtgtttgggatgttttttccatttactccatagtaaatgaggaaccattggcttagcataatgataatatgatccagcaaggcaaggagcccagaactctgggcatcaggaacccatcacatgcatattgtgtagtatttcaatacaacagaataatttgctgtcttttttcctaaatcgaaatgaaaaggatagatgagaaatctgttcaaaatacataggtcaaaaatacgttaagtacaacattattcaaaataattctgagatgtttgcccaactagtttaactttgaaatttatgtcagggtttttttttttaagtctttaatgttttacacatagattctaccttcagttaatacctgggcacttttttggctgcctatgcaatgactgactgaatgactttaaagggtctctatgttggtaggctgaaccttatatgagccatttttcaaacttttacttttggcccttctccttgggagcttgcttcccagagtcagagcttgtggacaggccagtgctagaggaaagggagaattttacccagaccctgtaagagaacctcatagtaaatgaagctattcaggttggaaccaggcctaccttgccatttggacctttcatatttagctctgtgaatgtatttaagtcccagtctatgattttcttgtgtgttactcatgagtattttccagaataaaaatcccaagcatgctatagtcgaactttgccagtttgttgggtatgtttgtgtgattaacttgttaacatagcagcaatagtaatgacatatgactttcttgaaaacctagtttgttccaggtactattccaagtgttttatatgtattaataggatgtcatttaatcctcataacaaccctattatggctactttacagatgaaaaactaaggcaaagagaagttaagcaacttgtgcatggttaaacatctagcaagcagtggtgctaggatttccactcaggcagtctgactccagagttcacattcttaatctctgtgctatgccacctcctgactagcttatctcttatagagtctgtgaaggttgtgtctctggtaggtctcaagttctgcctacctctgtcacacctggataaaaattgaaattatatcctagttacaaatcatgctatcttgagtcactaactttccttcttcctctctcatcaaatagtgcattaaggtaagggggcatgaataaacttcactgccatgagatatttgtgagaacatatgctgtctcgttgagagatcatttgttttcaagttaacaaaaacctgctgaagctagtgcaagcaaagaagacatttatggaaggatacaaggttatctcatagaacccaagagcaagaatacagctgggcctcaagggggatgaaaggcaggtagccagggttactccctttttagttgttctcattagatgtccatagggaagaaagggaaaggaagagtcaggcggtataaataggtaagaatttttcagacaacaagagtatggctagatatatactcctcaaaaagtatattttctgtactgcatcaattgaagggaaataccaattacaggtcgcattgcccagtagatttgtatggatttaaagtaataactaaacaatccctttcaactattcccaatcatcctgtcccttcataagtcttgattcttggcattttgtttattctcacttgatcagtctcaagttaggacttttcaactgttctgacacccaaagataagacccctgttttcatctcttctccccagaccttcaacctgtaccatcaaagagcctgttgcacttgccttttcaagtgacagtcaggaacctgcctagcttccattcctaatattaatatcctatatgagtagttcataccatctctgctttccttgtccttttccccctaccttttctcttcccaacattatgaatacctactggcttttcctatttctagggatcctcccccctccatttcctattagataaactccaaattcatcagcttgagggttcttcaaaatcatgtcccatcctaactgtcccagtcattcccactcaagtccttcactctaagcaggccattttccacagtgacctagaaacagcacaggcttaaccattattccaagcctttgctagtacagatcctcttgattacaaagctctttcccattcctttcctttccacctctctgaatccagctcatttctcagggcctcacctaagacattctctctaaagagtcctatgtgatctttccaacacctcaggtaaccaattgtccaggattgccttggattcctaggacatctgactttagtactaaaacaggaatattcctaggcaaaccaggatagttagacatcctccaacatctcattgtctcctttcattatagtggcttgttagaataaaaagccctgtgaaatcgccagtagccactacttcagcatgtacaaggtcctttctccataataagacttaatgctcctgttaggcagagacccttttgattcccacttcatacagaatatagtgctgtactcatgttaatgcctattagtgaataaggcgatgtagttttaagttggcactatatctaaaatcttttccttgtgtgttaatttctttgtctttatttttttccagcccagatgacttactcaatgccttgaatgagggtatcagtcgtgctgatgtcatcatcacatcagggggtgtatccatgggggaaaaggtatgaaagatagggctcgtgaaaatgtatctgctgtaatgttcttgcatatggtcgattaactgtggtctggtaggcatctgatattcataacgaggctcccacaaagctgaaaatccatggggcttcagaaattactggtctctttaaaagggatacaatgtgggtaggtcagggagcttaccctcaggagcaacctggagaatcccacaacttacagaatggtttttgctattcctgtggaaacttctgacctgtttctcactctattttactacattaggacatcctttatgcatgatatttaccaccagggtaaaactctaagatccttccttctactcaaatttaaacatgactccccaggagccaaccaattcacccaccatatattccaaatctaccaagaatgcttagctccccttccccacaaggaagaaagggaggattaggcattccttttgctcctccttacaaaataatataataataataatgaaaatatggccaggcacagtggctcaagcctgtaattccaatactttgggaggctgaggtgggtaggttgcttgagcccaggagttcaagaccacctgggcgacgtggtgaaaccccatctctacaaaaaaaatccaaaaattagctgggcatggtggcacgcgcctgcagttccagctacttgggtgctgaagtgggaggatcgcttgagcctgggtggtcaaggctgcagtgagctgagatcacaccactgcactccaacctgggcaacacagcaagaccctgtcttaaaaaaaaaaaaaaatatatatatatatatatatatatatatatatatatacacacacacatacacaaatattttataggactaagtgtatttgtagatggtatatacttgttcctataaagaccacaatttgaatatttcagtaacactaagtttacatttcttaatgaaatgtgttagtttacgatgactattgggtctactgaataatgttataaaagtaaaatattgtttactaaataaccaagcttaatttttggctcaaagatatttcagtgtaaaatgttttgccagctgataatccttttccatgttttctctcacattaatgactaaactgaaaaattacaaaaatactgtcatagcaatttttaccaaaattcatattttctaagagtttgatttattttaaactagatcttacgtatatgattgttcttgatctctgtcctcttgtagctataaaactgcctaaatttataacctgactctttggacagtgaactctgttggctcggagaacaaatgtcagaacttagcaacctgaacagaagaatgcctgccttccattcacaaactttagtgtcagagcctttcagaatagcactgcagatgctaaaaagtttggaagaaaaaaatctcacattacatccaggagtgaaagtgttgtagtgtgtgtaggtgttcttaaagcagacaaattgctggattagtgttccctcaaagtctcccagagtctttagccccaggtagagcaaattgccgcagagctctcctgagatcacaaaggctaggggctgagatctgcactgtagtacagctgaaagaaataatttgcaacttgtctgttttcattaccatcaaactgcctgtggtactctcaatattacaagagcaaaccatgaagtcaggtctatttaaatgttaaatttgttatttccagggtttgtgtcttgttataatttctcttagtttctgattaacctaattgtgggataatagctatttggcagaactaaaacgtttatcttttctagtactctggagaggtaacaaactcatagcatacataggcttggcaattgtggctcaattgtggtaaggacagaacacttctcaacctaaccttctttattagtgctaacaaagatgtcagttatgccagggatttgctcaccagtaaacaaagccaatatagttaagcatattggttttattttttttactctctgtataataagatacttacactaaacctttaatttactaggaaagaaattttagaaactgggcatcccacggtattccttaggagctgctaattgtcccttcctacctccttgagtgggaatgagatgatagaggaaccaggaagaaagagataaaacatacatgcagcaaattcctgccagcaaacaagttttaattccaaaaagaatttagggtacctccatagtagaaagaaaataataaaagacagaacatttgcttcagcccaggagctaagcctgaaaaccagttactaaaaagacagggaaatcaaggaaaaattcagaagtattatgtagcaggcatgaatattaagtgcagaacctcaggtatgcaagaaatgtatttaattccatttaaattatactctaagtgcctatgctacaggactggtgggaaattttattaagccacaactggagcttactatctccaagaattatgacaaggaacctgaaggtacttaagcagcaccaaagcatcagggagacacagctggtcactggtctgcactggatacatctagagtattcttatagtaccattagatctcaagtctttgctcctttgggccatgctaggagcactaagatcaggtagaggctggaaacctcagagcagctagcctctttgggtgtatttcacagccatcccttctaaagtctgaccacttctccaacatactgcatgctaaacagcgaggaaggggccctgctgcttgttggactcatagaccagtaccttcttcccagccaaggagaaatgattcttccacagttacttccctaaagatctctcccctccttcacctcaccctgccctacatactcttttcaaagagtttcatttttacaaaacactgaaagcttgttaaatagttaaacagtatctgccttttgccatgaaaactaaagaatcatatgcattactataagttttcttcgacctacaaaattattaaataactcaaagacaatgaaaggtggcaataatccagaaggatgcactaaactggacaccagtgaccttttttgctcatttctaagtctcttaagttttgctaatagtgtctccaccaccccttatgatcaaagtaatcacatagatgataaccgatcacaaaaaaggctggtttcatgaggtttgcccagttatttagcaataagagtgttaattaaccatgtaagctccttgatttgttttgtaagtctagagccatgtagccttagaatatttaaaagtaattggctgggcacgttggctcatgcctataatcccagcactttgggagcccaaggtgggcagattgcttgaggccaggagttcaagaccagcctggccaacatggcaaaaccccacctctactaaaaataaaaaattagctgggcatagtgacacatgcctataatcccagcttcttgggaggctgaggcacaagagctgcttgaacctgggaggtggaggttgcagtgagccaagatggcgccactgcactcctgcatgggtgacagaggaagactctgtctcaaaaaaacaaaacaaaacaaaaaaaactaatcaatattccaaacatacacataaaaaaattttctttaatatttcatttatcctacatcattcttgttctgctaaatgttgagttagcagtctgctttcctgaagccatcagctttgatactacataaaagttagctaagctatatcacctcagaagcctgtactcaagaggttattgtttgatatctcaatagcaatgttaaagtgcctattactctccttttccctaatgctctaaatctgtctctgtttcgggcataaactattgactatagcttgtagcaaagccttcaggcaagcaccagagtaaaacagaaattctctgtggatgacaaatacttgagagctgtgcttaatttgcttccataaccaataatatcagaatagaagataagtgacattctcttttgagatacatatgtaagtatttcacagtagggttttttgttttgttttgttttgttttgaggtttttgttgtattttgttttttgagacaaagtctcactctgtcacccagggtagagtgcagtactgccgtcatagttgactgcagccttgaattcctgggctcaagcaatcctcttgcatcagcctcccaaagtgctgggattataggcgtgaaccaccatgccagcctagaagttttaatcagcgtttcctctgagggtaaaacagcaaaggcattgtcaaatttccaggaacttcccgtaaagcaaacaatttctgaaatatttctattaataacagtttacctataagaacctaacctagggcagactgagtatctcttctcagatatggcagctcctctcatgaaactttaaacaaatctaattattcccagcatttctttttatagatgaaaacaaacctgggattttctagaggccctctaggaaattttaaagatgagttttggtaagaaaagcacattttttcctaaattttggtctgatctttaaaaggcaaaaatcaaaaaagttattaaaaaagaatggggcacttgatgaagacctgagaaactacttggttacctaatttttcaaaacaataaaatatttgaaaatgaacatagaaggtaacatgactgtaaataaccttggctcaattcataaataaggaacctttgttcttcgcttttttatttctttaaataaagataaacagcacaaaaaggcaaattacacaaaaagaataacctttcttattgtaggacaggcgttaatcagtaccaaagaaagaagcacatcaaaactcagcaaactcactaaaattttaatatgtttctcagcttcacttcaaacacagttactagaaaccagggcaaatacaatctcatgaaagtttgtcctttattatgctcttttatattctggaacaaattgacactttagagcaaagaatagtcttcataaccgtaagggtccttgagaccttttaagaggacctgcaaggtcaacactattttcataataattttaagactttatttgcttttttttttttttttttttgagacagaggctcgctctgtcacccaggctggagtgcagtggtgccatctcggctcactgcaagctccgcctcccgggttcatgccattctcccacctcagcctcccgagtagctgggactacaggtgcctgccaccatgcccagctaattttttgtttttgtatttttagtagagacagggtttcaccatgttagccaggatggtctcgatctcctgacctcatgatccacccgcctcggcctcccaaagtgctgggattacaggcgtgagccaccgcgcccggccagtttgccttttttattccacttctctcattctctttccttttctcatgagtgtatgcttgagttcttccagcagctaaatgatgagtgatatctcatcagattgagtgaatcagatatgagaatctgacttctggtaacccagaagttaaagagattttcaaaattataaaacaacgcattgaaaataaattactgggctgggcgtgtggctcacgcctgtaatcccagcactctgggaggctgaggcgggtggatcacctgaggtcaggagttcaagatcagcctggccaacatggtgaaaccccgtctctactaaaaatacaaaaattagctgggcgtggtggcgggcgcctgtaatcccagctacctgggaggctgaggcaggagaaccacttgaatccaggaggcagaggttgcagtgaccccagatcatgccattgcactctagcctaggcaacaagagtgagactctgtctcaaaaaagaagaaaagaagttacttatgttaacatgaaatggctttattgttgttattttcaaatgaaccaaatgtttttttaatttcttagttttaatttctaatatagtaaatatccatagctatagctcacataaacaaaaactcttagggatccttaatgaattttaatttaagaatatgtgaaggggtcttgagaccaaaaattctgagaatcgggccttaagaaaaaaatattatttttccttgaaaaacaaaagaacacttatagttatacttctctgtcattattgttccttatataattgcaactacccatattaattatgatgtttaagaaaataactaatatctgtgtcatagagaaaactagggagcttggataattgagaaataatatgtaaccattttagcagactagcaaagctcataaacacaaagaacacaactttctactgcgggacacatcccttttacaccttagtgtagcaaagatgaatcaacacattcattaacatgacccaaaaatacagcctttccagcaaaatatattcaccttaagaagtacatagttactaactatatagttttaatttctatataattaataactatattctttttaaaaagctaataacttaaaatgatgcttaataataaatgctctaatactctatcttagaaattaggtatcttacgatgatttattaatcaattcagtttaatatcaactcaagattttaagtaaataaaaatcttaaattattttgaaactgacatactataaaacataataactattaacattgtaaggttggccgggcgcggtggctcacgcctgtaatcccagcactttgggaggccgaggcgggcggatcacgagatcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaccaaaaaaaaaaaaaaaaaaaacattgtaaggttttcagaataattatttgattttgttgatcacagttttatacttttttataatcttaaatattatataggaaaaatgtgagattatttgataaataagcctatagaagtttaggaaaaacccaagtgaaataaaatgtatacttgtgttatacttaagattgatgtaaataagagaaagaacatggctgaggtttttttattattgttatttaagtttggggtttgttttttttctttgtttatatgtatgttttgaggcagggtctcaatattttgctcaagttggtctctaacttctgggcttaagcaataatcctcctgcctcagcctcccaagtagctagcattataggtacacgtcatcatacctggcttttgggtttccttaataactggaattattaagttagtctcatttgctacagatttatcctaattatatgaactcacattctcaaaattataagtagaatattttcagtgtagcatatttaaaatattgtaagttaaaattatttattatctaggaattttagaaatattttatataagaacttactatctctctcagccagttagaacagggcatctttaagagacgatataatttatgaataccttacagaaataggaaggcaaacacttcacactcacaaaatgaggtaaatgtttttctgtattacagacacgtgaacacacagacagataagaaacacaatagcttcagttctacttacaacttgagctgtaagtcaagagtaaacacagaaccataaatattcatcagtccactcataaagagctattttctttcctagagggcacaaaaatcttaattgatttggcctcagaatggacaataagagaaataaacaagaaagactaataagccagattctctgtcttctcttaaccaaacaaaatagatttgtatcatccttttacagagatcaccaaatgattagaccataaaaccaaatccctaatcattcctgccacaaggggcaataccttattggccgtgtgcagaaacaaaaacagaaccaaaatgaatacggaggccaaaatagagaaaccaaaagttaccaaagttacagttttattgctgcttggaattcactccaggaaccaaggaaagatgtaccctttgtttgtttgtttttgtttttgtttttttgagacagtgtcttgctctgtctcccaggctggagcacagtggcatgatcttggttcactgcaacctccacctcccgggttcaagcaattcttatgcctcagccccacaagtagctgggatcacaggcgcatgccatcatgcctggctaatttttgtctttttagtagagatgctgtttcaccatgttggccaagctggtctcgaactcctggcctcgagtgatccgcctgcctcagcctcccagagtgctgggatttcagacttgagccaccatgcctggcctgtacccaggtttaagccactcataaagtgtacttctctgccaatgaagtttaactggctctgtccaatgaatcaatggagcatctcagtggagcctctggaattgttaaagtttaactttttatagataaaatcattaatcttgattttgtctcctttcttggcttactcactgtacctcgtttttgtaaataaatttagttgtttcataagtgttcatagtatgtataacttctatattctacctagaagtgatattaccacttcgtgtatagcataagaatcttacaatgatatacttctgtttttcccctctcaacatctgtgctacacttgccataaatgtcatatttacatatattattgaaccttcactatatcattatgatttttctttaaatgataaattacttttagcaaatgttatatgatatttaaaaatcttacatatttgcctatgtaaaaaaattatgaatctcataaatatataaaatgaacatgtttccaagactttatttaactcaacaacgagcaaataagatgctatgacctattcaaaggagaattcaaagaatatacccatttcagcattcttgactacccaggtaatcaggtaatcaagaatgctgaaataatttgctaatagatgcaaaactgatctatacccaccacagaataatcaattacatctccactgggcagaattcatttgcatttctttggaataaaattatgttcactggcggggcgcggtggctcacacctgtaatcccagcactttggtaggccgaggcgggcagatcacgaggtcaggagattgagaccatcctggccaacatggggaaaccccatctctactaaaaatacaaaaattggctgggtgtggtggtgcatgcctgtcatgccagctactcaggaggctgaggcagcagaatctcttaaaccagggagtcagaggttgcactgagccaagattgtgccactgcactccagcctggtgacagagcgagactccgtgtcaaaaaaaaaaaaggttcactgtcttagcttaggctgctatttaaaaaataccaaagtccaggtgcagtggctcacgcctgtaatcctagcactttcagaggccaaggcgggcagatccttaagccaggagttctaaaccagcccaggcaacatggcaaaatcccctctctacaaaaactataaaaattagctaggcatagtggtgcttgcctgtagtcccaactagtcaggaagctgaggtgagaggtcaaggctgcagtgagctgtgttcacaccactgcactccagcctaggcaacaaaatgagaccctgtctcaaaataacaaaaaataccataaaatgggtggcgtaaacatttatttctcataattctgaaggttgggaaatccaagatccaggtgacagcatggatgggttctggtgagggccctcttccaggctgcagatagctgacttcttttaccctcacatggcagaaagagagctagctaactctctggcctcttcttataatggcactaattctactcatgagaactccaccctcatcacctaattacttcccaaagcccccaccatcacattgggattggagtttcaacatatgaatttgggggtggggagggacatattcagtccattgcatttactctcagttttattcagtttcattgctgtaaaatagctgaaaaatacaaataaccagaaagtgggtgttgcactggacacccagtattcttttctgcccatttcaaagttttgcacaatttttctgaccactggtgtttctccttacctgagttgaagaagagacttattccttcatccattcatttttcttcttctcatatgactctggggttcagaatatcagacaaagatccttgctgcttcaataggtaaacaaaaatataagaacaatgatgattctcagcctttatcactatgtctggtacaagttttctgtctgtcacaggagcatgaagcacttcttcatgttcaaaaagaatgaaaagggctatttttaaaaacaattttttgcaagaaaaataaaacactttcattcatttagcaaatatataagcatctgctttccaaactctgcatcataaccttcaaggccctgcaactctggcttctgcctatctcttcaaactctgcttatacctctctcctactcattcactaccatccattgccttttcagttccatgcacgctttgccactttggaagctttcatttgtatgtcccttctctggaattctcttccctccacacttcacatgcttgaatccttcttatccttcaaggcttagctaatatatcactacctcttctagaatgacctttcctattccccacaccctcatcattttctatcccagcacctgcttatttccttcatcgcatgtaccacaaattataattattttatttgttggtttacttgtttttggctatttctctccagtaaaatgtaacaggatatctttgtgtcagggactatgtctttcttctgtaccatgaaatgcgtagcacatatggaattcctaatacataataggcactcagaaatgtttggtgcactaacaaatgaatgagtgaaaggtgtatgctattcattaaggattcattatatagatatagatatatatagatatatataaaagagaagtttcctgttctcaagaactttatagtttaacaaaggatacatatcagctatcaaagcagttgctctataacctaagtgcataatgttagaagcatttagtgctataggagcatataagaaagacctgaagatttctgcttctgctatgatagaatagcatatttggaccaattctcccaccaagaacatctataaaaactatgtaaaattttttaaagaaaagcaaaagcagatgtctgaagaaaataaccaagacagccaggattccgggcactaagatcccagagaaaaagtgaaccacagagaagtaaaactggaattcttcaccatatttttcctcaaagcatttactaattcctaagccaggagtgaggtggggtgagagctattaatactacaggaggcaaagaagccaagcataaaaaagagtagctaagaagctaatgaaataagcagaattttcatgagtcttatgagttcaggacctgttatagaggaggggccctggtaaatatctcaggctttcagcttgaagggctatgctttaggaataaagacaatctgcagataaactagccttcacacggactgaaattcagcatcaaactatctcaatccctgattagatcaagataatctgagttttccttaactgccagaagacctcaaattctttttggaggaatatatcattgtccaaagccttttcaattttttcatacctgatatttgggcttcaatctgaaaagttgccagacatgctagagatagagcaaaatgactaaaaattaagataggaaacaattgataaagtagacctaaaaatgatgctgatacttatattgtctcacatggactttaataaccattatatgtttaagaaaaagggatgacaaagtgggaaatttcactagaaaactggtatctattcataagaatcaaattgaaattttggaaaagggatagaaaatatagaaatgagcataaaagacaaatgggatgtggtgaaaggtcaaacatatatgtagatgaagtctaagaaggagaggggagacagagtgagcaaaacgatatttaaaatattggcggatagttttccaaaatcaataaaagacatcaagccagaaattctaggagctctactaatctcgagccggataaataaaagaaaccatacctaggtaatcagcaaaactactgaaaactaaagacggagaaaattttaccagaaggacacattgccttcaaaggagcaacaataaaactaacaaatgatttaaatggaaatgatggaacccagaaaacaatggactgggatttgtaaaatgcaggaaaaaaatactgccagtagggaactctatagtcatcaaaaatgtacttcaaaaatgaaggtggagtaaagacaatttcagccaaacaaaaactgtgcggacctagactaaatagagtttttaaggtggaaggattatggaagcatggaaatgcagaaaggactaaagagggttaacatgtcagcaaatgtaaatgagtgttgatcatgtaaaataataatgtcttgtgaggcttaaaatatgaatactatatagtgaatatataaatatcaagtatatattgtcaacatagtatatgtagaaaatatatacaataaataaaatacatatacttaaaatataaacatatacatgcacatacgtatatgcttaaaatgcatgtaaaatatatacacacaatagcatgaaaggtagaaaggcataaattgagttgatatgttttaaggttcttgtattgtctgggaagtgatttttaaaaacccagttatgagtagactgtaataagtcaaggatgcatattgtaaatctctaaaataattactaacataataatataagaatatgtaactaacaagctaatagaggggaaagaatattaaataaaaaatatttcatgaatcctaagggaggtatagaagaaggaaaaaggaaatcaaagcagaagtgacaaatggtacagtgatagttttaaacccaaatatagcagtaatcatactacatgtaggccaggtgcggtggctcatgcctataatcccagcactttaggaggctgaggtggactgatcatgtggggccaggagttcgagaccagcctaaccaacgtaatgaaacctcgtctctatacaaaaattagctgggtgtggtggcatgtgcctgtagtcccagctactcaggaggctgagacatgcaatcgtttgaacccaggagacagaggttgccaacgtgagccgagatcgcgccactgcactccagcctgggtgacaagtgagactctgtctcaaaaaaaaaaaaaaagaaaaattatactaaatgtaaatagactgaatccttcagttaaaaattgtcattctggatttttaaaaaaacagctaatcatatgctgcttataagagacacatcttaaatattataaagacatagaaaactgaaagtaaaagatttgaaaaagttacaatgaaatatagctggtgtagctatattgataacagagaaaattctttttcttttcttataatacatttttatgtagagcaaatagagaaaattaaggtaaaaaggattactagatattaggagggacattttattattttaaattagttaattcatcaggaatatgtaagtaacatttgcaaatttactatatctaataatataacctcaaaatgaaaaatacgtgaattaattaattaataatcaacatttcatctagtcccccagtctttggagttcagaggaggctgagaagatgactgagactaagataaaggtgggatagacagtggggtagaaagagtattcaaggcagaaaaaagattttcaaagactggaggcaatagcttaagaaactggccagatgcggttgttcacacctgtaattccaacactttgggaggccagggtgggtggatcgcttgaggccaggagttcaagaccagcctggccaacatggtgaaacgctctctctcctaaaaatacaaaaattcgccgggcatggtggcatgcacctgtaatcccacccagctacttgggaggctgagggacaagaattgcctgaacccaggaggcgaaggtcgcagtgagccgagatcatgccactgcactccagcctgggtgacagagagagaccccgtctcaagaagaagagagaaagagaaaaagagagagagagtggcggcgggggtggggcaggggagaaggaaggaaggaaggagtcttgctagaatgtagacggagagaaagattgataggaatgtggctgggtgagatggatgagaacaatgattgggggggctagaaaatataggaatatttgatatttaaaagatgatatggcctggtgcagtggttcacgcctgtaatcccagcactttgggaggccgagacgggtggatcacctgaggtcaggagtttgacacaagcctggccaacctggtgaaacagtgtctctactaaaaatagaaaaattagctgggcgtagtggtgcatgcctgtaatcccagctactcgggaggctgaggcaggagaattgcttgaacccaggaggaggaggatgcagtgagccaagatcgcaccgttggactccagcctggaggacgagagcaaaactccatctcaaaaaaaaaaaaaaaaaaagatactttttcctaaaaaccagcaacttattaaagtattatatagtcacttgatcaaatttatctcagaggatctctgttactactgtggggagaatgaattggaggagggtggcactattggcaaggagacctatttcagcaatcccggtgagatgatgttggctgaggctgtagagatagaagggaacacatttttacaaataaaagtacctaatagtttgtgaaatatttaaaatgtagacaggttactggactcatttttagattagtaaaccaaaaaatttagtaatagacctaggtttttattatttaagagaaatgttaaggagtgcaatttttttctttctgtctacaacaccagctgcagagctgtgttatatttcatttccaaagatcagattttgtaatatcactgtgggttggtcatagccacaggttagttttgtttttaatactagaatataaagttggagtagttaaaactcccttgactttctgttttagagttcctttcctgtttttcattttagttgagctatttagatttgacaaatctaagtaatctgtgggcatatgttcaagtctctcttcaaggaatgtatatggctttaagatcattaagcagaatggtgtaggatacatacatgtaggtttcttgcccgggtacaacttaagacatatttgttaacatccttcttcagacataaaattctatcttagaagagaaacaataacgcaccagctaatgatattatacattaatgtagttgttttgtttttatctaacttctcctactagaatgtactttctgtgaggacagggatgttgtctcttttgttcaaggctgtatccccctacacatagactggtactcatcatataccaagtgttaagtaactatttattgaatgaataaatggataaatgaagaatgaaggaatatttgtgttaagcaaatcaactccattaaaataagaaagatgtttcttttcatttcaatcttattaatttaatgttcatttaaagtgttgaaagtctaatattaaaatgtttgaaagtaaagtgattatttttaatgtttgcaggactatctcaagcaggtgctggacattgatcttcatgctcagatccattttggcagggtttttatgaaaccagggtatgaaaatcatcttgttatctcatatatggggttggtttggcttgctttaactaacaaatttttaaatgccttctttttacatttcctattatgaattaactattccaaaaaaaaagaaatatagtattaggatcctttgcacaagtgcaggttctaatgaaataggaattcatcttccttatgagtcaatgagtttggtataaacaaaacacagcaactttccaaactttttctcctttttaattctcatccctagttccttcttcctctttttctctttttccccaaactgcttctttatctgtttttaaaaataattaatatgagaactctgaaatatacacaaaagtagggaacgaacccccaccccaccctgccttttagttgggagggagggctggtttgtttaaaagcaaattctagatatgtcattttggtatacatctgaaataataatactaacaacagcattctcttacctaatcacagtagtattatgtcatctaacaaaataaataatactttaatatcatctaataccctgatcatattcaaatttctcccatatatcaagaaaaagaatgcctttttataattgttttgtttgataaggattccattaaggtcgactcagtgtatttgtttgttaagtctctattaaatgagaacattttctgcccccaccctttttgttgttgttgtgccattgacttgctagagaaaatggatcatgtttcctgatgaatggatttggctgattacttccttaggttatgttcctctgtctctgatatatgctataaattgaaagatataaaggcttgattaaattcaggtttaattttttttttcctttgcaagaatgtttcattaagtaggctttcacactgtttcctactggcccctaggaggaaagaaaaataactaaggaaaataaccatgaatttgcacatctcttaaaaattaataatccctaaagaagggctgatggaggtcctgaagtcagttataaatcctcaaaggttgccaaacgttggtattagtgaaagatatggccatatctttaagaaatagtctatctgtttagacctttgctactctatgaacctatgatttcctgtgcagagacctcaactgtatggctgagagttccagcccacctccatgctgtcagggacaacagtaatgatgctttactgtcaatgaaccctaggagagaatggagtagaggcttctcagttgttgtaagtgagctatgggtaccatcaacaaatttcaaaagcctttaaagtatcaagctagccctcctaataagtacctcatgtcagttctaggatagagatcaggctttacctccacgatttggccatttttagtatagaattaagattattcctaaagctttgtccacaatttgatagaattcttggctttgtatttctgtagttgcatgttgagcatgccccaatatggctgctgctgatagggcctttttattatcgaaactgttgaattggggctgggcatggtggctcacgcctataatccccaacactttgggatgctgaagcaggcaggttgctttgaactcaggagttccagactatcctgagcaacatcgagaaaccccatctctataaaaaatacaaaaattagccgggcgttggtggcttgtgcctctagtcccagctacacgggaggctgaggctgaagaatcgcttgagctgggaagcagaggttacagtgagccgagatcatgccactgcagtccagcctgggtaacagagtgagaccttgtctcaaaaaagaaaaaaagaaaagaaaagaaagaaactattggattttgtcttacgcaaatattgttatgctattgggtataactgcttttttttttttctgagcccatgggcagtactaatctgattaggatacagaggatatcccaaaagcatatcagtgtgcttctcaaaacctcaaaaattgaattgggccgagtgcagtggctcacacctataatcccagcattttgggaggccgtgggggtggttcgcttgagcccggaagttggagaccaacctgggcaacatggcaaaaccccgtctctacaaaaaatacaaaaattagtcaggtgtggtggcacatgcctgtagtcccagctacttgggaggctaaggcgagaggatcacttgaggcggaggtggcagtgagccatgatagcaccactgcactccagcctgggcagcagagtaagaccctgcctcaaaaaaaaaaattaattgattgttctatttgcagagggaaagaagccaacacgacttgcccttacctctagagaagagttatttgtgtaatatctatcatttaaaatattctcagtgcctgtgataacttttatactctttttttcaatctgttatttaccactcacttcaactttagcagttcatcaattcctaacattttatttcctcccttaaaatcataacactctgacttcagccattgtgtaaatgctgttatagtctgagctcaagaggagaactgaataataggttttgagttccaaggaaatggcttccagagcttaaaaaaaaattcacagtttagcaataggacatttatgatagccatgcataataacaaaatatttttttgcaatggaatccttttttaaatgagtaactttacagaaattacattacctacctgcaagatgcaaaagattgcttaaattggccctataatttcaatgggctttaaatgcagtggaaggaagaaggtgttatacattctctcctcattcttattatctgtaggtttgctaaaataaagtagttttgaagtttaaatgggcttcttttagttcaccagaattttatgcttgtctaaaggtaataagaacttaaaggtaattgctacttaatattagaacaaaagaaatataaaacacacaaatacaatctggctttgctatttccacgtaacagtgctttcagaatgcaattaagctctttcattttagagacaaagatactcagaaaagcatttggagtatcagcaaccagatctaccaatcacggtttttattgcgtcatctacagtgagcatagctgttattaagaacaaatctttgaaattatttgcatcacacactaataatcattgccaaataacctatccataaatcagtatcaaaatcgaatctcatttttctaaaacagcaaagaatcaggaagtatgctaaagaaaagcctcagagtagccaaaatagatgtccaaagatcatgtactaacgctacataaccatcctgtgagatctttatccacatatcagctaaagttagaacaaccttggttcaaatctgtgttcctccacttagtagctgagtgacttggaccacattgcttaatctctctgaatctcagtttccatataaactgggattctaattgttaccttataagcttgttgtaagacttaaatgaaataattaatgtgatacatagatgttacttaaaaaatagatattttagccaggcccagtggcccacacctgtaatcccagtactttgggaggctgagacaggaggatcgcttgagctcaggagttcaagaccagcctgggcacatagcgagacctcatctctattaaaaataaaaaaaattaggtgggcatggtggtgcatgcctgtagtcctacctacctggaaagctgaggctggaggattgcttgagcccaggagatggagactgcagtgagccatgattgagccactgcactccagcatgggtgacagatcaagaccttgtctcaaaaaataaataaataaataaaaatagatatttttattattactgttattatgttcattctaacaatataactattgctactattctctggttctcaaacctaaaaccagctttaatggtcaagatgatagcaatctcgcattacagggtgccacaggaaaaaaaaaattgggaaggaataaaaaaacagaaacaagaactatagaaacatagcaatgtggggttatggtttatgggtgaaaacaacccatagtactcttgtgacctaacatcactgtattacagcagagtagtacacattaataatgatggctataaatcatcaaaagaagtcagtgtcactgtattattgcaaaaggtaaagagtgagagatctatttttgaaagatcaacctccaaaaagagtaaaaataaaacaatgtgagtgcttaaaaggttaatatttcatctgtatgaaaaaagtatgccctaagaattctgcattgcttaaggttcattaatataatgagatttattagctaaaattctatataaagggtaattaatagaaaaaaaaaacactattctcaactgcccactctatgccactcactccttccaccccacctcctatgataagagttcatgtcaaaatcttgaggaagtgtaatttgagaatatttttaaattactattaattgtggctgggtgcggtggcttacacctgtaatcccagcactttgggaggccgaggcaggcggatcacctgaggtcgggagttcaagaccagcctgaccaacatggagaaaccctgtctccactaaaaaaacaaaattagccgggcgtggtggcacgtgcctgtaatcccagctactcgggaggctgaggcaggagaatcacttgaacccgggaggcgggggttgccgtgagctgagatcacacccttgcacgctagcctgggcgacaaagagcaaaactccatctccaaaaaaaaaaaaaaaaaaaaaaactgttaattttgttctagtcatgatattttatttattttgatatttcaaaaataatgtcttgataagagggaagtgtttatgtctatgctaaggatagttttaaaaggctaatacagaaggagcaggattgaaagaaaaaggttaaaaaatactcattttgaacaataggcaactgtctgatagacatattatcaggtaatctgctttctttttttttgagatggagtcttgctctgtcgcccaggctggcgtgcagtggccatctcagctcactgcaacctctgcctcccaggttcaagcgattctcctgcctcagcctcccgagtagctgggattacaggcgcacaccaccatgcctggcaaatttttgtatttttagtagagacagggtttcaccatgttggccaggctggtctcaaactcctgacctcaagtgatccacccccctcagcctcccaaagtgttgggattacaggtgtgagccaccatgcctggccagtcttctgcttttaagaatgattgttgtaaatcgccagcaaaagtagtataaacattattaactagaggggtgggaaaacttggaaactccaagatttggagtacatttctatggcactggcaagaaaaaaaaaaaaagtaagtagttttctttaaaccagaaagtgtggttacttgaaaacaggaaatactaaaaacaaacttatttaagtgtctgtggaatacttcagagtataaagatgtaaaggcaagtcaacagaaaagtgttttttatatgataagtgtatggattacaaaaacactggagtacttaatgtattcatcatattgcttagcaatcactaacaagtgactctttttttcttctagcttgccaacaacatttgcaactttggatattgatggtgtaagaaaaataatctttgcactacctggtaagaataacaaattgtttcctttcctttttctggaaaaatagccaaaattttttggacttctcatgtgaccacctggtttgaaatctgaaagacctgggctcaagtctcagcttttctaaacgaccaatcacttaacctctctaggaagtttcttcacctataaaataagactaatatctacttcatagggttggtgtgaaagtcagattagataatatatatcaaagcacattccaaatcctatcaaagcacattccaaatcctaagatgatcatcaagtgttagctgtcactagatctttctggagcacctgctttttccttacaggaaattggtcgaagttagcagccgaatacctctcataaccagaagtattgtgctctagaggccaaaatgccttgagtcacccaagcaaataccaaatcaaaaaatacaaagctgcctctggtccttgccagatttgggctggttgaggggagggggaagaggaaaggccaggctactggaactagtgcttctcagccaaatcctactcatcatcagtctacaacttccccactcccacccttgtcccaacgtgagcagaaactcacatgttcagattatagaaagagcaaagcaggttcagttcacgatgattttcaaattcaaattttttgtgatttggggttatataaagtcatggtgaatcttgataaattttaaaataatttattgtgcatcttttttttaactttaaaattatcttctgatcattctgttcagttctctattttttggcacagattcctttagaaaataacctatttctttaagatttacaaatctcatggcttttggatctttgtttgttttttaggtcaagtatatctcaaaatggaaatgtaaagaaatggaagcaggcagaaaaatgttaaactttgaaaacattttaagcccctatctataagcataaaagagattagatttctatcatgtagaaaattttcagagagagaacatttaagtaaaatagtcctcagaatgtatctgtaacatgaaacgccttaggacctttcataattccttggatgctctgatagccattgtataaagaaatgtgctccttttcctagcttcatttagcctggaagagcctcttttgtctacggaagatatgacttaacctacagaccatcagtgatattataacaaagaatgttactgtgggagcctatttcaccattatgccaaagatgttataaaattaaaacctgttttcaaattcctacttttaatttgaaaccttatctgctcagcctgagtgaaccaacagagggcagcagaaactcacatgttcagattgtagaatgtgcaaagtggttccatttacaaggattttctttcttgtttttgttgttattggttttgtttgttttttgtgttttgtgttttttgtttgtttgtttgtttgtttttgagacaaggtctggctctgtcgcccaggctggagtgcagcagcgcgatctcagctcactgcaacctctgcctcctaggctcaagccgttctcccacctcagcctcccaggtagctgggactataggcgcttgctaccacccctggctaatttttgtattttttgtagagacggggtttcaccatgttgcccgggctggtctcaacttctgagctcaagccatccacctgtctcagcgtcccaaagttttgggattacaggcatgagccaccatgcgcagctttacaaggattttcaatttcaaaagtgtatttctgctttcctgtaggccatgcgtttaaagccatccctaatctcgacaagttttaaatcaaagttttgtatatttacttgtttttttggacatttttaacattgctagagtgacacatgctcactattgtaaaaatcagaaaatatagataagcataaaaaagtgttaaccataatcccccaacacccacatatggataaaccactattacaagttttttatatcagtccttccagtcctttttcgtacatagcaagaccctgcctctaaaataattagagcacttcattttttatacagtaatgttataaagtggtagtattacatggattttataatccttgatttacaatggcttttttatttgttggtttggggtttttttgcttttccagaaaaaaatattctatctacttgtattttgaagcaagggaaagtaattgattctttttaagagtctgctattctgtgggcaactcatttttccatcgaaactattagtatcacttgtcactttttgcaccttaaaaaatctattcttaagcacttttgcaggtagaagagaattggaggtatgattatagctaataataggctaaactgaccattgccttttgacttgatgatgcaataagcagtgtttagccatgccaagggaacctaaaaatctagtagcccattccccactccaggttatacattcatgcttacatagaactgtataaaagtattaaaacaactgaaattttagaaccagaagagatcttgagaatcatgtagtccaaacctttcatttcatagatgagtaaagttagactcaaaaaactttggaacttgccaagatcagacagcttggttagataataatgccacacaagaaatcaaatctgttatttacagcccagtggttgtttgcttcttcacagcccacccttcctcctttgaagtgtacgacacacctagatttcttcttggagtgatatagtggaattcctcaaattcttctcataactttaaaagaatgtggtatttgtattagtctgctcaggctgccatgacagaataccatagactgggtagctgaaacaacagaaatgtattttcttacagttctggaagctggaagtccaaaatcaaggtgccagcaaggttggcttctggtgaggcctctctccctggcttgtagacagcaaccttttcactgtgtcttcacatgatctttcctgtatgtgtgcagactcctggtgtctcttcctctttttataagggcaccagtcctattggattacggccacatctttatgaccttatttaccttaattacctccttaaaggccctatctccaaatatagtcaatcatattggagttatagctttatcatatgaattcaatccataacagtattcatcttcaggtccttaaaacacttcttaaatcatttggtgtttttttttaatttaaagaaatatccaggtagagaagattataaataagtttccttatgcttatctatgttttctcagtttgggaaccaagcttgtaatactatagtaatttttaaatgcttaaaaaatagcaaatagatatataaaacttgtaaacggctttaaaacaagattagtaatgagtaatcttgataataagattagtaatggctttcagctggctctcaggaaagcggaaataaatggcgttaaacagcttctgggcagcagaattctccattttactgaaagacgcaaatgtttacaccccctgtggcatttagttgactatacctctgttctggttggattcaaggtgattcagaagaggaaaaatagtgcctagtcacttccgtcacattctgatacccaaagatatagacagacataattatttggcaaattgttacacagtgtattataaataactgcttggttgactttcagggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctattagttttgatggaaaatgtgattatattctccccctgtgtactagaaaatgtaggagaaagggtccctttaattctcctacttcatgacttctaaagtgaatcattttctccagatagaagtccatatacgagtccagagagcacggcttaaaaacttgagtgatacttaaggacaaaacagtcaataggatatatctggctctaccctaacactagacctgtctggaacaagggagaattttcttttccccatgcaaactcagagggacagcaattaacctgctcactttttctgtgacttcaacgataaattttaaacaattcagaagaagacaaaggactacaaagagaccctggtgattcagggaaagggtaaccatattgtttagaagagaactgctaaggctgagaaatataccatggtaaaagtcacctggaaattaggtctccttctccaccaacactaacttcaatgtgatttactactactcaactaattatgttatacactttctctgtgactaatgaataatgttcttagcagtataaactacagtaccaaaccattactttccaagtgttccgaagtaaattcaaatatggcagaatgctatgattagttgacaggaagagcaaaaaacataaaagataaaatattaggccaggctcaatggctggcgcctgtaatgccagcacttcgggaggccgaggcaggtggatcacctgaggtcaggagttcaagaccagcctggccaacgtggtgaaaccctgtctctactaaaaatagaaaaaattagctgggcgtggtagtgggtgcctgtaatcccggctattcaggaggctgaggcaggagaatcgcttgaacccgggaggcggaggttgcagtgagccgagattatgccattgcacttcagcctgggaaacaagagcaaaacttcatctcaaaataaaaataaaaagataaaatattttaaaaaattacactgagaatacataggataaaaacattaaaaaaatctaggctttcaatagtcttaacattgactgtttaaatgctaagaactttgtggactaggatatgaaacaatctccttttcttaaaatttcatgaaaaatttaactagagtttttttcattaatcacagtggtaatcaaatttgaaattaagtggaaaaagaaataaaaaccatccatgaacaaaaagtattctgatcaagtcagaagtcagagtcataaagcttagatttagacagtcaaaccaatagtactgaatttactatcttcatatttactaaattaaggaaataaaaattcacattattataagagagagagaaagaaggcttccctttgactttgcagatctcttatgaattctttcacttatttctcattgtaacatccaccatctcttctttaaaacagacatagcagccatctattctgacaacaaagatgagatggtactttgtaatcagactgatgcttgatatgttgttcctgatggtgtccatttcctgtcagcaaaggatgttaagaagtggtcaaaaaatcagtcaaatgcctttctcccacagcagtgtcactgggactgccagtatgggtcatcagtatgcttggctatttgtttcttttgtttcttagctttccaaatcatccccacatcagtactgacacaactgccactttaaagcataaacatatacttccttgaaacgtgataagtcttatctctcctttctgaccataaaagatgcagcttacacacaccacttattactgttcttcagaatagatgccacagtcattgcctttaccaatgcttgctgctttcaggaagtgggagtcagtgttaaatgctgctgttggtaaatcatactgttggactctgatgtggccattctgtgtgtcagtgcagaaaatgtcatccttgctaggcacagtggcactcgcctgtaatccctgctcctcaggaggctcaggcaggaggattgcatgaggccaagtgtttgagaccagcctgggcaacatagcaacaccctgcctctaaaaaaattaacaaaaagaaaatgtaaaaaaaaaatgaaaataaaatgtcatcctttcatatcaaagcattcagaagagcatcattttagaacaaacatttcccttatttccttggtcacttatggttggaggtgaaaatcttctcattttcagtacacaataagaaacacttccaaagcatctggtaaagaaaaaaaaaaagaaaaagaaaaagaaaggaacacaatcctagcaattcatcaaatagaattattgaccccgtgtttccatgcaaggaccttctatcatgtgtttccttaatatcccattaaagcactctaccacccttgttctcagcttttttcgctagaaacatacctggagtaactcccattagtattaacaacttatctcaagcagtgattaagagacagaaaagggggaaagcatgttctagaggatagccaactataagtccctcatgcccatccccccctcacaaacacagccagaacaatgaataaataactgcattttaatgaaaaaaaactgaagaagagcagcagagtgtatccgtggagtaacagaaaccctggtgagcacagaaactcaggatggtcacatcgagaacagaaggaaacaccaggcctccaccatcgcatcccccagctggatcagctgggaaccaggaagaactcccttggcaaggaattaagcagaggatcccagcaacccccatcaacactttggacacctacagacctcacaatgggaaaccctgcagccctcacaagcatgaagcccagctgaaggaactgcctggagtccacagagctatgctccccccagtaaaggagtcaacgctatgctccaacctctgtggcctgtgcaactactgcactacaccatgttggaattggaactatggctagagtttttcttgctctgggagcaagtagtcacagcaccccttcatccccaatgctaccccaacactgtggcctaacatccacaggctgagatgcaagcagctgttacaactttcccagtggagccaaatagaggtggagctactccacccagcccgccgcccgccgcatccccctcagccagagctaaagccatatacggcctcctaggaaaacagtatcttggctgctcagagcagtcatgcatccctaagttcagtcatgtactagcctaagttgagccagcacccagcatcccaggaaatgatgcttttgctgcccaaagtaatcatgcactctagtacctaagctaaagcagcaccctctatcccagagaaaaagtgccagagccacccagaacagccatgtccccagggcctgagctgaagcagcacatagtccctaggtgccctggctgaactgagcagctgggcatccagaactatgccgatgtagtacccacaacccagggaaacagagcagtggctgagctgagacacctcatcctacaggtcaaacaacttcctactctcctttcctgaagctagactacccccctagtgtctgagcagctgagaaacacctcttcctaggaagtgcagtcattgctatgctatttattgcccccaccccagggcccaaatgacagcagtgctccaccagtctggattacttattgctgctgcacctggctgcacaaagtctgggattctaccaagccccaccagcacagggtctgcagtcactactacatgctgcctcatcccctgggacctaggttgccactaagccctattgactcaggttcctagatagcaacaatagcctactccccagccccaaacgtccaggggcaacccttcttctctggagtcaggccagagctgtgccctgcccgccaggggcagaatcatagctacaactcagccacctgaacccaagctgctaaggggtacccaaagtcacagaccctggctctgtggacaacctacactcaaaactaccacaggaaaaaaacaagcaccccaagacccaggtgccacaatgggttcacaagacccttagcctaggaccctggccccacatccactctaagcacctgtaccaggaacccggtgctgcagtaggccttcttgaaggccatgtcagatttgacacaaagagggatctccctaggctatatcttcccattgtggagaaaataagaataaggaagacactaaaagcccttaacactgaatattagcaaactatgccaccaccaccaccacttccacaaacttctgtggactacgtaactgaggcacccacagttactgctcgccctgaaagcacctgaagatgctgcatggaaactataccactatacctattgaaaaagtcaccacacccttcccagctggcacactaaaacccaactgcaaatgaaagactttttctatggaaaccagaaagattggaagaaagaatagttctaccaggtgcacagattcatgcaggcttacaagaaacacaaaaaagcaagcaaatataacaccgccaaaggaacataatgggtctctagtaacagacccaaatgaaaagaaaatcaatgacctgctggaaaataaatgcaaagtaattatctgaaggaaattcaatgagatataataaaaaatatatacagacaagtcaacagaatcaggaaaacaatttatgatataaatgagaaattcagcagagttaggaatcataaaaaaaaacagaaatcctacagttgaagaattcaataaatgaaataaaaatgcaatagagagcttcaataacagactttgtcaggccgaagactttctgaacttgaagataggtcatttgaaattacccactctgaaggggaaaaaaagaaataacaatgaaaaagaatgaagaaggcctgtaagacttacgagccatcattaagtcaacaaatttttttattatactttaacttctggggtacatgtgcacaacgtgcaggtttgttacataggtatacatgtgccatgttggtttcctgcacccatcaactcgtcatttacattgggtatttttcctaatgctattcctcccccagccccccaccccacaaccccccgacaggccccagtgtgtgatgttcccctccctgtgtccgtgtgttctcattgttcaactcccacttatgagtgagaacacacggtgtttggttttctgtccttgtgctagtttgctgagaatgatggtttccagcttaatccatgtccatgcaaaggacatgaactcatccatttttatggctgcatagtattccatggtgtatatgtgccacattttctttatccagtctattattgatggacatttgggttggttccaagtctttgctgctgtgaatagtgtcgcgataaacatacatgtgcatgtgtctttatagtagaataatctataatcctttgggtatatacccagtaatgggatggctgggtcaaatggtatttctagttctagatccttgaggaatctccacactgtcttccacaatggttgaactaatttacactcccaccaacagtgtaaaagtgttcctatttctccacatcctctccagcatctgttgtttcctgactttttatgatcaccattctaactgccatgaggtgatatctcattgtggttttgatttgcacttctctaatgaccagtcatggtgagcattttttcatatgtctattggctgtaataaataccttcttttgagaagtgtctgttcatatcctttgcccactttttgatggggttgtttttttcttggaaatttgtttaagttctttgtagattctggatattagccctttgtcagatgggtagattgtaaaaaattttttccattctgtaggttgcttgttcactctgatggtagtttcttttgctgtgtagaagctctttagtttaattagatcccatttgtcaattttgacttttgttgccattgcttttggtgttttagtcatgaagtccttgcccatgcctatgtcctgaatggtattgtctaggttttcttctagggtttttctggttttaggtctaacatgtaagtctttaatccatcttgaattaatttttgtataaggtgtaaggaagggatccagtttcagctttctacttatggctagccagttttcccagcaccatttaataaatagggaatcctttccctgttgcttgtttttgtcaggtttgtcaaagatcagatggttgtagatgtgtggtattatttctgaggcctctgttttgttccattggtctatatatctgttttggtaccagtatcatgctgttttggttactatagcattgtagtatagtttgcagtcaggtagcgtgatgcctccagctttgttgtttttgcttaggattgtcttggcactgagggctcttttttggttccatatgaactttaaagtagttttttccaattttgtgaagaaagtcagtggtagctttatggggatagcattgagtctataaattactttgggcagtatggccattttcatgatattgattcttcctatccatgagcatggaatgttcttccatttgtttgtgttctcttttatttggttgagcagtggtttatagttctctttgaagaggtccttcacatcccttgtaagttggattcctaggtattttattctatttgtatcaattgtgaatgggagttcactcgtgatttggctctctgtttgtgtgttattggtgtatacgaatgcttgtgatttttgcacattgattttgtatcctgagactgctgaagttgcttatcagcttaaggaggttttgggctgagacagtggggttttctaaatatacaatcatgtcatcttcaaacagagacaatttgacttcctcttttcctatttgaataccctttattgctttctcttgcctgattgccctggccagaacttccaatactatgttgaataggaatggtgagagagggcatccttgtcttgcaccggttttcaaagggaatgcttccagtttttgcccactcagtatgatattggctgtgggtttgtcataaatagctcctattattttgagatacattccatcaatacctagtttattgagagtttttagcatgaagggctgttgagttttgtcgaaggccttttctgcatgtattgagataatcatgtggtttttgtcgttggttctgtttatgtgatggattacgtctattgatttgcatatgttgaaccagccttgcatcccagggatgaagcccacttgatcgtggtggataagcttttagatgtgctgctggattcggcttgccagtattttattgaggatttttgcatcaatgttcatcaggatattggcctaaaattctctttttttgttgtgtctctgccaggctttggtatcaggatgatgctggcctcataaaatgagttagggaggattacctctttttctgttccttggaatagtttcagaaggaatggtaccagctcctctttgtacttctcatagaattcggctgtgagtccttctggtcctggactttttttggttggtaggctattaattattgccccaatttcaaagtctgttactggtctattcagagattcgacttcttcctggtttagtcttgggagggtgtatgtgtccaggaatttatccatttcttctacattttctagtttatttgcatagaggtatttatagtattctctgatggtagtttgtatttctgtgggatcagtggtgatatcccctttatcattttttattgcatctgtttgattcttctctcttttcttctttgttagtcttgctaagagtctatctattttgttgaccttttcaaaaaaccagctcctggattcactgatttttttgaagggttttttgtgtctctatctccatcagttctgctctgatcttagttatttcttgccttcttctagcttttgaatttatttcctcttactcctctagttctttaaactgtgatgttaggatgtcgattttagatctttcctgctttttcttgtgggcatttagtgctataaatttccctctacacattgctttaaacgtgtcccaaagattctggtatgtcgtgtctttgttctcattggtttcaaagaacatctttatttctgccttcatttcattatttacccagtagtcattcaggagcaggttgttcagtttccatgtagttgtgtggttttgagtaagtttcttaatcctgagttctaatttgattgcactgtgatctgagagacagtttgttgtgatttctgttcttttgcatttgctgaggagtgttttacttccaattatgtggtcaattttagaatcagtgcgatgtgttgctgagaagaatgtacattctgttgatttggggtggagagttctgtagatgtctattaggtctgcttggtccaaagctgagttcaagtcctggatatccttgttacttttctgtcttgttgatctgtctaatattgacagtggggtgttaaagtctcccattattattgtgtgggagtctaagtctctttgtaggtctctaagagcttgctttatgaatctgggggctcctgtattgggtgcatatatatttaggatagttagctcttcttgttgaattgatccctttaccattaagtaatggccttctttgtctcttttgatccttgttggttatcagagactaggattgcaacccctgctgttttttgctttccatttgcttgttagatcttcctccaaatgtttattttgagcctatttgtgtctttgcatgtgagatgggtctcctgaatacagcacaccgatgggtcttgactgtccaatttgccagtctgtatcttttaattggggcatttagcccatttatatttaaggttaatattgttatgtgtgaatttgatcctgtcattatgatgctagctggttattttgcccattagttgatgcagtttcctcatagcatcaatgatctttacaatttggcatatttttgcagtggcaggtaccaattattcctttccatgtttagtgcttccttcaggagttcttgtaaggcaggcctggtgatgacaaggctcccagcatttgcttgtctgtaaaggattttatttctccttcatttatgaagcttagtttggctggatatgaaattctgggttgaaaattcttttctttaagaatgttgattattggcccccactgtctcctggcttgtagggtttctgctgagagatccactgttattttgatgggcttccctttgtgggtaatccgacctttctctctggctgcctttaacattttttcctccatttcaaccttggtgaatctgacgattatgtgccttggggttgctcttctggaggaatatccttgtggtgttctctgtatttcctgaatttgaatcaacaaatatttttatcatcagagtccagaagaagaagagaagggaaagaggataggaaatttatttaatgaaatactagctgaaaaacttcccaaatctgttgagagatatagacatccagatccaggaagttcaaaggtctccaaatgtattcaacccaaaagatccttcccaatttgtcaaaagttaaagacaaagaattataataacagcaaaagaaaagcatcaagtcacatacaaggaagtccacattagactagcagtagatttatctgcagaaaccttaaggccagaagggaagggaatgatgtatgtaaagtgctgaaagaaaaaaaaaatgccaaccagaaatactatatgcagcaaagctatccttcaggaatgagggagaaataaagcctttcccagacagacaaaagctgaactccagcttcttagccttcttttctcttttcaccagagcaacccaacccctagacttcctgtattaagaatataaggtggccaggcatggtggctcatgcctatgattccagcactctgggaggcccaggtggcaggatcgcttgagcccaggagttcaagaccagcctgagcaacatagcaagatgccatctctaaaaataaaaataaaaattattcaggtatggtggcacatgcatgtggtcccagctactcaggaggccaaggcaggaggatcactggagcccaggaggtcaaggctgcagtgagctatgatcatgccactgcactccagcctgggtaacagagtgagaccttgtgtcaaaagaaaaaatacatttttaattaaattttatttaaaaagaaaaagaacataaggtggtagtgacagcaacgacagaataccaaggttagtctccatgtccactgtattctttgcacaacccctactatcttgtatttttgtgagatgatcaggtgaccaagtttgttttcttttctactttattctgtagttatcatgtgatgtaaaacttgatcctcgtccagaataccatcggtgtatactaacttggcatcaccaagaaccactaccttgggcacagagtacaggttagtcattcacatctacagatattcctagacacctatcctgttaaaacacaaacttatatataatcttccttggttatgactgattttgtaattattatacatttttctttttgaaaagttagatgagttaagttattcctaaacagtatagcaaaagttaaaaaataactattagaagtttacttattttattgagccatattttctagataaacatttagaatgtccacatatcattgactaatgtcctgtaataaatctggaattacagaagatttgatatgtttgttcaaccaataagttctgagtataactttgtaggaaaaggaggagattctagctataccatcttgaaatgtgagatgaaagcccaatttataatttgattctctgtagcctctaccatacgctagttattggtaaatttgaagggcagagaaatcaatattgataatgcagagttctacagtaaccttcactagactttaaactgttattcccaacttccctactcatattttgcctaatttttgatgtgactccagaaaagttgtagtactctttaaacaaagatcctaccaagtgaaaacgtcaactaacagcgactaagttcatgggctttgccatcagagagaactgcattcaaactggccaccaacctacttagcaggaccctaggcaagttacctaaaaattttttgagtcttgtgagaatcaaataaggtgtttaagtaaagtgcctagtactttggcactcagtaaagaaatggtagctgctaccattattgtcattattattttaatactttttttaaagcctcccttttcagacacgcataacatttcagcctgaattgagaaattctatggcattttgcataatgctataaaatcctggttttactctttcaagcaagaatttctaatgtttatttttaaagtttgaatgagaaggtggtaggatataatagcatggccacctgaaaaaggtactggaaagtttgatcatcccttctcctcttgaagacccgcatttctgtctgtttacattttgaaaaggtctacaagggcccaactgtatacgccatgatgcttatgctgctgtaataagagtatttctttctaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgttttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaatgtaatgtgttggcctcgttatttaaagagagaagattgtcatgccattctgatagggttctgcctgaataaaagaaatggttaagatggcctaccaagaatatttaaaatatggtatattgtaactctgtatcttactacaatatgtggggaaaaatgtgatcatagcattatgatctgtagtgtgtgaaaatacagatgagaaggaaggagaacctgcagttggtctcgtctttccagtcatagctggagaatagcaagcaaatttagaggaagggtactaatgacttagaaaaaaaataattcttattttagacgccataaaatccaatttcaaacatctacagttctttgaaatggagaaaaaaataagcaatgaaacaaaaaattacagatgagcgcctcgaaatttttaaccgtgttagaaaggaagtgagaaatggcaaaaaatatctgtgctgaccatagaaaacacaataggtaaaatatactgtatccacaatggatcctttaataaaaacttaggggcacttttcaaatggtggtaacaggaagatgttaaatatactgtaaaatgtgctcaggaaagcaaactacaaaaattggcctactagtaaacaaaatgtcaagggatggtaaataaaggcaaaatagtaaacaaatatttgatactgatatgtgatattttcattcatatttacagttgaagaagataaggttagttaatagaggtcaaatgaaagagtatgcaaataatccttttatgtacattcattcaagaaatatttgttaagcatctattatgtgcttgggtacaaagtatatcatgctactatttacaaacatgaatagggcagagcacctgaccttacacttcattagggagataacaaaatgcaagcaaataaccacgatatttaatatatttgataatatatagtagagtgtatagaatgtgataaatgccataatacagattttaagggttggaagaattcagatgagatttcaaggagtaagatggcatgttagtgggtctttttttttttttttttttgtagaggcacagtcttgctctactgctcaggatagagtgcagtagcatggtcctagtgcactacagcctcgaactcctggcctcaag

SEQ ID NO: 13174 - DNA, 10153 bp, Human
  misc_feature (1)...(10153): n = A,T,C or G
cagaggagttaagtaattacagcgttctgaaagcgaacgttaaagggaatttacaaccgaaaaaagatgccggtcttcttcccccatcccagcttgcaattcacagaagcacacattagggtggagccagaaggaattacggaaaggacaatgaggacattgagagggagggtatggggggttaaagttagtcctccgaggccaagaagcagagtgtcttggcctagtgtctgaaaatcgcagcgcaggacggaacttccgagagcctatacctccccacttccccctccagtttacagatgggcaaaccgctgtcccgggtgtctgtcaggtctagtagcccagaatctcagtgcctaggcttcactgtaaataataaactatgtaaataacatttacaaatatcctttgtgagctcagaaactcagcattaccagtaactgggtagtggaacgcatccatcttcgtcgtttactccttctccaggggctctccagcctgcattccatggccaacagcagtgcagctgcagaagcacttctggaagcctcctgacttgaactagaccttgggtaaatagggtttagataagtggaggggagggaaaagtttcacctgaggggagaatgagctagtctgccagacccttataaaagtattggcctggatgggatggagggctttgacctgaaagccacagggagaagggaaccctgaggaattggctgaaagaggggggttcttaggaaatgcaccaacagggaagccagcgctttaccagggatttcattcatggtgggtatattattaatagagattcgaattctctagaagctgatcatttctaagagaaacaatatttaaacattactgtcgaaggaaaggttgtggggagaaaatgttctagttctaaaacagaacacccattttccctggttgtatatgaataatacaaatatgtcaaaaatcaagcttactatgtgccaagcactctaagaactttttttttttttttttttttgagacagagtcttggtctgtcgcccaggctggagtgcagtggcacaatctcggctcactgcaacctctgcctcctgggttcaagcgattctcctgcctcagcctcctgagtagctgggactacaggcatgcaccaccatacccggctaatttttgtatttttagtagagatggggtttcaccctgttggccaggctggtctcgatctcctgacctcagatgagccacccacctcggcctcccaaagtgctgagattacaggcgtgagccaccgcgtccagccaactttatgaaatttaatttatttattcctaacaacaaatccaggaggttgttactttttaaaatcagtgccattttataaatgtggaggctgaggcaccaagaggttgcccaaggtaagaagatctggactgaggctgagtggtgtgataccaagcatcctggcttggctggaatcagatttgggttccagtacttccactcctcttgttttgtgaatttagcttatctgagccttcattttcttatctgtgaaatgcatactgtaatccctccctattagtgagacaatgaatgtgcaggtgctttgtgaactacacattgtgacactaataggaagtgtaaagccttgcacttctaaggccaaatcccagctaagaagagcaaatgatgagctgggtttgacttgcagaatttagtgggcttactactcaccaagaggcaagagatacagttgtagttatgatgatagactttggagtcagatggacctatgttgggatcccagccctgccacttattggctctgtgacctgagacaagtcactgaacatttctcaaactgcattatctccatggtcctccatttgttcatacataaaatgggctttatattcctcatagagcagtgatgaggattacatgagatgccactgatacaatgtctgcaagtagtgagtgctcaataaaacatagctagagtcgttgttttttctgattcttcttgctcctcatcctatttcctttgtcttaatttccccacaaagacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtgagcacagccggtgggaggtgcaaggagggcaaagaataaaacagccttgaggaaatcattaagaatgttgatggagatttaaataacagagacaatagtgtttgtaaatgtgataaaaatagaaataacggccatggtggtggctcatacctgtaattccagctctttgggaggccaaggtgagagaatcacttgaacccaggagttcaagacaagcctgagcaatatacggagaccctgtctctagaatggggtagccaatccctcttctagagacaggtactgatccgtggcttgttaggaactggagcacacagcaggaagtgagtgatgggcgaaggagcatcatcacctgagctctgcctccatcagatcagtggcgcattagattctcataggagcctgaaccctgttgggaactgcacatgcgagggatctagattgtgggcttcttatgagaatctaatgtctgatgatctgtggtggaacagttttgtcccaaaacctcccccaaccaaccccgtccatggaaaaattatcttctgtaaaaccggtcgctggtgccaaaaaggctggggactacaactccagaaaaaaatttttaaaacattagccaggtgtcatggcacatacctgtagtcccagctacttggggggctgaggtaggatgattgcttgagcccgggaggttgaggctacagtgagctaggatcgtgccactgcattccagcctgagtgacaaagcaataccctgactctaaaaaataaagaaataaatagaaagaacctaaatctctcataattaattaagctgacacatttgcaaccatttaaaattattcagggtgactctactcaataacaatgtatcgtatatttcaaaataaccaatagagtaaatttcaaatgtctcaccacaaaaaaaagtgaggcaatagatatgctaattagcctgatcatcccacattgtttacatatatcaaatcatcacattatactaaataaatgtatataattgatttgtcaatttaaatattaataaaaatttaaaatttgcaaataatatttactaatattgaaaagtattattatacactaataggttataaaatagtatgtatgttatgaacctactgtcctttaaaaaatagatctgtggggccaagtgctgtggcttacacctgtaatcccaacactgtgaaaggccaaggtgagaggattgcttgagtccaggagtttgagaccagcctgggcaacatagcaaaagcctgtctttaaaaaaaatttttttgagtggccagttaaaaaaaaatttttttttttttgagatggagtctcactctgttgcccaggctggagtgcagtggcacgatctcggctcactgcaacctctgcctcccaggttcaagcgattctcctgccccagcctcccaagtagctgggattacaggcacgcaccaccacgtctggctaatttttgtatttttggtagagatggggtttcaccatgttggccaggctggtttcgaactcctgacctcagttgatccacctgcctcagcctcccaaagtgctgggattacaggcatgagccaccatgcctggccaaaaaaaaacttttttttaaaaaatagatatgtatttctgtgttgagaaagatcttgaagaacatgtacaaagatgttactaattatatttgggtgatgggagtatttatagttttttatttttacttacttgtattctaagtttctgtgagaataagaaaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctaaaggccacattttagcttaaccacctctttaaaggccctatctccaaatcgaggtacttagagctacagcatttgaattggggggactcaattcagcacataacacctcctgatgaaagcttcccatcaccataccaaggggcccttgtcaccccaaggattggctttagatgccaatctctgttcatcctttctcggcatctgatagctcatcagtttaacaagtggaaacttttttttgtccacctgtgccatccatgaacatttttgtgaaaacactgaccagtaaaggaacagcagtgccacactccatcgtatgttgctgccatcgcttggttcgcatgcgtattcacaggtccccagtaggacaggtcgggggacaagcctgcttacgtcactgtcacgaggggatagccaaggcccagaggttcagtgactcaccaaagacacattgtttccctgaatccactgctcctcatctgagcccagggcttcactgtagaatttttggccgctttctttctttttgatgttcaggaactccaattgtgaggtttttgttttttgttttttggttttttgttttgagacggagtctcgctctgtcacccaggccagggtgcagtggtgcaatctcgactcactgcaacctctgcctcccgggttcaaacgattctcctgcctcagccttccaaatagctgggactacaggcatgtgtcaccacgcccggctagttttttgtatttttagtagagacggagtttcaccgtgttagccaggatggtcccgatctcctgacctcgtgatctgcctgcctccacctcccaaagtgctgggattacaggcatgagccactgctcccggcctaattgtaaggttcttattggactccataaggaattgggctttggagtctgatggattttacccagccactaactagctgattatgtgattttgaggaagtttcttaagctctgagcttaaaaggcttatttacttaaaaaagagaacaatatacttacttcttaatttttttgtgatgtctcagtaatgactggtaaagattccaaggatccctatatgagtctgctgcctttattagcgttatcttgccaagggttatacataaagaaaggcacattgttgggtggggtttggagttttggggcatgcatcatcatattttttggctctccctttccatcaaaaatacttggagacagagtttagttatttattcctgctggggcctttgctttggttatgctaacccccatcccttatccgactcttccccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtgagtctgtaagcgcacgccctgctcaaacacggttgaatctgtgcgtgtacatccacctgcacatatatgtcttgtattcagagatcacagcaaccctcatggttttcacccccagccccctttctacccatctgctaaggatttcaagttcccttccagtaatgattctacaaagtagccaagtggatacctcaatgaatagggcagctgtggtgtttccctcttacacggaatcctgtcatttttgtggctatcctattctgccatgaattttcatgcctatttcctactttcctggaatttgctttttcagtgttgtcttggtatacaaataatattttgaaatccttggttaaaattccagagatacgtttttccactagctaactaataagtggtaaggccacatcttccccttctcgtgagttcacttcacattgtctttcttagaataaaaagaggctttctgctgaagtcacccacagttgtgatgtcttgaagttcccctttaaaaggtcattactctcgaccctcccagggaaaacaaacctgtatttcttaccctttaacttgatatgtatctctttatttagcaacaggatcaatgccttatttatgtagatccttatgaaaaatgtattgaatgaatggtacttatatagaaataattttgatgtttaaatagtttatgatattactgcaagaagccgaagttatgttggatttttctctgttcacacatccatctggtgctttttgttatgacttttcactttatttttttcaattgactctagattttttcctttctacaggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaacagaacctagcacagtgcttgggcagccaataggcattaatcagtatctattgagtgttatgaactagcctcctagctcgtgcttccctcattaccctccagagttatgtttacgaataacaaattgaccatgctaaactaatcatgttccaatgaatacatcacctttcttcatttcttgatgctcttcccaatccttgtctacctgataataaattcttacttgtccttcaagacccaactcagatagatagagcttcctgagtgaaacctgctttgattgttcaggcacttggccaccttctcctcactcctcccacagccttctgtcttggccttgtcatcacatcaatcctgttgtgtggtgctgtgtgtcttctgggtcagtcctaggcacatgctgcccagcacatgtccacctgggaaatgagatgccatcgtcacattcatttggtcaccctcagtccagccagtgggcttgctctcatttggcctgttctcaggggtgggaaggaagagcgtcccttccttctccttttgagaaaaccacagaactatgactctcatgatttttcctttgtgaaatccctggttttcagctggaagcggtgggtaaatgaggtctgatgatagcagtcctgccaccttctagttcatcccataggaatgtttttccaagtccttccagtctttttagaacgtggtggaggagggttgtgtgtgccccagggggtcgggggtaggggatgcagggaggatcttagcatttgttgttttctagtgcagggctttagccacaattgtaaacaacaggaaaaggctctttagagatcctattagatttgctttgccgattgtcactcttcatcacaggcacatttcaaaaagaggttagactttcagacttcttttttctcaaacctcaaaacttccaccccaaacttcgctctcagctggtgactttgcttctttatgtgtgtgtatgtgtgtcagagaaagagagagagagagagagaagggaggatgagaacgaatggggggaagagataaactttatgcataacattagggtaaatcaataaagatggtctgacacatcgtatgaatttgccattcttatcaagttaatctatgcatattgaacaacagaagaggtcatatgtgacatttcaaatgatgctttttggacctgctgtgtgatgctgcttcatttgctttctt

SEQ ID NO: 13175 - DNA, 58768 bp, Human
  misc_feature (1)...(58768): n = A,T,C or G
taccagattctgagagggtgcagtggatctgcaagggatgcaatgtattgtgcgttattcgagggcagaactttatccacaatagttcccttcaatccttgcacagtgaccaagacagagtatctggtgcggaacatctattccctaatcttattaccataacaagggagcaggagtaagttgtctgactggagagtttgaaagaactggggatgtgtcactctaccccctcaagtttggggagcaggcatgtcccaggaggcacatattttctgcttttccatgcagtttagtttttacacaggcaggttttccagctctgcttgtgactgagtggacatgttcaattctgggcccgctgtccctgcagatctaaagccatggctgccattccagcctttagcagagacaaagctgacattttgctctccataagtctgactcctgttgctatctcagtggattctgaacttacatggggaccatgggtattatcttgaagccccctaaagccacaacagtgggcactcaacaaaccttggcagcagagtgagtatgacaagttcagaggacaacgaggagatgggcctgctttgagcggaggaagtatgctgatgtagttgaagagaagttagatggacagggtgggcccagtaatgcagggcttataagaaaggcagagtttggatttgatgtgggtagaagaacgctgaagtttctgagtagaggaagaacatgaacacgaggaagacaatgtttaaaataagggaaagaatatgacaatggattgcagtggagactacaggggagagcctggagtcagaggacaacgaaaggaggtttccagaatttctgagtgagggaggatgaaggtctggcctaggaaagtggacatgtgaacggaggcgaggggatgcatatgagatctcagcggctaaactgccaggctatgggtacaagccggctctgagaaaaggagataggtttgaaggcaaccaccctgaaagaggtagataagcaggccctgaagctgggggaagtgaggcttagtcttgggcatgtgaaatctgagttgctaagtggatctgctctccttactagttatggcaggaaaggcgccttaattaggagcattttagggagttaaccctgtcaaagaggtagcacactttcgaaggccaagggctgggaagaaggtggtgaagatggcaatcctgaacacagaggctacttgggatgacagggatgggaggagggacacaggtgatgagtgagtgggcggaagagaggagggggacaccgctccccggcccgagggaaggaggggatgaggctgccggcaaacgctggactcaggatcttcccagcagagcagggcggccgccacctcacccgggacaatgcactgtagaacccacagcagccttccccacgccggccggtcttcccggccctgcgcccacttcccggtgccccgctgccctgctgccgtgaccccgggatgcggggtctcctctgcctccctgggcctcccccttcagccatggggggcggctccgcttcctaggccgcgggacgtcttttcctccaggttccagtcccggaccttcccgggccccccacggcaccgcccacctggccaccgccgcagcccgcccgggccgccgccagccagcagcccctcccggggtggggtttcccttccccctacccctttgtggcagggacccacgggacaccccctctgcctccgctccacgtccagggggccgaaggggcgccggacgagggaccgtgcggagagaggggttcggcggcgccaggactcccgcgggctccccggagcaggggtcggaaggagggggagcgggagccgcgggggccgctgcagcagaagggggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacggtgagcgcagggcgcacggcgcggaggccggactcttcgggcggccgggggtgcttgggcggccggagcgagcctgcgggacccgagcaagtttcccaggtcggcgcggggcccggcgccttcagactcgctctcttctctcttccgcagatgtggaaacgctggctcgcgctcgcgctcgcgctggtggcggtcgcctgggtccgcgccgaggtaggcgaggggccgaggagtccgaactcggtccccggggcctcttgggtctgcgcgctgggcgggtgggcgcgcgtcctggggatgctctcccggggtggcgctgggagtttcggtccttggggtgtgctggggtggagctggggcagtaatgctgcttacgaaacttaaatctttaaagcaggaaaagtagttcgggccgtaagcgggagccccgccgcggctaacatggagggagagcggggaggaggagaggggacgggctgggccgacggggacgagacggcgactggagcagcagcgagttcaaaaaggcgcctcagttccgtccttcacttcagaggagactgagagtagttggggacttttccctcccaagtctgtctcctgggggcgggggcagaggaatcgggattcttcttttggggcaaaattaattttcctttctctcttttaaagtgagatcatgattctctgaaatgtattttcttctttgtgaagtgtcctcgggttttgtgttaacatctgggcaatgtaacggccttttcccaagtgttccctgtaacgttgcgcaagtgtaagagaagatccattgctctgctctttgggggctcgagtttccagttaaagcatttcagcgcttgttttttttgtaccaattttttcaactctaacgaccttcctgagacactacaaacaaaccaacaaactctttgctcagaagccgctccattaactcaaaggtttatggacagaaaataaacaattctaaattccccgggctccagtctccaggaaagtgaggtcagaaactaaacatttgataattatggcaggaaatatggaaggaattaaaaagcatgagggagaagaaatggaatgcacattacaaaagaaatagctccctggtgggtggtttatgctccctgtttgaattttttccttcatattacagtttaaccacacccttagcatcgcagcttgactctgcccaaaaaagtcataaatgcatacaaggtcttcacaatttttaaaaaatacgcattgtactgaattctcatttaattcactactacgttgttgattgaggtggaaactcaatcaactgtttttactgccaatgaaataaaagtagctaatatttattaaatatctgctatgttgtaataaaattccattttaatgacagataaattgagtcagcgaaggttacccaatgctctcagctattaaatgctaagggtgggatttgaacccaaacagtctggctccggacccaaggctcttgaccattaacccacaccacttccaagcacaatggtttaacatttaccaagtacatttttgtttaccacacactgggctgtgtacgttacctgcagttacttcttttaaagctcccaaaccctgtaatgtaggttttattatcccgattttacagaggaagaaacaggtttaaggagattaggtaacttgcccagggtcatacaactagttagctctgaagcaggatctgaacctacctctcttacctttggagcccatcttgaactccaggtctgcttcttatccatctggttttccagggtttgcatttgagagcgtatcccccttcactggctgatgtagccctggttaagaaacatttctccatcccctgctgtggccctcaaaaggcagttgcagaccagtgatggatgaggtgaatccctggttggttttccagcaggctcaagaattgccagccagtgtgtgaaatcactcagtgaactggaatgcaaatatgaggtgtgaggaggctgttggttgacttaccaggctgtgtggcccaaggtctggaatctattctaggcggcctgcaagacacacacccctcccaacccccttccacacagggaaaacttatccctggtaggaagttcccccagcagcaatttcctgctggaggtagaagagcatccagtgctctcacataattcccaggcaaactacagggaagaaggcaaaatagagaagtactgagatgtgaaaacagagtgcgttgggggagaaaagaggctgtgaactcacagtgtatggaaatggttacaatgaaaagagtgaggggtaggtatgagctaggttacatttcatggctccaggttattaaggattattatcttttaattattccaacctcctggtgcctggccaagtaagatttggcaagtttttaatccatttaataataatatacctttaacaattgatgaagaggtacattaaccctctccctatgggaattgtaatttggattttttaaaagccttttatcttgtagttaatggtgcttgctgtttaaatttcttccttgttaactctaaggacagtctgcaaaaatggtcacatcatgatatttacagtccttagtgacaatctattttagtaaacttcaaatcgctaaaattgtacaaatattgttgaactttttagaaatgaaatttagaaaataaattgaggcttcttggtgctttctgcttttctgcaaccataaatatttaattcagcatatttttaaacaatttaatcactttacaaatcatgttgatatttgaagaagccagagcctctgtagtaaaccagaatcagaggtgctctccacttgggaaaaggtgattgtcatcagtattaatgccagtctatgtcaatcccatttggttagattcacaaagctattaacaaaagtcataaaggagcctgggctcagtggctcatgcctgtaatcccagcactttgggaggccaagacgggaggactgcttgagcccaggaatttgagaccagcctgggcaacatcgtgagaccatatctctacaaaaaataagaaaattacctgggcatggtagcacacacgcctctggtcccagctactcaggaggctgaagcaggaaaatcacttgaacccaggaggttgaggctgcagtgagccgtgatggtgccactgcactccagcctgagcaacagagtgaaaccttgtatttaaaaaaatagaaacaaactcattaagcaaagtgtcatattgttttgaatgtgttccatggtgtcctacttccttggcacctcagggttgctttctgattgcttcttctctttcttacctgctcactctcttactactctgtctgcagcatataccttcagccagcctccctccagattctgccacatccacctgagcacacacacccatgcactctgtagtctgcttgaaagaaggtactgggtgtagcatatgtctctagatgtgtgtagattaacatgtgaatggactaggcagagagggcagcagcagagggagtgcctgcactaataattacacagatatcccttttctagattctctggggagaggactgtgtgagcctgctcatctactctttcccatccccctcccattgggaattactacagttcattgagaagtgttgatggtggatgcatagtatggagcctgggaaaatgttaagaacacaggcggtagtgtgtgtgcccttgaagctcagtcagtggatatctgtcactctaacatggcaggctggagagaaccctgtggcccaactgcctgctttaggaagacagccctggcaagtacccaagcatacccccactctcccttggtggatgtctctgctgtcactatgattcccagcattccaggtctagaaattcattatgataagtcacatgtacagttaactgatttgtagttcagaatcctcattccagtaagggatccatgcttgacccatgaactttgagtgtattacctaagagagaacaatagcaattctacaaatagatgtacttcacttagctctagacatgcaatactagaagattatgagggctttgtcctgaggccacgtttcttaacctcaccgtaccctattatcggcattgtacactaggggttatatttgggagctcctctatgttctttagaattgttctgatggtagactcaagtaagccttgcatctaacccatatctctgactgcatcttcttggtgccacaacttgtattattaacaaagctaaaaagatctctaaaatgatctcttgcttgtttatcctttggcaaataagctacttgttgcaattctaaagaccattgctggaaatcggggtgtaaaacatagcaggggctgtgcagactagccagaacagaagggcaagcacccagcatacgaggccctggccgttgcaagtggctttagaaggtggacacgttacagttcccctagaagtctctggattaggtgacagaaaccaggactccatccccaggctcatagaagcaagttggagaggaaccatgaggtgaagatctggtcatgggctgaagtggatgtaatgatccgagaggaaatgccccaaagacgaaaagaaagtcttcgaagtcagtggggcagagcaacacatgctgccacaagaataggaagtaaaggatgagctgtaaattaccagtgatcacatatgagaattgaaaatgtcatggattctttgtcttagtcctcttcaaataactggacatctggcagaatgtttctaacagacataaattttattagcttaatgataccagttaatagggaaaaaaagtacattagataggttcactttgtaagccagatgattaatgtcctcagagggcaaatgcatactttttgtttaggatgctctattctgactcctgcgattttggcaaggggtgctttctctgagagtatgccatgaatggcgtggccttcccttcactgtcctcatcgagcctatcccctgctgcagctgagcgcacctggtactcaggtcagagtcacagtgaagcacaaggcatggtctctgccctcacattatttacagtctagtggtgggtccaggtgctttaaatcgtggcagctacagtttatattattataactacatagtaactagtagctttatacttattgctgttttttttttaatttacattaatgtagggccttcctttgtaagatccttttatggtagcaaaatgcacaaatcttccatgtatagcttcatgaacttttacatctggcccatgtaggcaccatgcgacaagactgagggagttagtacagaaaggtatgaacctgtatgttaccatgaagttacatacaggaaaagttaccatgaagaaaatgagggatagggatgatctagggtacatttcatgactctgtgcccaaagatggctatcttttaatctgtctcttctcttggtgtctagcccaggtaacatttagcaagtttttaatccatgttttaacaacagcaaaccttcaataattaatgaaagataaattaatcctctctatatgagacttactatttggatgttatttttaacattttaacttgttaacaataaatggctttccttgttagctacaaggatgtgcagcaaacacagtgaaatacagccttaattgacattaatccattttagtaaactttagatctgctttggggagctttcttgactgttttgtggatggatagatattccagggctcactgtaatctatattgaatttcacaaagaactcaaatcattctgttagaccactttgccctggtcattattacttttgaaaggactctacataagatgtcagtcatgttatttatgacagcaaaaaacttaacattgactacatagtcaaccgtaggagaagggttaaataaatcatggaacagctgtatgtgccaccaaaagcatttacaaaaacattttgaagcgccggcaaatgattataatttaatttaaaaagcacacaccccccagctttattctcacgactgtaaaaatttatagaaaagtacaacaaacaaatgtgttagaaattatctgtaggtagtagatttatgggtcattttattctttgctctagtcttttctatattctctaagcttttaattggcatattttattttcatattttatcagaaaataacacattaacttttttatttaaataaaataccacatattaggagaagggaaaattcctctcgaaaaaaggaggggatcacaagaatcgtcacgatgtcaaggcactggatgaaatatccaaggggcaggacttcagggattgcttaaggagaaaaaggtggggtggtaaatggcctttcagagatggcacagacgtggcatacatattaccattaccctctcccttacccatgacagacatttctaatcaatcatagaattctttcctactgaacttggagaaggtttgaaaatcctactcagcaatattctaggtagccactagcaatcagagtctatatgagatgaaagctatttaccatccctgctggatggtaaatcagtccaatttgacaaacattgacacatctttagccaaaattaagataattagaagacagagtttgggactgtatgaaactgacaaaaacaacatagggtaatagatgatagaactgggttagcaaatggatgaaatgtcaggaaaatagcacttacaccagattttggcccaagtttctaagctctttggatgaatctgaacaccttaaagtaagccagaccttctaacattggcccagtcaacaaaaatataacgagaattttcttggctattctgatgaagtaaacagttgctcttgctaaagttctaagagctgctgctgtcatagataacagcttttgcattagcctggcaataacttgctaatagaatgctctttgggtagttggagtacaaaataattcccataaatcttcatttcctgctttggttggaggatttccatttaatcttttcacagactttagatgctcatttggaagccatcaccaataaactattcccaggattagtctgaatgtatgacccccatatgtcccttgaataatcctggacaccatttgtgaccaactaagctgttgacaaacaggtcatatgatacatgacaaaagctatcacatgttgcaggcccagatttatatgtgcatgcatgtgtgcatgtgtgtgtgtgtgtcatgggatattggcttgaattgatgtaaggaaaacgtctctctgtctttctatactttttgttgtttcaagatttaaaatcctatgtctgaggcaaaatttgtcttttcccctgtctttcctcttatccttcaatgacagttaataagtgtaatttatggatctacagaagtgtcaggcattatgctagtcagtttgcacataagctactattaggaagagtgtgggactaaaaagccttaccatacagatccctgttctgaaggagctgctaccaccatcgctgcttggccattaggggtcagatgtaaggctttagcagaaattccccttcctcacctcttggcactacttcagaaaatcctgaaacatggcagtgggatagatggcccctgccttctcagaatttgaaagactccacttgggcagctggggcccttttcagcctgtccacctaatcagtatgtccagtagatggcagctttttgtgtggaacttttttttttaatttattattattatactttaagttttagggtacatgtgcacagtgtgcaggttagttacatatgtatacatgtgccatgctggtgcactgcacccactaactcgtcatctagccttaggtatatctcccaatgctatccctcccccctccccccaccccacaacagtccccagagtgtgatgttccccttcactttatcttaccttgtgaccgttctgggggtctgctgtttttctcttcccatttttctttgtcttttcttgttctcatttctgggtgtctccaagtctgcttttttttttttttttttttttcttttttgagatggagtccgctctgtcacccaggctggagcacagtggtgcgatctcggctcactgcaacctcctctgcctcctgggttcaagtgattctcctgcctcagcctcctgagtagctgggattacaagcgcctgccaccacacccggctaatttttgtgtttttagtagagatggggtttcacctagttggccaggctggtctggaactcccaccctcaagtgatccacccgcctcagcctcccaaagtgctgggattagaggcgtgagccacgatgccaggcctaactctgtctttttcatagactctgtaacaaacccattttgttattaagagcaacgctgtagaacaatgaaagagtccaacttagaagtcctgctgtgcccttttctgggcacctttttaaagtcacataatgtctctaacttgtatcttcagttaagagcgagggctttggggcagtggactgagtttgaattctggccttgtccagctgtgaggccttgtgcaagttacttaacctccccgaagtcactttccttaccagtagaatgggaatcattcctgtgtctctacctgtctactcgattagatcttggaaaaggtctcctctactcatggtgtatagtcaacaccaaaaacaaatacctgcaagagatgaagggtcgcttatgtttttgactctgtaatgatttcaccaggagaatcctcagtatacaagtaaacatccactaggcatggtctttatttgcacagcctttgtgctggctcaggttgttactctgattactgatttttcctcgagaggaagtataacataatggcttagcgctcagacctggaagctagattaaatcctagcactgcccttactagccatgtgatcttgggaaaactacttaaaacctctctgagcctgtttccccatctctaaaacgggcttaatccagagtatctaccccataggttggttgtgagaattaaataagctcttacatgtaaagcagagtgttttggcacacagtgtgcagtgttagttggtattatcatcttcagggcatctctaggggacgaactccaaaagccatgggtgcgtgtgtgtgtgtgtacatgtgtgtacacacgtgtgtttgcacacacattcacgcacgtgtatatgtgtgttcatggcatacagaagtctccttgcttctttttctctctccagagatttaattatcaccttcttttttaaagagaaaactaggatatttacttcagtggatgctttaaggcccagaatttatatcagaacccttgcttctactgagctaatcttgcccttaaacttctatgtagtgtttcttctgtgaagccacagttctatcattcctccaggaagagattgaagtactcatggagcatctcctgtgcagaggcagtaggatgggaagccagcataggttctccctaaaggtagagtgagtgaatggaaataactgggaagaaaacagaaagaaaaggcaaaaaaagaggtatgtatgaaggtggcaaacagatatcttgggtggtcatttccattttgctgtggtcttcatagcatggcctgttaccaggcaataaatttcaaattgttggtgtggaaaatgtgataatgcaaaggaataggatcctttgctttcattatttcaaaaataagtgccaattactctcaaagacagggtaagaagtattcctggagcaagctggaatttgtccctttgggagccaaggccacagcttctggtactttgcacacagacctgcagtcccactagggaggggctgctgtgtctgcagccaggccgatgccagcctcacatgcccaccccttcctggccctggagccagctctctgtaccactccttatgttgctctttgctcttcccttcatctttctcctctattttccttctctcaccattacagagaggtcatcctgaagtgtctgggctgcagtaggagctgccaaacattcacgaaccaccacgttcacattagatgcagagataaaactgcacaaagtctcaatacactattttgcatcactcatctgggacaaagtaaaatttttcaaagtcaactcaaaagaggaaaacaaaaggtattgcaaatctgttctctgttaggcactgagttagtgctggtggataagagaccttgtgcccaaagagcttgcagtccggaggggaggcagacaggaacacaggctcaaagtgatgcaatgtgagaagtattgggacagggctgaaaacctaacccagcacgaagggctcaggagcgcttccaggaggaagtgacccaccagctgagctctgaaaaatgactgatagtcactgtgtcttgtggaagtttgaaaaccaaagacacttctgctaggtaacatccactcagcattgtagagacccagccgtttaactttccaggtaacatcagttgttatatggctatgtgcctggaatgacacttcagacttggccattctggccacatagacatggcaggcatgacctccatttggaattaggtccatttacttctgagtcacattggaatgcagtttttacagtggagcatttgcagcctaatgatcagtgacttaggagttttgggggtttttttttgtagcagttgttttgttttgttttttgacacaggatcttgctctgttgcccgggctggagagcagtgacacaatcttagctcactgcagcctctacatcctggcttaagcaatccttccacctcagcctccagagtagctgggactacaggcatgtgccatcaggcccagctaatttttgtgtttttagtggagacagggtttcaccttgttgcccatgctggtctctaactcctgggcttaggcgatcctccctcctcagcctcccaaagtgctagcattacagtcgtgagccacagtgcccagccttgggggatgttttaaggcaatttctttgttcttcagatgtattcacaactgttccgcattaaataaggccaaatggcaagacagctctaaaacgccagcagagttgctaggtagggttgtacagactgttcactgcacaagtgtgtcatgtacctgtgtgtggcacagggcttgtctgcccacccacaggaaggagcacatttttttctaactgatgtgcaaagctccccaaacccaacgttatctctgagtcatgtgatgtttattagactatggcagtcatttctacatttgtgcatcttataagttgatttcatttagactcttgaaaagtttttgtactaggcctccatcaaaagccagttctgtgtttttgtggattttcctcatagataagcagagatgatagacatggaaatcttaaatatctggtttcttgtacccacagtgtgctactttgggctgtcgcacaagtcagtctagtttgggaactgtgattccccaggaattaaaacaagtattcccagcttccttctgattgctggattagcagaatttcctcagcctccagctgaattccagcccctgggaagaaatgtcttagagtaaacccccagcctggagcctgtcagaggttgtgtcatgtgtttgcattagctgagcaaaacccgagcaggctttccggccttgctctcgcctcctccctgcacgcctctccgctgggagaggccagttaaagtctagacactgtctgcttggctctgtgcctttttagcacaatctgcatggttctgtagctcttactttggttgtctgtcctcactcgtttccccagttttcttagttaggcttaaactgtcccgggggactggcaacgagtcgcacacataggaaacaggtgagtgaatttatgagactgtcaggattcagctgccttgaaaggttcagagtgaagatagcagcagtgctgactgaaactgtggctgagtttacagacatccctggtgtgagctggcttcaaacgaacctccatttactggccagagatgggctgggatgaataactcaggacagacagtggcaccccaggtaatgagcagccacctgactcctcatctgccaaatatgggggttagagtaggtgggctctaaaatgcagctttgaagtcctattcatataaaaggaggcggatattctaggctagactgtcaaaatattctacttaatggaattgggatatttgattaactcttatggtgatttacagcctagtgaagaacagtttgaaagataggctggctcaagaatgagaaaacagagtgaataaaaacaggaggcatcttgtgtcctttactttctctcgccatgtagtgagtggaatataaacagtacggcatgtggcacctgaacagtcttcatgcccaggaatcccaaatgctgtttactctacagaaaggaatcacttgattttccacttcagaagccaaccgctcaacaacactggggaagaaatgaagaatcctgggtctccttgtagtcgatcaagaaattttggggggaaaagggaagacaacccctaattcagagtgtgcaatttgggatttattgaacttacttgaaaaacaaaagcaaacaaaactttttctcgcttctgtaaatgttcacattttcttttaaaaataatgatgcagtattgcaaatggcttacagaaatagttgtctgaaactattgcgtggaccctaattttgttttctggaatccttcttattactttctcatcatgttgcctggcccatgatcaggatccaggggctcctgaacaagtattaatgaattgcctgccctgctcccctggccctgatctctggtcagatcaggctcttactacagcccatgggcactggtctttggctttgacccaatggttaaatcaagtgacttgttagggtgaacacagtaaggaaacagaggccaatgcagatgttttagtcctgctgaaatgcttggtaccttgcctgtactccagttcccgaatctcactagaaaatcccaatgtgctaaatcgtgctattgatcctgactggggagccagccagctcaatattggaggtggcttttctagtaagggtacagtacaggttagaattgaattaaattttgctgtgccccagggtagactatatgtgtgtgtgtgtgtgtgcatggatatgtgtctgtgtacatacagaatacacaaggagacatgcacacacacactccaatagacactgacttaaatttcaccactaggagaacatggccatctccctatagctctaatagtgagacttttctcacaaaaattcctgtggaatttgttttgttttaatttagtttagtgtttgacttatgttatactgccctgatttctttctaagcctaggcacataaaccagtgcttatttttatggtgtgaagtttgcctgttaatgaatttaataagtgcatgtcattcattcactcattccctaccatattccaaaaataagacataggttttccctccctaatcccacagccaacatatcctattagcttctgtaagggttgggctaattacatgtatttttagctattgagagggcccaagtttgtagtttgtggcataacatttgtgacagagaaaaagaaaatggacgggacctcaaagatggtccgagaaatttctgatccccttcacacatatacctggctcacctaaactgtagtgtgaaattgatacagtggaatttctatcagagaggctaaacactattgaaacagaaatacagatgctcaccctgagcaaagactcagacataatgagttccctttactgtcagggtccctaccaggagggcccagcatggcttcttggtggcccagccgagctcacaaaacttgctttgggatggaggcagatgtatgcttgccagtcattcacaaatactcggagcacgcagcttcgcttctcccagggcaccaccatccctggttttgcactatgtgctataattatggtgctacagggacaggctgagtcctatatcagaagcaggaaattcacctggcttctccctagagtcccagcagtctttcaggaatgtgtctgtttgtgctttgttccccttcctctagttttccctccttgacattttctattttctttcctttcttatcctatgtggccttggtcttgctgacagccacatgcagagatgcagattttctggtttagctatttattttaaggagaaagacattcactttatgcattaattggtgtctgcctcctgttccacagaagggtaattttctgtgtggcaccaagggcttgatagtgatcaaagaaaaccccagttcccagtaggaacacacttcaggtgtgagtccattttgggtttctcaatctcctttcttgggagatgaaactagaagggagaatgggactgggaagtgttttgagtagaggccagacattcaagtcttggctaaatgttgggtataataatttcagtactcactgcagacttatttcttaataaaactccccaagctacttgtggaccatgttgttttaaaggatagttacaaagttaaccgcttcctcttacagatacaattggagaagagtctttgtgttttttcattttctacaaaggaacatatataagctagataataagaaaccatgttggggttgtttttgtttattacgtgtcctattttagatacttttttttttttacaaaaataaactgtgatagggatatgaaatcctgtaaaaacaaccagcgcttgaggatgactaccccactatgttggtcattttacagcttaggtaattgcgtttttcctccaaattccccatacacatttgatcaaatagaagtctcttcatttcctgtttaagttgctccatggaattgctgtgtggattagagagcaagctgggttcctccccagtggctgtgtttccgttggttgattgggttattttccaggtaatgctataattattttgcccagtgtaaatggcattgtcgtgtagtgactgaaattactcatgttacagtggcctggaatgtaaagacttcctcattctccagtgatttgttgtttgactctgactccaggaaaaagtcttttctctgcctaggctgaagtgtgtgcatgtatttggggctcagatagatagctgaggctctagactgccagtctgtgggctcagatgtgacagtagccatattcagaaagtcatgacagtctctgagaaagagacaaaagttaggaattgtaagcctaagagtgttcaaagcatgtaatgaactgtccccaaatggttcttgtcctagaagtgggtagaacaaataaggaggaggaaaatagtgatgaggaagactggaagaagggaggtggtgatgcacgtgggaaactctgttaattttagtgggttaagcaaatgcagatgaggcgattgagtgaagaatttctgttaagtgcttcatgagaaaatactgtgagtgaacactgcagatgtatatgatcagaaaagatatatcactgttttttgtttgtttgtttttgttttgagacagagtctcgctctgtcgcccagactggagtgtagtggcaggatctcggctcactgcaacctctgcctcctggattaaagcagttctcgtgcctcagcctcccaagtagctgggattacaggtgcctgcaaccacgcccggctaatttttgtatttttggtagagatggggtttcaccatgttggccaggctggtcttgaactcctgacctcatgtgagctccctgactcaacctcccaatgtgctgggattataggcatgagccaccgtgcctggctgttttttgtaagtaaatgtatgctctgtaagcacaactcacaaatgataattaaagctgtaaattaaaatggcacctgtacatagtgtgtggcaagggagatgatgtctacaaaggtgcctcccacaaggtaagtactcaataaatagtagttgctattgttctccttgttgttatggcttgaattccaaggaacggtaataacaccatagggagagacatgaagagcctagacccaaagtgtgtagtgagtgaagtccatatatgtgctgggttaaatggttttttagttagaggatgttccagagttttacaaagttcgtgtgcgtttatgactctagaaggaagtataataagtaatgtttcccaaacattttaccacagaacaccatttcaaaaaaggccataaatatttcaaggctagtgttccatggacagacttcccatgaacaggatctatttatatgtgaccccaggtcttagtggccttgctgaactcacctcataaactaagtttcctcaggaaggcaagggacttgtctggacccagagcctgtctcagagaagatcctcttggtagtgactctagaatggaccatcagcatggccatgtgcacacctacccagaactggctgggcttttggatatcaacttatgtacccaggaattttctcttttatttttcactttctctgttcatacccagtctatcagcaagtcctgccttctgtactgtcagaatgtatcacctctccattgactgtcctctgtccccaccgccaccaccctagccaagctgccatcattgtgcctggactattgcaatagcacctagctgctctccgctttctctctcctgcgacctggctctttctgtacaggacagcctgagtaatctttgtaaaacacatatctgatcatgtcactccctgagcaaaaccccccagtgacatccattgcattaagaataaaatacagacttatcagtacctttaaaaccctacatgctctaccccttgccagcttttcccagcttacctcttgctgctctggcttttggacccagtgctatggctacactggccttttctctgttccaggaatgtaacaaattccaccctgcttcagaacctttgcacttttctactttcgtctgaattgctctcatccttcaggtcccagctcaagaaagcattccctgaccactcaatctaagtggtgccctctctcccagagttctgtcatacatactctattttcctctaaacttactgatcacaggctgaaatgaacttgttatttttgtttgtttattcaccttcctccctctagagcatgtactcctttagaatagggctttgtctctctcattctgcaatggatctctaatacctagaaccagttgtgcttagtgtatagtagatgcttagtaaatattttttgaattaatccactagctaaatggattaataaggccaaatgtctcatatgtaatacgaagaggtgcctacaatctttgtatcttaatgatagtcatctctgtgccgtattttgcaagaatattgtgcatctgggaagatggttgacagcacttgcccgtcaacagtttgcttaatcttggacatgatagtagtgctgggcttgcttaatcagacacctggattctaagtctctcagtcccaggtgaagttggaagttaagcagaggctagctgaatagtaaatatttttattgtttccttccatgatcagcaattttaatataacttggcaccattcccagaggaagctaatgtcccaaagaatatgaaataaagcattaaattctgttgttggtaattctttgcccatagtcactagtcacctttgtctttggacctcaccttttgctgaaacctttacttttttggatccttcctgctgttactctttctctctggtttcatttgaatggcaactgtgatgtttccagtatggataaaacaaagcaaaaggcattcagtgtcactggattttcacattaagatctcagaggcgaagtctcattctggggaacgttccaccgctaacacagtggtcagcattgagtgaagtccctgggggccaaccacctccacttacctgtggccttaactccttaagtcagagttcccggacttaccatagcatactacttcatttttcagtggagttgggagttcctcagggtgaccccaaacagttaaatatgtggcatttctccagtgtttacacagttaaaatgaaggataccagagctgtgagaacaatattgttacatgatacttggaagtgtttttaccacaaatgataatctatccatagcaactaagctagtacatttttgtatagagtttctaatgcagtccttggggaaaaacagaatgaacaaaaaaggaggtctttgtgcattgtgtacagcttgagggtctcggagggttttaatttctgaaaaaataggggggaatttgttgcagcggaacggaatacctggcagtccctcattggtgggcctcctgtcagccaaggcctgattggccagcataagtaggttttacagctccttccccccagctgtgacatcccaactgcttcaaggaaagaatgcaaggcaggaatgtctcaagaagaatagaatgtgcatgttttcattgactttaatctcaaggcactgaaactgtgtttgtgtgtgtgtaatattgaaagctggcagtaagagagtgtagcagtcaagccaagaaaattttttaaaaaggttttgagaagatatatctatctcattgccaaatttgtccatggatttgtatgcccccaaaaaagcatatttagctaagagaaggctccaaatatgtacagcttaattagcccttttgtcattgtttctgagctgagccataaaaagtcttacagagaggaagtaccaaacattttacctttcttatagaggagaccagaagggtgaaatgacttgtccacaggcattgaaaacagccagaattcagcctaagtgcccatgacgcctgcctatttttgaaggactaggtcctcattactcagtatcctggtcccagatgcagcctgacatgctgccttgcctgtatgttcagataatctctattgacttcagttatacaccacttgaaaagtattccaagttaaagaaggtcgtcctctttctcctcaaaccctcctcctccgatgcagtgaggtcagaactcagaactatttttatttccttttttctctttttcttttttttttaagagacaggatcttgctatattgcccaggctggtctcaaactcctggcctcaaggaatcgtctcgccttggcctcccaaagtgctgggataacaggcgtgagccaccgcatccagccataactgtttagaactgtgctgttcaatgccgatagctactagctgcagtggctattgagcacttgaaacgtggctagtccaatttagatgtactgtaagtgtaaaagacataccagattccaaagacttagtatgaaaaaagtctaaaatatctccatattattgattacatgttgagatggtaatattttggatatattttcttaaaataagtgattacacttaatttcaccttatttcttttgagtttttaaaaggtaccttccagaggccgggtgcggtggctcacaactataatcccagcactttgggagaccgaggtggtggatcacttgaggtccggagttcaagaacagcctggccaacatggtgaaaccctgtctctactaaaaacacaaaaattgtccgggcatggtggcaggcacctataatcccaggtactcagcagattgaggaaggagaattgcttgaacccaggaggcggagtttgcagtgagctgagatcatgccactgcactccagcatgggcaatagattgagacttcgtctcaaaaaaaaatgtacctactagaaaattttaaattctgtatgagatgggtattctatttctgttggacagcactgctctagacagttgtcacttaaccatagccacacattgtcttgagttatctcttattagattgtgttgttctgttatttaaaattgcatatattcattcccctagcttctcacctaagctacaagctccttagagacacagagtgtgctttactcctccttgagcccctggcacttggcatgatgtttggtatgtttttgattgtcctgtatattacttatagatttcatctatttccatgttagatattgataaggaaatgcagattaatttgtgtttggattgttgcttttcttttcaaaggaactgattttatgtagttcttagtttgttccacaaagattaacattcctctaaactggactattaaaatccaggggacctgtagagggtgccagaacttcctgacacccatgcctagtagagaacaatggtgttaaaattgatgcttacaggttttaaggagcccctcctgaccaccccagaaatcttgagaagttccaaactcagctcagaaacttgtgctctacttttcaggacctgtctgagtaataggtgcaataaattaggcatgttggcccagggactcccagccttaaaccagggttgagaagagggtcaccaccagcctgagtcaatgagtaactgtcaggaactcctaccagatggctgtgattcccaaagtctctgagaaaattctaggagacgcactctgggtgggccttaccctttaaacatcctgcaattttgtaactgagcctgtggctgaaccacatgctcataatatctaggctggctagcttatgcctaaaacatagtcatttctgctggtgctctgggagagcctgatctttccctgatttcatgactacaggatccctgtgccactgttttcagttcagatgttaaagaatgtgtaagaatgcactcctggaaaccactccccttcaggggcagatatattaggtctcactgctgtggaatgatcccactccactgaccactttattgctgtaaacagtgaatagggaactatctcccttaggtgacaaagtgtgaaatgaatgattgtctctttagaggagtagttggaaggatttgtaatgatcaagacttagaagcaaagatggtcccatctgctgaggctccccagcttcccagcagcagaaccctagaaaatcctcctgtggctgttgaatcaagggagattaaggctacaaaaggcagttcatgcccagagcagtaaattagggtttgtctttcctaggttattgggtttgggtttgggtcttttgagtattgaaaaattcatgcccccttgaaaatccagtcccaaaatttatggatgggtttctgggggcccatagataccaggttagcatcctcactctctaaaataaaaaccacaaattttcccatcccataggcagcctagtaattaaggtgaccatgtgtcacagtttaggcctgttgtccaagtgtgtctgtttaaaaggtttcctttaactctcaaatgtccccatttggatgataaaatatatggctgaaggccacactcatgggtgctccagagtgatgcataaattaaacttgcagcctccctcactgatcctcactcagctccagaaagccccagagaccagagattactcttcagcacaaactctcctctgagagttcctcattccttcctttggatgccctctgaagggagcccttgatgtgcatttgaaattgctccaggggtgggaatggggattaggaggaatttgagggagagggccttctagagcctgggcgtgggcaagctggaggagccagccatgaagcccaagcatgatgaacaccactggcatttccttggaagactgtattcctcggactccaggttttccccaccttcttcctggccagcagttgctgtggcaacacaatgtctgagaacttctaattacatctgtctgcttctcctagaaccctactgagccacacatatggagacttcatttagctttgagtttcttgctgggttttaaccctgtctgcatccttaggctagagaataattgccaggatgctggaaccttaactgctttgcagccacactacccccagagattcccaggactttgtccctgttttttgttgttgttgttgttgctgtttgttttttgtctgagacagagtctcactccgttacccaggctggaggacagtggtgcaatctaggctcattgcaacctctgccttccaggttcaagcgattctcgtgcctcagcctccagagtagctggatttacaggtgcaagtcaccacacccagctaatttttgtatttttaatggagaggggggtttcaccatgttggccaggctggtctcaaacttctgtcctcaagtgatccacctgcctaggcctcccagagggctgggattacaggtgtgagccactgtgcccggcctgtccttgtttttaaagtggagactggtgctactttgctatgctgggtctcccagatccattttgtttcagtcaaccctgacatccctactatccccccagcctccaccattgtatcagatggtctcacctcttggttgggcatcacagttcttactaatgtgcccaatccaaggggagataaaccacgtgggcacacctaaggctttgctgtcccggcaactcgtgtttcagtgtattccagcccactgcaaggtcagcctagtggatgagacagaggggagtagttagagatccccagaatattttgggagtggaggaggggtagagcaaggcaagaagcttttttcctggtctagaaatgttggccagcctgtctccctctacctcagaagacagtgtaagggcggggttcctcagaagagttcacgcaaagcactggcctcagataataagcccatttccacagtttctcctgccttctcacttgcttctcttcatctctacttccccctagtataggcccccaaggtatcaggcagctctttggctgcccctaccctatactcagaaatctcacccaattttgctttgctctgagataccccacattcccacattaccttatcttcctcttcaccaaattctcattctctcagcatgtctcagttaggttaaatatttaaactgtggacaaaggaaatgactgaaagccattttcgtcctccgttgctcttctacctcattaacacacatatgcatgcacacacatgcacaaacacactcttcaatgtctttctgtgggcctaagacaatctctaattagtgaaattccaggctgaatatatatggcctggtggtggagggcagggtctttagggtatttcctcaaagaagaccagttctgggagggagcagccccaggaaaggagttggcacaggtgttgttcctctctgtccctatcccaagtccccagggcagtgtggttcaatccacctttttttgctttcaacaaaggttaatggagtggcacaaggtatactaggtcctacaaaaggatggacaaacagaatctttgtcctctaggagcttgtagttcagccagaaagacaaaatccacacagtcagttctgtttttaaaaaaataaatgatcaaaatgagttcatacaaagaggaatcaaagttcagagaaggaagggggaattcataccagtagaaagtaaaaggtcactgaggatggagtggtgtaacttgacccaagccttgaaggacagggagaatttgggcaagccagacaacaaatcagacttcccagatggtgacattatttttttaggtggtcttgtgggacattctctgcctatctgaaggttaaagaagcatctgacaattcctcatcatgctgacattttcaaaggctaatgagttctcatttcaaaacatagagccttgggagccctagaccctttttttaaattttagtccacttacagcttaaatctgctgtggctacctgctctgcttacagacacttcccaaagctttcagtatccagggtccctaagaagtggagggttgctcgaagtgaggagcccacagatctcgaggctacatgaacaatgaagtcacccaggagagaggaaaaacgccctgtgccatatgccaaagactttgttaacagtgcccaggtagaaggcagtaggtgacagtgtcgggcatccaactcagtgccagggcatgtggaccaccgtcgagaatagtggcttggcttgcaggtttagggggaatcatgtgcaaattggggtaatggaaagcagccacagaagtgatgggggtactgttccagctcagggaagcaagcaagctctctgccacagtggattctattcccagcaggtctgtggtatcaggaaccacccagggactacttaaattcagtggcacccaaggcaaaaatgggtggagtggagaactagatacctcttaggcgatatccatctcatctgccttccaccatatcaggggaataaatcctacattccacttggaactccaaagaatgcaaatcctaatgggttcagggcttgggaagctgggggtgggtggagggtgggcttgcatgggatggagggatgggaatgtgtagggatgttggcccagatgtggcaggcactgcaggggatgcttctaaaactgcctgtcttgagaattttcccacagctgccctagagctttctcccttctttgatttgaaggtactgggatttaggtgtgtgggatttttttttttaaacttttgatcaaccattttccttgaactacatgtggaaataattagagcatgaatgctgagtaaatgtgagccctggcagccccagacatacttcagtgacaggttcttggcaggaatgaagaattgtgaatcgcatgtgaatttcctttagcctttctctcctttcttttcttcccttttctccttgcaaggcaaatgcaagtagaataaaaaatttattaatagtattctaggggagtagagggttccacccagttcactagaaacaaaatcaggacactcaattggggttccattactgcttccctgattccctctgccatgatctgggagggaatgaaaaggcattgcttatgagaatcctttgactatgagagccaactttaatccccccttcagaacctagcaacaccctcatgtgactgtatacataaccactttctttagtttggccatttaggttagcttccttgggagagtgaagtttgatattcaggaacatctgaagtggtaaattcctgagctttctaattaatagaattcttacagcttaagggacttaggcatcatctataacctctgcattttatagctgaggaaactgaggcccagagaggtcaagcaccttgccccatgtcacaccatatgttagaggcagagatatatccagggcccatttcagtcctcctgcattaattcttcttacacaggacatcactgcctctgcctggcttacactccaggttactagttcaggtttcagcagaagtttaaaagcttttttttttttttggctgttttatcccgacatttgccaaatgatttctcttacatggcattcatcatccatttctgggagctctctaggcttcctggttttcctcccaattctctgaatgttcctactctactctcggctgctttgctgtcagagttctcataccattgtgcaggctgttgactgcatgaggaggtgacaggggctgaaatccaaactacactctgctagccaagccccataccctggccatgtgctgcatctcctggagagaaaggtgccttttctgatttgcacagagaccccttgtgggctgttcttcctgctgtctgtgctcccccttttccttccacgccctagccgccctcagccttccatgcccacctttttctcctgagctcatttgttcctctgcctcaatttctcacccctacacaggtgacgcccagatatgcatctttagccaatattggcagctgtcggtgggatgtttcactgtccttgagacgcgtccataactgactcatcattgcccaccccaccctcacgggacacctttcccaggcttcatttctgatagagacacacaaccaaccctccaggccctagaagccaaagatctggcagccccccagactctctccttcctctctctattcaggatgttgccagacctcgttattctgtagagatttctcttggatcccttccttctataaccatgccaccactagtgtagatgcaactgtcatcaccccaggcctgttccaactgatatccttctgcctgcccccaattccgccttacccatttcttgccatgtgccactgttcaaatgtttttcttaacactctcctgctcaaaaacctatagattttccatccacatcctacctttcttaagagctcggctcaagtcccatctcttctatgaagtcccatctcctggagtcggccccattacttaggactgcattggcctgtattcttgtttcatcagctcaactaggttagacactcctgtggtgggggcagccacatcctctgctcctttttgggttttttgttgttatttttagagacagggtctcactctgtcacccaggctggagtgcagtggcatgatcctagctcactgcagcctcaaactcctgggctcaagcaatcttcccacctcagcctcccaaagtgctggaatgacaggcttgagccactgcacccaggcctcccttttgggtttatgccacggagcttgcgccatgctcattacagaccgttctctttttttgttttgctgttacaggcattcatcaaatagcattttgatgggtttaaatcattttccttggccattactgaagaagactggaggatttatactctctacattggccttcaaagtggacaagtcttaggtagacaattggagaggagaaaataagaaccatattcaaacctaacaagctaattcagggcagataaatggtctgtattagaaacttccacttggactttcctaagaaaccgaagggtgaaattatgaaactagtggcagccttacaaaaacattttttaggaagagtgacaagatatcttgggaactcctaagaatcactctgaggagtgttgctttcataatggggagcccgaaagaccctgtcagtagcagtggagtcactgggtgttcctgtgttgagaaggcggtgtggtatgtcacaggggagactctccaactcgtcactgtggaccatgagaacagaagcacctctctcaagtaccggagttggagccacctgggtctgactcttacctcagtcatggcccagctcttgaagtcacagtctcctcagtgcaaacagggatgaatccctgagcctcacagatctttgtgagatgattttcagccctatatgaacaggcctaacatgtttctaactctgtaagtgcttactatactgctatacttctgctatgactagacaagaccattgcagaacacaggaaccgatcattctatagaaaccaagcatctagtgtgctatgctgtgtctgggccacctcaagaaagctctaagcataggcagcatgaggcattccagagatgacatgtgagcagcagtgaaggagagaggcttccgtgtgaaggtggcctgagccaacctagattcttcagtctgaaaagacacatagagaatgtgacagaatctgtaaaataataaagaaaatggtggaggtaaacatcactgtcccatttgaaatttgaatatagtaatttccaggcacacaatacgcaatgagtagtaaaaggaacatgttatatcccataagctgtgatagaggctaaacatagaaattaatcaaagggtaattaaataattcttgattgaccgggcacagtggcttaggcttgtaatcccagcacttcggaaggccgaggcaggtggatcacttgcaatcaggaattcgagaccagcctggccaacatggtgaaaccccatctctactaaaaatacaaaaattggccaggcatgggggcgtgtgcctgtaatctcagctactgggaaggctgaggcaggagaatcgcttgaacccgggaggtggaagttacagtgagctgagattgtgccactgcactccagccttggcaccagagcgagactccatctcaaaaaaaaaaaaaattattgattgacagcttcataatagatttttttaaatcttaaagctaatcttcgtcaggcgatatatctcttatctggatgtcatggagcctggccatactgacccaaaaacatccgaagtgccactgttggctgctgcactaacctgaagagactgtaaatgacattttaaaataatttttgtttatttttaagcagctttattgagatatcactgacatataaaaattgcatatatttaaggtgtacaaatgttttaatgttttaatattcatatatatggtgaaatgttcaccataatcaagctaattaacatattcactacctctacatagttaccattttgtgtgtgtgcatgttgagaaaatttaatttatgatctatcctcttagcaaattaaaagtatacaaacagtattattaactatcatcgccatgctgtacattagatctccaaaaattactcatcttgcataaccgaaactttgtacccccaaatgacatttaatatacaaaccatttgttgagcattttctcaggcagtacactgtggtgggtctgtgggaagctgaagtgtgcaaggctcttagagtctacttgagataagccatatgtgcatcagatattgaataggactctctctaatagactaaggacccaaaagccattattggaaagattttgtttatgaagaaaataatagggcaaatggggagttggattaccatgaagctaattaagctttgatttcagaccttttatttgcaagggtcttgcaaggccatttacccaatttgcatttataattgtatatttttttagccctccctaaaccatttaagcttcaggccccacaaaaccagggtttggccctagtgcattaaccttgagatgagggactgattgtgagcacatataaggaagggaaacttatagcagggactgcacacatgcagtgccccctgccacacacatcagaaccactgctagaaatcaccagtccctcctcctctgtccatagcatatgcaggatgtaccaacacatttctttccagaaaaaaagagagacttgaacaaggtcatgagatactccagcaaggtttcaaggtcctgaagcggttttgctctttctctctgcttttctcaggcctgtgctactgggttccagaagagctgcctgggagcaaccagcatctcaccccatacgccccactgcagacctccccctgctctccccagttctgtgaattcctttgtccccagctccatggtattctgtgtatatctgaggggccctggtgttcctgtgaagtttccatgactaattctggcaaagcaaagagagcctttctcacgtcaacaaagccactctgtcgcagaatagtggcaagtagagccaaaattccaccttggcataagtagagctgttcttttttaaaagagttggaaggaggaaaagaatggaggggacagagccggcccacttcatgttagtgaaatgatggtatattaaactgacagttttatggctttgcttataagcttcctttcctgccaaagcacactgttcttccagaaattattttacttcagaagacttttttttaaacattcaacgtgtattttatgttcagacttaattctggttggcccagagactcagatgcacgatcacctctactggtggttttgcaaataacttgcttctccatttgcttgcaaagatcttttttgattgcaaaaatcatttccattttttaagaccttggattcaagacatttcctggctttgatttgtaaagaggtagagtggtttagtggaaagaggctgggattaaagtctggagacctagggccaggcctcaattctacaactgtgagatcttggaccagtcacatgtagctgtgagcctcagttttattttcaccataggatcttaaatctagaagggcctcagaggtatcccctgcctgcctatctaaaaagaatcaaaaatgacagtaaaattacagatcaaccagaattgctgtgcaagtatgaatattgccattcaatggctgaccgttgctcagatactttctacctagtaaaaagtcaggaatgttcccagtctgtcttctaccaaagggagtttgcaatgtgaaaattaatgagaccaaatctccagagcttggcttgcaacacacgaaatgaaaacaacacggagactggtcaggaagatgatgcagaaggataaagctagaaatctgatgtttctccattgcaggcagatattttgctgatttttatcaatatatctgagtgtccacacttccaaaacacaccctctacccccactcaaatcaattacattctcacaggtacatttagacttataggttcatacttttgtgatattggacctgcctgtgacctcatactcctagaaaacatccatgtgccaatgtggttatctacgcatacatgaagtcctcatactgctttgggacctcattcctaaaatcattacagtggtagaacaaacacttctatttgcaagaactgcattgtaccttgtgacctcaccctgtgccagcccttggaactgtccccactccccaaagctcactgccttgattgtaccccaagagggaaccttgaggctctggagtcagactggcctttgttctattcctgagtcagctctcactagttatgtggcctccatgcgtcacagagctttcctgactctccgatgcctctgcatctgttacatgggactaaaaatacagagacctgcacagaggttgtgaggacagagatatctgcagagcctcactcagctgaaggtgctaaaattaacattggccttgggtcctaggcccttgtcatccccgactagattacagtcttaaacctggccggttttcctgcttgcagcctctctccatccaggctgccttgcactttgaatcagaatttcagaaaggacccaacacaaattaacattccaaagcaccatatccatcatgttacctacccaatcccaaaccttccaaggttctcacttctcatagtcgctgtggagagcccctcaggtcagccatcgagcgccacccctctccccatcatcacctgccaccctgcttcatctccctcttcctcaccacgagaagggttgaacccatgagcatgttcaacccctctcaaggtgttcttttcccccactcagaatcagtttctcagtagatgggtaagactacccaccaccctaagcaactttctaggcacctcggggatgcacctgacactcccactcccagagaagatgaggcttggagaagagctttcaatggcacaaagcctatctctctggagaaaattttcttcattgttgatttctgcatcaaagcatgcctgtgaatggggatcactggggagggctatgaggctgcaggtgagacctcccccacattggtagatccccctacccatgtttttggagcagccaccctattcttccacctcctgcaccacttcttgttccgaggacagagctgggtggagctgcaggagccaacactgcgcttctgcattgcagtgctgggctgtgcaagacagagagagattgccacctattgacagacgtgtcacctgcaaagaggaatgattgtgtaactagtggctccccccttctctgtgtgctcttcaaacgggccttttgttttttccattcagtgagtccttctgttctctattatcactgcagtgcaagggaggacagggaaaaacggggacatgacagcccaaggtggtagtgacagcatctcagtgggaaagttgtctgaaaataaattgcccactgtagtaatagccactttcagttgtgtggcaggcactgtgctgcctgcagtacatcccgtttaatcctcacaacaaccctctaagaatcagtactcccagttttcacatgaggaagctgaggtttaaagagagcacctggcccacgaccagcaagtaaggaatagaggtgggatgtgggtaatttaaacctaaatctctgacgcactcttaacgcacattctcccgacacttgctaattatgcaactcacacccccatcataatttccttacgtcatctggatatgaaaataaatcaaatataaactgctttccctttgggcagaattctagctctgccactttctagttatttaagcctctgctctctcacctgtgaaatggggctagtaatgatgtctaacttaaggagttattgaagagcttaaatcacatataataaaaatagtaggatgccggatatttataaatgggagtttagttatcagtggttgaagatacgagttggaatcctagctcctctcatttctagctttggaaacttgggcaagttatctgacctttctggtcttcaatttcctcatctatggaatagggttaataataatatacctattcttgcagggtttccctataagacaaaatcatgtgtatgaaaacattttgtaaattgtactattcaaatattagttgttataactcaaaagttatctgtttcttcaaatggatttttgagaactattcctgaaaaatgacttggtttaattcaatccgtttttaatacttactaaaaacaacaatgtaagttaaaaggaggttccatacatgccacaggcttttctgcaagtagctctataaggcattcccatgaataacaggtttcatatgcagcttgttttacagttggtacttccacatgtatctcactgaatctccgcagggcagggttggcatttacccctactttatagatgaggacatgtgagccttaaagaatgaaaattactagttaaggacagagactagtgagtggaggtttgtgggtgtttgcctgtggagctgtgtgcgggtgtctttgagtgcaggcatgtgtctgagcatgcttttttatgcatttgtgtgtccataactcatgggaacaactcgtcagcaaaaaccttttcctcttcctttttcgtgttgccttacattgtcaggcacagtttccacaagagggccctgcctggagaatatccttgatttttatctccactctctgtttaggaaaacaaaagctctccaatccccgcggacttctgggaattacttcctctttcttccccgcctgctagctttcttgaattcgccttagcaacattcaaaaaagaattggtttatcaacagcatgtgaaccaatgaaatgtgagctgagaacggcttctagaccaatgggagccctgcatgaccagcaagctggcttgggacagaaaataatgacctggagtttgcagagcagcctctgggtggcagcagactagctgtattggatacagcacctcagctcgaaagcctcttctttctttttgcttttttcccctaatcttgagtataaaacattcaccaactataagaattgtactgttacaagacttgtgggtgtgagttctctgcataatgtggtagacatggcctggagggtggactgtctggttccatccctgccttaccccagccagccccatgaccccatcgtgcctcctgcagtctttgttggttttgtcacagcatctagcccagtagccttgagtctggaggtctttcgtgattttgcctgcccagccagtcaggatgagaagctggggaaatcacattctccttcatgcaaccaccactacccctgggttgagtggtgaatgaggtggggctggctttctgccaccagtgaatgggagggaagggatgagccaccaacagatcagtgcctgtcaatacccccacattctcaggtggcatacactgagaccattccctgccttgtcagttctgctgcacacgtctgaacaggggaatgcctgactagcaaatgatttgagaatagttctactttcaggcagcttcgccctcttaatcttgaagacagtggcagacatgggtaggggctaaatgggaccatagcaaaaatagcgaatccacgtttccaatggtttagccatccttcttttgccctttgagatgataatgcctagaacaccattcagtcaggtttgggtccttcagatagtcatagttctgtacaatgtttccatttctgcctgacttactcctctcaccctttaagaatcagttaagacctagtatcttcagaaagtatcctttgaaaaattctcaccctcttcctcccctccagctccctggtgatcctgttcttgcacttcctgtgttgttttccaaatgtctctttctttgtgagtttcctctgagagtcatggagcttcctgaggacagggtctgtcctttgtatctccatctcagcgtagtgttggcataaaattggtgctcaacaagcatttttagaagaaaggaagcatgcaagaaaggaactcttgctctttgagaaacatattagggactcagaagtacctgaacctgggctgaagcagtatctgggagtagggcactagctgttggaggcaacgtctccaacagctgtttaagacccaacatctagctgtttaagaccatgagccatgactccagagcaaagcccaagcctgaaagataatctcattatgggctcattccataatgggttcatctcagtcacacggtttcctttatgattgtatgttttaggaagagctaaggagcaaatccaagatctgtgccaatgtgttttgtggagccggccgggaatgtgcagtcacagagaaaggggaacccacctgtctctgcattgaggtaagtcctgatgtcgggagccagaggacagtggccaaggccaatgtggtaccttgcggagccacccatcagcaggcagtgccaatgatttcattctctttataaaagcattcttcatccccctgaaaaacgtggaattcttattccagattcctgatttttaaagcatggatattttttcttttaaaaaaatttagctttataagattttttaattaaaaaataagaattgttttatataagtcaaatagtacagacatttacacaagcataaaattataatcttcccccataacccttcaatcccttagtctgaagtaaccagcgttaacaatttggtacatgttccacatgtttttcttttctatgttactataagcatagggtttatatgctactgtagacataatggttccccctattttatgcaaaaatgggatcatgatatggatatagatatatacagtttgtattctttactcattaatttatcagggacaaccctctagatcagcacatatacttttaactcatttaactcattgtagtggcataatgtttagtaatataaaagaactagatttattcaatcattttcccatagatggacattcagttggttctttgggttgtttaccactataaccaataacatccttgtgcaaatacccttatatgcccctgcctttatttctgtagcattgattgacaccagggcttgctaggtcagaggatatgcaaatttttaaaaacagtagatgagatgcagggttttttttttttaatgtttttttttttttgaaaaacaaacatgaatatgtatttattccattgtataaaagcaataatttagaaattaaaagaacgttgcagagatctctaaatagagctaaagattttttttctttctttcttttttaatttatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcatgctgccttcaagcgtctgtttaacaaagcacatcttgcaccgcccttaatccatttaaccctgagtggacacagcatatgtttcagagagcacagggttgggggtaaggtcacagatcaacaggatcccaaggcagaagaagttttcttagtacagaacaaaatgaaaagtctcccatgtctacttctttctacacagacatggcaaccatccgatttctcaatcttttccccacctttcccgcctttctattccacaaagccgccattgtcatcctggcccgttctcaatggagctgttgggcacacctcccaaacgggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtagttcatgagtgagtcagccatgatcagctgggcacatcgagactgagtgacgggcaggcctgcatcccggcactcgggaggccgaggctggcggatcacttgcggttaggggctggagaccggcctggccaacacagcgaaaccccgtctccaccaaaaccagtcaggcatggcggcgaactgcaatcgcagcactgggcaggctgagtcaggagaatcaggcagggaggttgcagtgagccgagatggcagcagtacagtccagcttcggctcaacatgagagggagaccgtggaaagagagggagagggagaccgtggggagagggagagggagggggagagggagagggagggggagggggagggggagagggagagggagttttttttttaatgtttaaaaaacaaagagagcctttgataaatacttcttttgtaggctggattctgacaagttctgccactaaagtgaacataaataccttggacattctgttttctgtcaaaacaacccatagcctggaaacacgtctttctgcaaattaaatacaaccaatttagtccccaggttaaggatcctgatttgttgccccagaaaggaagttttctaactcagaaacctaaaagccagatcctactggggatccattagctctgggaggtcctcactggcagtgtacctggccacagtgtggtggcataagcctggacttaggatctagaaacctgatcctaaaaattgtacaactagatgtgggtgagctgagaccaaacctgaggtctcaggagatgctgtgaagacagtgcccacatttggttttgcccgttgcccagcacatagtgagcactccataataaatattggttcactgaaatttgtgtttttggtatcctcaactaaaactggaaaggttgggctgccatccacttccagtgctctgtgcttctttttaccatctgctctttcttgtttcagttcctttctttattggatctgagctaaatttacttcctgcttctcccctttaaaaaccatagaagtccaaagaaactgaacttgcctgtgatcttggcaccttcagcagccaaagcataacctagttgccatatgaactttgttccatttccctgtccataatgattctctgtagtacttcacaaagacccaggcaaccctactcctagcttcacaacaaaggcttgagatcaggaggaaaacaaagtgttcccccaatagtatatacagcaagagatccttacagttaggctgcagaagaattggagtgtgtgtgtgtgtgtgtgtgtgtgtgtgtgtgtgtgcgcgcgcgcgcgcgcgcgcacatgtgtgtgtgtttgcctgcctgcctatcagcctctccacattcccagctctcagctctggctgttttgtgtcattgaatgttggaatattaagggatcttagatcttctgagacattaaattactttttccaaagtgacagagaattcaaatttctggcttttaataaaacgccctttctgctcatttgatgtggggggtgtctttgtttgtttgggctgctataacaaaatatctgagattgggtaattaataaataataagaatttaattctcacagttctggaggctgggaagtacaagattgaggtgcaagcagatttgatgtctggtgagggcctggtctctaacttccaagatggcaccttgcatgtggcatcctcacatggcagaaggcagaagggccaaagggccaaatgctgtaggaagactgttttattcacttcttaacctcatccacaagggaggagtcctcatgacctaatcacctcctaaaggcctcacctcttaatacttttgcattgtggattaagtatcaacatgaattttggagggatcacaaacattgaaactatagagggtgtctctttcttcactgaatagaagagatgaccctggaccaggataggcatgaagggccataggcaactgagacagggtcagttggccagaactgtgactgcctgtgccctgatggggtagaagcaccatctctggtggtggagagtccccttacaaaatggctctgtgtgtgtgtgtgcatgtatgtgtgtgtgtgtgtctgtgtgtcgatatccataactgcacaaacattctcttttgggtctgtttcagcaatgcaaacctcacaagaggcctgtgtgtggcagtaatggcaagacctacctcaaccactgtgaactgcatcgagatgcctgcctcactggatccaaaatccaggttgattacgatggacactgcaaaggtaaggtgtgctctcaccactgcaaggcagctttagccacggggagccaaggaacagagcagtgtggcctggctgaccacatggtctttcctccacgaccacagcctctcaaagctgtggaaagcgcccagttggttggagttgcatcctcttgtcacttatgagcctgctgggtttgccctggatggcccaggcctctgcccagggtttgctatatcagatccccatgggggttttcagcactgtctgcagctggatagtagatagggtggaccccatcagtaaatcagtaacaataagaaagttccttaaatgaattatgtacctttttagaaagtaggtaagtttcacttttcccatgctttttaatttgggcacctctcagtattgtttcctctattttgcactgaaaccactgccattagaataagaaggaagaagtcccacacttgttgctaattagataccagccccctgccaagccatagccctgcccagcccctctcagccttgcccttccttgaagaaacaagaagctgtttcccaggtgattgtctccactccattccctgtccagaatgattctccatttgaattctcaaaatcccagtgacccctcaatgcaacaggaggaggtatgaggccagaagggtaactcagtggccctaaattgtcagacaaagcaggagacagaagatcctcatacctgggccctagaagaaggaaaggaagggaaaggattcaagacaaaatgatgaaaaggttacaaacattcccctacatgtagagcagctgtaatcctagaaatacagaaaaattttcttttttccttcacttcgcattacacgttttctctttttgtcttgcagagaagaaatccgtaagtccatctgccagcccaggtgagtgcctattttttctactgtgtgcatctcagggaggacattcttttcatgatagaaattttgtgttccacaatccctgccaagctcataagatcttctatgcatcagaattgtgtcccagaactggccactcctcaacacagctcagaaaagctgcaaaactacatttgtgtatgtgtttgccaattgaagcagctggttgggtcagaatgttggctgtgttttcccatttttcctgagtagtgattgaactgcataaacaggaaagccactgagttcatttttcaacatcctataagacatgctcgtgtcatgggaccagcaaatagaaggcacaactctttttgaaaggggataactggaaatgccagtaagacttctgtggttttctattagtgatcactaaaattttatcatgatttatagttacagagcttttttgcacatactttccttagattctcacggtagcctttgtgaagtagatcttattgtaattaccatatagatgaggaaattgaggctcaaagaggctaagtgagttttctatatcacacagctagtaattggcagactggggaagaactcccagattttcattcccctggcccagtgcccttttcacccacagcatgtgttgtcttccaggaattctcttttgccaaagctttctctcctctgcttccccatccactcaactctcagcaccccctgttatttccagtggacaacagctgtccagagcagggcttcgacgtagccctcactggccttcacattctgttgttcataataaaggatgatgcaggtggtatacagttgtaagtggggggaagtttggatggacctagttggtgagaaagggagaaactggagaaaatcagaaatctagtagcataaaaactgtaatattctcatttattcatgtattatttcagctcatctttgagtcaagagagctgctttattgattttttccccttcagcttcctaaagttaatgaaagtatcctttattatttttctgctctagttatttctcacataagcagcaaaatctctctgtttcaatattctcaatctttacaaatattttagagatgggtgcttgaatcctgggctagactttttccagttgtgtaccctggatgtgctaatcctatctccctgtgttgctgggatgacatatgcagaaccatgggcacggatgctcccacacagtgggtgccagatatcactggggtcctcccctgactgctccagctgacatcctccactttcctgcagttgtttgctatcagtccaaccgtgatgagctccgacgtcgcatcatccagtggctggaagctgagatcattccagatggctggttctctaaaggcagcaactacagtgaaatcctagacaagtattttaaggtaatccagaggtaggaggaagactattcaggcccatagaaagggaagcttcctcctcccattgcccgatcacaccttcccagaccacaggaaatgtaaacctgcacagacaccctgagtttcctcatcatagatcattcatgaagctgtgaaagttgccttctgaccagcttgatcagtgggagtaagcagtggagtctttgggatctaacacacatgtgctgctgccttcaggcagtgaaagccacaaaggtcttggagaacctgtcagttagggccaagctctgtcccctactcgccatgacaccttatggatctggctgttaatacaaaattccctctgattgcacccagacctggaccactttggcctctttcctgcctagtttgacatttctctaagtcattaacttgactgccaatggcttggagagagtcttcatatgagaagaatcaatggactggcatttcatgggtccagagattgttcctgaacttagatattgctgttcccaatcataattagttgaagagacagagtgttccacttgggagcaggagagatgctattttcacaaagagaaatgaaggaagctataatatttagtgatggctcgggttatcatgccatgcagatctttcacagaacttgagagttagaagaagcaattaagggcattcttacagctgattgacaagaacagacacacacacaggtacatcacactcagaatatcacactcagaagcacagagaaggacacacttaaactcaaaacatgccagacacgcacacacacaccacatacagagactcacatgccacacagagacacatcctacatgcagacacattcagatacccacatttccatgcaagcaccaaagccctcttcactaggtagatgccccagccatctactccctcacatgcttccagggcccaacccagccaggactcaggagcaacttcagacacatgaaggacttttcttggcagctctgaggccacctaatgtggccaatgccagtctagtctgtggatttctctttctgacactatagaacccgcagatgaagaaatactgggttggcttcaaatggatatttggtcatttaagacttcacttgtgtcatttttacatagagatttctctcctctatggcagatactaaatctctggattccaagtttttgagatcatacccagatgaaaaagcacagcctttcttgctctgtcctctctctcaatcactcccacattacagagcccttagaggaagaatggttcctcttctacagaaaaacacatcatagtgctgagccaggagacttggacaggaacagaaagtaatgtaaagaaagtgactgttcaaaagctgagcgaatggtaaaggtacctgcagggcctgctgtgtgtgagcagtgactttgccctgcaattacagcataggaggtgtggggcccaggacactccttcccaggggccacttaggacgttgtaaccattttttagtggccctttgatggcactctgcctcaggcatcactgacacctgctattagatttgattcccaagaacctatgccacattcccctcaacacatctccatctcctccagcagtaactcacttttacaggctcccttctgaaagctataaggccctttgggaaagtagctcttctctaggacattctcacaaccaggcatctaagaaagcttgatcatgactgacagacacaaaatcccctcttcccagacactctggcagtgtctaacaggagaaaacaggtttcattttctactttttgatgattatcagagtcttacatgctgctgtcttcaaagggagactgcctcctcctaggtcagcagctgcctgttggtgagaggtctgatatctcaaagagactgttatgaaccaatgaaatgctccccagcccagctggcatttcttacatcaaaattgttcaaaaaccaaattgaattagaatttgaataaggccaaaatctgactttcaccataaccagtgatgtagtcactgtttcttaggtgaaagcgtaacagaatgaagaaagaaagacccaggtagaaagagccttccatgctcttggaatttggaatctaatccattcctaatttcatctgggtgtgatctcaatccctgtggctcctgatggccagggctgacacttgagccagccttcttatctcctttaccctggcaccacagcccacacagccccagctgctgtgcacaagcaagtgcctgtctcagcccatctcctctgaagagtctccaaacttacattgataagccccaagaacagatctcatgacatacatcttttctgcctttccacaaccctacagttagatagaggaaaagttttgttacctcaaatgctgaaatctgaaactttttgagcaccaacatgatgccataagtggaaaatttcacacctgaattcatgtgatgggtagcattcaaaacacagtcaaaactttgtttcatgcacaaaatgatttaaactattgtataaaattaccttcaggctatatgtgtaaggtatataggaaacagggatgaatttcatgtttacatttggatcccatccccaagatatctcattatacatatttaaactttccaaaatctgaaatctgaaacacttctggtcccaagcatttcagataagggataatcaacctgtatagagctggggaaagaggcacagagagatattatgtctttgtaactgactggctgaagagaggctcaataaattaggttggttcatggtccatgattaggacctcacaggcagaccccccaggcattccaggctatttctggggcaggcaccagaattctgtgttcctgtggattctacatacaactctggcctggggaggcccaactggaccctcatgagttgagaaagcacatgggctggaccttcccccagctgcaggccttattctagtcctactgaagtgtgtgtacacagcactgccttttgagagctgcctggactgtggttgccaggttcatggtgcccacttgggccatgtggcactgggtctgtagctagtgctggacgtttcccctccctacactcattccatcatcaggccctgatgacactggagtctttgagggttgctgtcatttacccagcacatgcaatatttgaactcaagaaagccctgtgctactaacaatggcccccagccaaacttatttaattattttccattaattaatcaagacttcacaaggtaaacagggaagtttcgtcagggaaaattgtatagtgaataaaggacatcagagacctgttcctaggaattaggacaagaatgataagtacgtactaagcaaaggcctaatagttgtttcatgcacaccttcattatacaacattagagtggaacacctgtgacacatggcaagcaggagaggagagttgttagctacatcttccccttctatctagaaatttggatagatgtttcttccagaatcccttgcaccatctggggagccatcttgaaagtaacatggggaagctgatcctttcccagggcagcagcatgagggagcctagggaaaggatttgggaggaagggggaaaatgttattgaaatttgttaggagagcagccatatgcaacttggaatttgatcagtcttgatttgacaccctcctcctgcagctagtgcctgggtgtcttgaatggtcccagatggctgaggtctcagtttagcatcttgccatagagaacagtgtgtgagcttactgcactcctcactttgtgcttgtgggatgccagctgggtcatgagggcagcctgagctggatgatctgaggacctgtgcacacatctgcagtggggcccacagggcagaggagcgggaactttgcatgatgacccctgtctgtagcttattgctttgaggcctttgcctgagttctcactgatgtgatcagttacgggcaccaaagtgaaagttaagcactgagaacaggacaaggaggctggaatcaagcaacaagatttggaatcctataattccaaagtgagctcagagggtcatctgcattgctgctgttcctgagcagctcattagaaacatattctgggacctgctacagagattctgattcacagcgtgcaactttaaactcttgttacatgttcatcagggcttgagaacatgatgtgcaggttggtctgaacccaaaggtatagtcaaaagtgtctacagggcagtgtcagagatggggccacacagcatgcttagggaccccagaggcctcagttcaggttgcctcctctgcccaggcacttttcctctctcattgtgggcacaggtaccttctctgcatgtcccagggattagagcatttgttgccatggccctctgaggtcagggcagggttggaatgtatcaagaacaagatgaatcagaggcaggtcagctgagtggagtaatgatggaacaggggttctgcaaaacatccctgaacgatcttgtcatgccctttctagaactttgataatggtgattctcgcctggactccagtgaattcctgaagtttgtggaacagaatgaaactgccatcaatattacaacgtatccagaccaggagaacaacaagttgcttaggtgagaggaaccgagaggtcagagaatgatccacaagggaagactaactgagagaggggacttaaaccctttcccacctgcaaaagagccaccagtgagagaatgtcacgtaaaaagcaaaatgggaattctgtcctgttctattctatgaaagtatgaattaatatattgagtaccactgatatctaatcaaatagttattgtttttggtcagaacttgcaaggactagaagaatataattttaaaataaattgccaagggcacgtcagagcaagttatttctgaatgttgtgggtgatgttttactgattaattttctgaaggaattacagtaatgtattatttaactataggtctaaaatagctttgttctgatttttagataattagtgctatttcatgtcaattgccctaactgttacagatatatgcccgtctacttttatggcattattccagaatcaatattaataaaaactaatcgctaagaaacttttgatgtggtttcagcacatcggtaagaattaaaaataggaaaagcatgtctttttttcaaaagaagtgcattgcacagtttctagaaggattcttctttaataatagtctatgaccttaaagtataggttctgtaaatccttcatattttgataatctgaaattatatgttttataatttcaacgtttgagcctcatgatatcccagtgaaggagggcttcttgtcctccttttacggatgggaagacaggctcagaaaagttgaataactaactcaagtccatttgagtagtaagtgattgagccagggctcaaatacagcccaagaaagaagtgatggagctgagtttttttttgtttgttttgttttttgtttttttttgttgtttgtttttgttttgttttgtttttgttttttttttttttttttttttttgagacggagtctcgctctgtcgcccaggctggagtgcagtggcgggatctcggctcactgcaagctgatggagctgagttctaaaagcttttctgaaaatctctttctagaaggatgataatggtgattcttgcttgaacttcatattctttcaaatcctatattcctttcatgtcatctgtcatatctcttctgttttgattttcctagtttggttgacttgacgtgtatataccatggggaaaagcaattgctagtggaaggtatgcaggcagtgaaaacattagacaaaaccattcacgaaactttagtcatcttaagggggggaacatttggacagcctgggtgatctgacattcatataacaaactaaaggttagatgcctgcattggtcaggatggataatagttgtgttgggtcagtgtagagagaggctgttttagttagcagtcatcttcttggcctcctgtggaggccctgggtgtatgtggtcctgatgcttacttcctttcttctgagcgaagctgaggtcttgctaacacatttctcctgtgttttgtttcaggggactctgtgttgatgctctcattgaactgtctgatgaaaatgctgattggaaactcagcttccaagagtttctcaagtgcctcaacccatctttcaaccctcctgagaagagtatgcctaacctaagaaatagagagctgtagtgaatggaggcattttgtaggagccaagatagagaggattggtggaactctccagagctagctgagaaaatccccttccatgattctaaactgggccccagcccattctccccatggtgaagttagggccccacattctttaggttgatggtagtgtttgctcagatatagtgcttctgagggacaggcaggtcttgtctgggaaaaaagggtaaggtgcacagactgtagcaaagatgccctgttccaccctcacagctaaactgttgccccgtatttctggcccaacagagtgtgccctggaggatgaaacgtatgcagatggagctgagaccgaggtggactgtaaccgctgtgtctgtgcctgtggaaattgggtctgtacagccatgacctgtgacggtgagctgtgcttcaagcagaaagaaaaaacagcaaggagagagcttcatgaaatcagcatgagagaagttggggtggggatgatggagaagagggcggtggctgggagcaaggaacccaggcagacccacacctgtaaggttggagccccaagtggggagctttgagggcagaacatttatcccataggcattcagtttgaaaatcactccagaggcttggaataagagaggaccaagaccctgggcaaaagtaaatgataatggaatagtaacattatggaaatagtaacagtgaaagtagtaataatggaataataattaaaaatagtaattatttaataattaaaacattaaaataaaaacaataattattatttaataataatcaaaaataataatggaatagtaacagtgaaagcaaatactcagcaaaaaccatgtgccaggctctcttctaagcactttacatattaacccattgatccttataacaccttaggaaatggtaaaagactagtggttggaagacaaaatgacttctccttgccatacccagcagaaaaagaaaatatgtttgtagaccctctttcaactaacagagatgggtaatcttttttaaaaagagaaagttgagctagttgagatatgtgcagggtggtctggggagacagagaaatctgagagtttgtggggcagtgtgaggctacagggtatgttggaaccactggagtcccatctgggtcctgggctacaatgatgccaaagatcaagagggactcttaaagccgagccctagcaaagaaccagggatattcagagtggaggcaagacagagaagggtgttgaagccaggtctgcaacggagaattgccttaaggtcatttggaaccaggccgaaaagtttcaccagctagggtgaacctaaagttatatcagccaggcgcagtggcttatgcctataatcccaacacttggggaggccaaagtgggaagcccaggagttcaagaccagccttgccaacatagcgagaccatgtccctacaaaaatgtgaaaattaggcaggcgtgatggcacgtgcctgtagtcccagctacttgggaggctgaagtgggaggatcacctgagcctgggaggttgaggctgccatgagccatagtcacgccactgcattctagcctggacaacagagcaagaccttgtcttaaaaaaaaaaaaaaagtttattttaagaagttaactgtgtcaaggaagagctggctggaacctaagataatgttcaggaagatcaggttaaatggtaactaggagacagaggtcagaaacccaggatgaggctcttctagacaaggatcctagagaacagcaacagtataaatggcccagtactatctaaggtatcactggtctaccgctgcccaggaccaagtctgttttcagtgtggaacgacagcaaaccaatgtaactacagggacaggtgaaggaacaggaagaggctgtttagagactagaaattcctacaagttcctagaagtcaagaccaagccaggatctccagaccaaacacagagttgctactgaaaccaacaaaacacatctcaaaacagtcagtggcctagcctgcctcaaccatgaagcatcctatacttgtcttccctaaactcccttcagtacctctccgcttctaactgctgctgttctggctttgtaaaggtagccctccatttctaaggtgcaggcagttggtatgcagttggcttatagaataagcatggtcatttggataataatctctatcacatgcatcagacaaaattcaaatgatcagcttcatgggatgttgcccatttccacagccactcagctatgggctgctcatcctccctggatgaccaagtccagaactctatgtgggtataacatggagcaacccatgttagatggtggtgccccaggggcctgagcacgtatggatgtgtaggccgtggatctaagaggagtttgtggagccagcattctggggcattttcaggttaatacctgagagttagcagtctgatcttagatcacaaatcaaaatgggacaagcaagaaggggcatcaaaatttgaagccaggaggaggcagagccaagggaaactgctgtgaagggaaggttgatagcaatgtttggaagatatgtcctagaagtgtttcctaatggtcaacattctacttgataagcctagagatttcatcctaaacctagtaaatcagaatttgcaaaagagcagcttgggaacctgtgtagtttttgtttttgtttatcactgtgcaagtttcagaaacattgctagatgaaatggttgtcaaccctggctgcacattagaaccaactagaaagacttgtaaaaaaatactggtgtccagatctcacctcacatcaattaaatcagaatctctgaaggtggaactagacagctatcttttcaaatgttctccaggacattttgatggtatatgaatgacttgagagtcattgtctcagagaaatctccagtgtcaggatccaagttttcaccataactttttttgtagggccagcttctggctgggatgtgctaagcagttaaaggaacaaaggccagagaggagttggggtagattgctttgttacaatgtgttaccttggaggtatcaattacacagggccccttcatgccttcatactcagaaaatgtgggtaattcacctctccttccacaagttaaatgggagatgaattgagagcctctaggtagatcttggcggattcctcactggcttaccacagctgctactgctctgagctttggttcttcttgcaggaaagaatcagaagggggcccagacccagacagaggaggagatgaccagatatgtccaggagctccaaaagcatcaggtgagtggcagcctccgtgctggttcaggtgttgctgttgccatcaggccctataccattcaaacactgcccagtgccccaggagaccaaggaggctctctctgctcaatacagtacatcttgagtgataccccatcacctgtactatcaaactgtgatacagacagttccctgataaagtcctcacagggcccagtaggtctcaacacatataggttacagctcggtgagtggctgcataaggcaaaatcaggcaggtggtgatttgcaaatgaggtggaagtggtttgcaaatgagcgtggtttaaggaagtgtgtatcctgtcatgaccagtgtccagacccaaagactgtgagctcctgaaagcaggctctgtaacttgctcatcattgtacccttgcagtctcacagggcctggtatgtagtcagcactcagtgagcatgaaagcagtggatttgggccacagcagaaaggatttaagttcaacatcagtctggctagaaaatagcctggggttaacaaagagtctccttcccagagactcaagaagataataagaattttgttcaggttctatgtcattaagttaaaggcttccttggggaaagggttcttagcagaatagtgatgctctgacatattgtggaactgttgaactcctggcccatcctcctactggcttattatgtagtcttaatacaggatattgcaccttccattacctgtccgtagaccgaatgtagtagtattagccttctctctgacatagaagtttttaaggaatataatggtcacaagaactgctaaactattgatatgaaatatttgacatgagtaaacagaactattactattaatagtaattgcccatttattgatcattcttaatgtgcattttgtcatcattgtcactgatagtatagaaatctcatgtcggttgtttaagcagaagcaaaagcttctagtcttttgcttttcaaatttcaccagtcttgagtctccaaatgagttcaatcccatgaaagagaaaaaaacttcataggaattactttcgtctagaatatcagacagtacagttatcagacagtacagagtgaattatagtagctaatatgtttaagtttctgtgtttgatgtgagtcccctcagagcagatgctgaggcaaggatgcaagtacacatagtttatttgggaagcaatgccaggaaacaccagagggagatttgggaaatgagtccagaaagagaaggaagtaatgaagagtgtgtattcaggcatgttaccactgttaacaagtgactcttaatcctattggggatctctgggaatggaataacagtgcctgagtggggatgaagctgggctgtttctacaagaactcccattagccattggctgagggctgctactgggaaatgttaattccctggcatttgtggcctatcagtgtgtgtggacagagtgggctccagcagccagagaaaggcctcaggcagagatgcaggtgctggcagtaggtaggaagtcatgccagtgtacaccaagacattaaacacaaaggggcgatggatggaacaccagtgtctgctagatatcaggcaatgttgtcaggttttaaaaatttatttctttaattgagatatgattcatataccataaaattcacccctttaaagtgtatattcctaagattgtcaatcatctcactactatcttaattccagaacattttcattatcccagaaagaaatcccatacccattagaagtaaccctccattctcatcttcctccagccctttgcaaccactaatctactttctaactataaatttgcctgttctggacatattacagtggtatcatacaacagtatagccttttctgtctttgacttagcataatgttttcaaggttcattcttacagcatgaatcagtacttctttcctatttatggctgagtaatattccatgatacgaatataccacatgttgtgttatccattcatcatttaatggatatttaggttgtttcaatttgggggctctgataaataaagctgttaggaacattttcgcacaagtttttgtgtggacacatgttgtcagctctcttgggtatttacctagaagtggaattgctgggtcatacggtgactccatgtttaacctttggagaaatggccaaactggtttccaaagctactgcaccactgtacatcttcaccatagagttccaatttcttcacatactcaccaacggttttgttattgctattttttattttagctgtcctagcgggtgtcaagtggttttgatttgcatttcccgtgtgattaatgatgttgagcatcttcttatgtccttattggccattttgtgccaggcactgttgtaagagatggtactttattactgtggttttgcagttgaagacattgagacacagaagatttcataatatgcccaaggtcacccaaaaagtagcacagccatggttgaagctcaggcagtctgcctccagaacctgttgtacttaacacttctttggacttgttggattaagaacatcttgtagcatttccatttaacatcattttcttcatccttaaaatgggaaccataatgtctgatctgcttgtttcataggagtccaaatggagtcagcttaattcagtaaacagcccctgcatgaccatgtcatgaataggccatagttcttgttctcaaattgttcattgtccgtggaggagcccgacaagtaaacaactaaaattcagcataagcttgtaaatgccaatgctatatagtcttgaggaacagataaattccaacagttgtttaatatttccatgacgcctattttctcttgcatctcaaaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaaatagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatggttttattggtttcctttcccccaattaaggccaaataaagtcgtgagaacattacccatttacttcctaagagtg

SEQ ID NO: 13176 - DNA, 36577 bp, Human
  misc_feature (1)...(36577): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatctctgttttggtaccagtaccatgctgttttggttactgtagccttgtagtatagtttgaagtcaggtagcgtgatgcctccagctttgtccttttggcttaggattgacttggcagtgtgggctcttttttggttccatatgaactttaaagtagttttttccaattctgtgaagaaagtcattggtagcttcatggggatggcattgaatctataaattaccttgggcagtatggccattttcacgatattgattcttcctacccatgagcatggaatgttcttccatttgtttgtatcctctttaagttcattgagcagtggtttgtagttgtccttgaagaggtccttcacatcccttgtaagttggattcctaggtattttattctctttgaagcaattgtgaatgggagttcactcatgatttggctctctttttgtctgttattggtgtataagaatgcttgtgatttttgtacattgattttgtgtcctgagactttttgctgaagttgcttatcagtttaaggagattttgggctgagacaatggggttttctagatatacaatcatgtcatctgcaaacagagacaatttgacttcctcttttcctaattgaataccctttatttccttctcctgcctgattgccctggccagaacttccaacactatgttgaataggagtggtaagagagggcatccctgtcttgtgccagttttcaaagggaatgcttccaggttttgcccattcagtatgatattggctgtgggtttgtcatagatagctcttattattttgagatacgtcccatcaatacctaacttattgagagtttttagcatgaagagttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataataagctttttgatgtgctgctggattcggtttgccagtattttattgaggatttttgcatcaatgttcatcaaggatattggtctaaaattctcctttttggttgtgtctctgcccgaagcccaggtttttaaagtaaactatatgccaatgtgggctttgagaagacagctttctgggtcatggtacggaaatgagatacacttagtttctgctttgtcaagggatccagtatttaagaatattttgggctgctctccctccctcattttctacctttttaaggactggatggtctttccttgattatcagattcaatttttcaaggttggtaaaactgtctggatctaagtattactttctttcagttttacaacagttaatgattttgtcaaacaccccaggtggtgattactcatgtgtttattggtttgttgtgattttattgtgaaagcatgactatgtaaaacatcctagaatcttggtagaaaaattttactcaagaaaggaaacaaagacacttttaggaaatgcgaactgctagttttctcagggtttccagcattcccaaagaatagtgagcatttcatgtagctttttttgtgtttctcttctgaagtaaagtagacttgacgtaatatattgttttataaataaaaagttactttttaatcaaacacactatagatcataaaagtagccatttaagaaatatgtaaagctttttgggtgtaatcttttgtgcattctagaggaaaatcttgttctgctctgttaaatgcttaggtattagaaatctttttaaacactttgggtacttttctggcactgcaaggatagtggatatgattaccatgttcttatacctggctaattttctgtttttttttgaattcagtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggtgaggtttatccagtttgtgaatctttaaaataaagtgtgtattaccttttttcttaaattgattcatctaatttttaaaccatcatatatattattataaaagtgaatggatcagtgtaaatcacagcatacagtcagtcttactgtcctgtttggctgtcgcactactttgagaagcctttgcaaagcgtttctcctttacaagggagtttctcacttatggccctcctgcctctgcccaccccaccttgtttacaactgcagcctaatctgaagggttgatttctctaccactttgaggctgttctaattttatttttgacctctagacagttgcaatacagtgtatttaaatgctttgttagtggaagtagaaagtggtatcaggagtatataactagggcatataatctggatttggggaaggcctctggaagaagttaacatttgagacctaaaagatagtaagagttagctagatgaaataagaggggaattctttccaagataagacatttagtgtcctttagatacacattattgttggaagaaaattgtcaacaagatatataattggcctgatttgattgaatagttttaaggatttttcataacacaatttagaaagcatgcattatctgaaaatacaatatgtctagcataaacatgagaaactttaaagttctgagttatatagttattttatcttgttatctgtttacacaataaaaaagagactagttttgctaaatactcgatcaattttgtcttattttctacaggtaaaaatctatagaaggactcagtgctattaaattagattaagtccctttgttatggttgaattcaggagtataggctactttttagttcatagatctgcttttttaaaaacttcgtctgaaagtttaaactttgacccatgaaatatttggttgtgcaaaattacagatttctgtgtatgttttattttctaatttttatgttatatatggtacattttaaataattaaaaaaaatttttaagtgggaaataaccccaatataaattaagattattgacaaaaagagccagaagcaatctgtgacctttttttcttatttactgtgaggcaatgattttggatgaaaactgatttaaggaattcacaattgtattaaacatttaatttgtctgagccgagctttttaccttgaaagggctccacaaggagagatcttgattataagaaagtcttaaccatcctcggtatgagaattgcttgagtgttctatagaggaaggttgtagaatatatctggagctcttcaaaatagactagaaaagtctcatgattcttgccattcactctaacagatttcttacaggagctctgggttcttggttttgtaattctctacagatgttggttttaacagtggaggcttcatcactcttgaccacagtagaaggtgttatccagtcccttagagtaatctaaaataacatgcttctactacatttatttgtcatttgagtcatattaatttaattaaactttctaaaaggagatgattccactacttatatatcagtatttgggagactgatcatgatactcttgaatttcacctggattctgaatgaaactagttgactcaatagatggcctgtggaagagatggcctaacattccatccagtacagtcaaggtgacttgaatcaaggagttagggtagagggcatgaaagtattttatgaaataaagctaaaactgaaacaattgtgttgtggccagtctgaacaaagactatttttaatgtgagggctatggtcagcatgaagatgaaaagaaggggtgcctgagagcaagaataagccacttaatcttaatgtcactcaggggagggtgccctggtcagccaacactaatgcttaattggcagttatgtcctacagtaaagcctgaggtatcatgattaaaaatttataatcattagggaccctcattctgagaacatacttgcctttttattgtaacgtggcttttcatttagatgctcctttaaggagaaaatgtgctgattaggtgatattaggctctagtttgccagttctgatgttttgagttttgtttttgtttttttttttaaactattaatacccaacaacttcctttggtctgtacattccttttagaaatctttgtgtttttctctattattctttcttgttttgctcggtattcatctctctgtcctctcctctactcccaccccattatgaagaagatgggcaataaaaatttggtgtgtgtagtaaggaaggagggaactttttctgctgtaataattatgccttgtctaaattggtagattgtagttttctttctaagcccagtcctgtacaaatacccagtttcttggttgctagaggagattgataatatttctgatcaagtgatggaagtatttaatggccttctacctccatttcttttcaatagttcttagattgacttatggtttacataagcaattaggggatattcagaaattggatttgaagcctgctagattttactgttttccctgacaaaaggtgcttaactcaagtgtatgggcagctctctgccacaggacaaagggtagtaactcctagatgagctcctgaggaccacctgcaaattctggacccaggaaacagcccagcaaggattgtttaccattgttaattcacacataagccaccggtcttcctacttcagtttactactatttcctactccatctctacttttcctaaagattgtaaattttctccatactttccatttagatttgcttttgatgtttctgggttgaactctcttcaaatgtatagatacattatttgttaaaatggaatagcctagcctttgcacactagtcaatcagaagcttaatcattaaggtgaaaccaggttttaagtttctaaaatatgggaggattatgtaatcaaaacaaaaacatgacatgaaatctctcagtgaatcagcaaaataacatcttgtgtttcataaatgcatgttttagatttagcaagctttctgaccatttaaatagacttaagtatttctattttagcagtctcaaccatgggtgatttagttaatcaccctaagttaacacttctaagttaagttcaacagcatgcttctcctgaagggcagagggggatcttagctctttttagatgttaaggttagatgatttggaaatagctttatattttccatttttagtttaaaaattatgcaaccataatgccagagacaaatttgaagagaaaaaaatcacccacaaagccaccagccttttacgtattacctacaattacaatcatagcttagaatagtttatgatctcttggtttcttaatgtaccaaactctcctgtttctatctagtgttcaaaatacattttaataggtgtaattttttcccattttcctttcccctccttttgggcactttgggggtatctattttttgctggtatagataagatgctttgaatacctttgtatatatagcacattattcctgttcacattttttcttatgaattcttggcagtgggaatattgggcaaaaaaatacagttttagagcttctctaaaaacatatatggcattgtagttttactgtgagtgggtggagtagaattgttagatgtttgaattggaaataattcgggagccccttttactgcattcacctagggacctaggagtcacattttaaattttgagatgagataatttaatttttttttaaaaaagaatcttataaatgtatatttaataaaatcttagaaatagaaattcagagattatctagttcaactcaacaaataatgtgtatgtgggtgcacatggacatgcctatgttgtactcttggatttggaggatcgcataatgtaataacgaataaatctaggggtatatacattgctaggctgttttagatttactattaagggagaatatgacacttctcatggagatttaccttgttttgtttggctccatggaaagacttagcaacagattttagtattagcataaagaagtctttgataattaagtaagtgtctaataaataactcgtaaaaatagccaacaatggaatagatctcttctagtgatgagttctgagtttggaatagtcaagtaaacttggtatctacttgagatattcatatgtaagtttggagttaaatcatatgagtcccttcttggcttgtgactacagataaaactttttggtttggacagatccatttcctgatggccccattcattgagattccttttctgttcccttaccctaacatttaaaaatttttaagattctctatttgtgagacttgattaaagagtttgccttcatagggcaggctgctttttcctgtcttctctttctacttagaataggagatatctttaaaaatttttttaattaaaagaaattttttgtggctaaataggtgtatatgtttatggggtacatgagatgttttgatacaggcatgcaatgtgtaataatcacgtcatggagaatggggtatccatcccctcatgcatttatcctttgtgttacaaacaatccaattatactattttagttatttttaaatgtataattattgactatagttaccctgttgtgctatcaaatagtaggtcttattcattctttctaactattttttttaccagttagccatcccccatccctactaccatttctaccctctgctaaccatcctttcattctctgtgtccccgaattcaatcattttgagttttagatcccacagattagtgagaaggtacaatgtttatccttctgtgcctggcttatttcacttaacataatgatttccagttccgtctatgttgcaaatgactgaatctcattcttttttatggctgaatagtactccattgtgtatgtgcaccacagtttctttatctagtcatctgttgatgaacacttaggttgcttccaaatcttagctattgtgaacagtgctgccacaaacatgggaatgcagatacatctgatatactgatttcctttcttttgggtatatactcagcagtgagattgctggatcatatggtagctttatttttagttttttgaggaacctccaaactgttctccatggtgattgtactaatttacattcccaccaacagtgtacgacagttccctttcctccacgttcttgccagcatttgttattgccaggacaggaggtatcttataagcagtgttttcaattcctgaagtgctaaaaacacaaacacaaaaagaaatctttccaagattgttttgctcagttgctgagtcctcagtctttggaatcttatccagcatgggttagacaattatgccacagaactcaaaggtatggattggggagtggggggagtaagggggggggaaaatttattaggaacagttaaaatatatataaaaatgagttatggaaagataggaacaagtatcgtccctcttctacccttccaccgcaaaacctttaggtctgattttttaaaactttgctgcttttgattttgaggatttgagaacttttttaaaaaaacattttggctgggcacagtggctcatgcctgtaatcccagcaccttgagaggccaaggtgggtggatcgtttgaggtcagtagttcaagaccagcctggccaacatagcaaaaccccatctctactaaaaatacaaaaattagctgggcgtggtggagtgcgcctgtaatctcagctactcgggaggctgaggcaggagaatcctttgaacccaggagccagaggttgcagtgagccgagatcgcaccactgcactccagtctgggcgacagagtgaaacttcatctcagaaaacaaacaaacaaacaaaaaaaaacaatcttttatcttttttgtattttgatgccagtgacataaaagctaatttatttgcttatttgtgaagagttgctttttagttttgatgctttggattttgatacaatattctattctttattgtctttcagatagttgagatgagtttggttctgcatgctgagatgaatttgatttgggcctaatttagagaatttattgaaagctttaatattcatccatgtaccatacttcagtttgttgttttctgcccttcttcccccacattgtaccttttgtcccctttatcataagttccagaattgaggaatgatgcatgattagaccaaatccagataaattcctgtttaaggaagtagaacccaatttcattgattaaattgaattttggagggtgaggttgtattgtgtaaatcattgatacatttgattctgaatttcaaaaacattaaatctgctttttttttcttttgcatgcagatgaatgagtattttgcagtgttaagtgttctgtggtgaatttttataagatgatttttcaaatttctttttattataggtaaaataattaaatgtaatgtaaaactatgttcctgtcatgtgtgttactgtttgctaatagcaactcctttttctatacattttcccttgcccaattaaactgaagaaatttgctttatgaaaataaagtttaggaatgagactaaaaggtgactttttgagacttcaaaattacattttaatagatattcccccgaacattatgagttataaaaattgcaacaaaggacttgataatgctttcagaaaagcccaggaatgactgtatagcttctgcatattgattaagagggagttgaatgtttttggagaattcaatatggcattcgttttctttcttttaaaaatacataagtaatatatggctgggagcgatagctcaacacatgtaatcccagcactttgggaggccgaggtgggcggatcacttgaggttaggagttcaagaccagcctggccaacagggtgaaaccccatctctactaaatatacaaaaagccaggtgtggtggcgcacacctgtagttccagctactccggaggctgaggcacaaggattacttgaacctcggaggcagaggttgcagtgagccaagatcacgccactgccagcctgggcaacagagcgaaactctgtctcaaaaaaataaaataagtaatatatgaatgaaaacttggtaaagacacaaatagtagagaggtatgtaaactaaaatggcaaactagtttttcctctctgtggcttttccgctcactgcactcccaccaattttctctgtcataacagagaaactacgaagtttttgcttatccttccagtcctgttaccttgtatccctaacaccatcctccagaagccctttagaaatctaacaatgtaaagtgattctttttttattttttaaattttatttttttattatacttttaagttctggggtacatgtgcacaacgtacaggtttgttacataggtatacatgtgccatgttggtttgctgcacccaacaacccgtcatttacgttaggtatttctcctactgctaatccctcccccagcctcccacccccgacaggccctggtgtgtgatgttccctgccttgtgtccatgtgttctcgttgttaaactcccacctatgagtgagaacgtgaggtgtttgattttctgactttgtgatagttggctgagaatgatggtttccagcttcatccatgtccctgcaaaggacatgaacttatcttttttatggctgcatagtattccatggtgtatatgtgccacattttcttaatccagtctatcattgacagtcatttgggttggttccaagtctttgctattgtgaatagtgctgcagtaaacatacgtgtgcatgtgtctttatagtagcatgatttataatcctttgggtgtatatccagtaatgtgatggctgggtcaaatggtatttctagttctagatccttgaagaatcgccacagtcttccacaatggttgaactaatttacactcccaccaatagtataaaagcattcttatttctccacatcctctccatcatctgttgtttcctgactttttaatgattgccattctaactggtatgagatggtatctcattgtggttttgatttgcatttctctgatgaccagtgatgatgagcattttttcatatgtcatctatgctgcatatgcatatgttggctgcataaatgtcttcttttgagaagtgtctgttcatatcctttgcccactttttgatggggtcatttgtttttttcttgtaaatttgttgagttctttgtagattctggttattagccctttgtcaggtgggtagattgcaaagattttctcccattctgtaggttgcctgttcactctgatgataatttcttttgctatgcagaagctctttagtataattagattccatttgtctattttgtcttttgttgccattacttttggtgttttagtcatgaagtctttacttatgcctatgtcctgaatgatattgcctaggttttcttatagggtttttgtggtgttaggtcttacatttaagtctttaatctatcttgagttaatttttgtataaggtgtaaggaagggattcaatttcagctttctacatagggctagccagttttaccagcaccatttataaaatagggaatcttttcctcatttcttgtttttgtcaggtttgtcaaagatcagatggttatagaggtgtggtgttatttctgaggcctctgttctgttccattggtctgtatatctgctttggtagcagtaacgtgctgttttggttactgtagccttgtagtatagtttgaagtcaggtagtgtgatgcctccagctttgttgtttttgcttaggattgtcttggctatacaggctgttttttggttccatgtgaactttaaagtagtattttccaattctgtgaagaaagtcagtggtagcttgatggggataacattgaatctataaattaccttggacaggatggccattttcacgatattgattcttcctatccttgagcatggaatgttcttccatttgtgtcctcttttatttcgttgagcagtggtttgtagttcttgaagaggtccttcacatcccttataagttggattcctaggtattttattctctatgtggcaattgtgaatgggagttcactcatgatttgactctctgtttattattggtgtgtatgaatgcctgtgatttctgcacattgattttgtgtcctgagactttgctgaaattgcttatcaggtgaaggagattttgggctgaaacgatggagttttctaaatatacaatgatgtcatctacaaacagagacaatttgacttcctattttcctaattgaataccctttatttctttctcttgcctgattgccctggccagaacttccaacactatgttgaataggagtggtgagagagggcatccttgtcttgtgctggtttttaaagggaatgcttccagtttttgaccattcagtatgatattggctgtgggtttgtcatagctcttattattttgagatacagtccatcaatacctagtttattgagagtttttagcatgaagggctgttgaattttgtcaaaggccttttctgcatctattgagataatcgtgtgctttttgtcattggttctgtttatgtgatggattacatttattgatttgcatatgttgaaccagccttgcatcccagcgatgaagccgacttgatcttggtggataagctttttgatgtgctgctggattcggtttgccagtattgtagtgaggattttcacgtcgatgttcatcaggaatattggcctaaaattctctttttttgttgtgtctctaccaggctttggtatcaggatgatgctagcctcataaaatgagttaaggaggatttcctcctttttctattgattggaatagtttcagaaggaatggtacnnnnnnnnnnnnnnnnnnnntaccagctcctccttgtacctttggtagaattcagctgtgtctggtcctggcactttttttggttggtaggctattaattattgcctcaatttccaagcctgttattggtctattcagagattcaacttcttcctggtttagtcttgggagggtatatgtgtccaggaatttatccatttcttctagattttttagcttatttttgtagcgttgtttatagtattctctgatggtagtttgtatttctgtgggatcggtggtgatatcccctttatcgttttttattgcatctatttgattcttctctcttttcttttttattagtctggctagcagtctatctattttgttgatcttttcaaagaaccagctcctggattcattgattttttggaagggttttttgtgtctttatctccttcagttctgctctgatcttagttatttcttgccttctgctagcttttgaatgtgtttgctcttgcttctctagttcttttaattgtgatgttagggcatcaattttagatctttcctgctttctcttgtgggcatttagtgctataaatttccctctacacattgctttaaatgtatcccagagattctgatatgttgtgtctttgttctcattggtttcaaagaacatctttatttctgccttcatttcattatttacccagtagtcattcaggagcaggttgttcagtttccatgtagttgtgcgttttgagtgagtttcttaatcctgagttctaatttgattacactgtggtctgagagacatttttttttttttttttttttgagacgtagtctcgctcttctgcccaggctggagtgcagtggcgtgatctcggctcactgcaaactctgcctcccgggttcatgccattctcctgcctcagcctcccaagaagctgggactacaggtgcccactaccacgcccggctaattttttgtatttttagtagagacgggatttcaccgtgttagccaggatggtctcgatctcctgacctcgtgatccacctgccttgacctcccaaagtgctgggattacaggcatgagctaccgcgcctggccaatctctattcttttacatttgttgcagagtattttactaccaattatgtggtcaattttagaataattgtgatgtggtgctgagaagaatgtatattctgttgatttgggatgtagagatctgtagatgtctgttaggtccgcttggtctagagctgagttcaagtcctggatatccttgttaaccttctgtctcgttgatctgtctaatattgacaatggggtgttaaagtctccagttattattgtgtgggagtctaagtctctttgtaggtctctaaggacttgctttatgaatctgggtgctcctgtactgggtgcatatatatttaggatagttagctcttcttgttaaattgatctctttaccattatgtagtggccttctttgtctcttttgatgcaaagtgattcttaaatactttattaaaacagcttatggttagtaatgcttggtcaacttttcataatattgtatagttttatttagaacacttattatgttgggtccttttgcataatcagtatgttcagtgttcatgtcatttctagaagttttttggcttttcttttcagcagtggctgcaagacagtaaaatgaaaggatgttaagattcaagagccctggcttttagtcttagtcatgttagtaactgttaccttgggcaaatcctgtaaccattcttggccttcttttagcatgtgtaaaatgatacgttcatcctattctataccatatatggcttctctcaactctagttttatacttactctttgatttggaacatatttgacattctaaaagtatggagaagcttgggggttttatcactggttttagaggattatgttagtcactttgggttaatttagaagccttggttaggaattgggacccctcagttatagtattcatatagaaaatatgctctgtttacatcttcagaaacgcacaggcataatggagaataatattaataattttaagcagtcttatttttccaagctccccaattcactaccttccgcatatatatattctattggctatcgtcttttaggtatttgagatgagtttgattctgcatgctgagatgaatttgatttgggcctaatttagataatttgttgcaagctttaatattcatccatgtattatccttcagtttgttgttttttgcccttcttcccccatattgtaccttttttcccctttataatgagttccagaatggaggaatgatgcatgatttgaccaaatccagataagttcacatttaaggaaggacaaactaaattgaattttggggggtggttttatgtatttcataaaatattcagtgggaggggaaaacggtgtctaaatatgcttcctaacctatatggtggttggatgtttacagtgcagtaaaattaatcatatatattagtgttatgtcttgaaattttatagtttcctccttatctcactgaaatcctaggagttctgcttctagctacttagttttaacatggaactgtgaaatgtcttttgtttttttctttttcctggaagctttttgagtgaaggggagtaaaaaacttggattcaaagttttttcataagattgtccaggaaagttatgcatgccattatctcttgcttagattttgcaaagctctcttaggtagtttccttgctttcactcttggttcccgtgtagactatttgtcatagcaactagtgatccttctagcatatcagagcatgccactcttctgttaaaaatcctccagaggcttcttctttccctcagaaaagtcaaagtcctcaacagaatttataaagtcttctatttgcttcctccccaatttccccttttggagactatttctatcattattcccatgttcacagcagccaccttatttgtgctttgtgtgcaccaggcatgcctttactttatttgcctttttgcatgctattttcccttgtccaaacatttgcatgacttgctcccatctttaagtctctgcttttacattgttatatgagagaggcctaccctgagtttcctatataatagagcaacacccctttcccttcaccttcttccttccctgctttttttcccctgtaatacttatatactatggatgtgatttttttgtgtcttgactacccccaactagaatgtgagggccatgaaagtagctcagaagatgattggctggacttgggaaggctgaatgtcagaagccctggggatatcaaacccactgttctggggtgagagctctgcagcagcagacatttgatcttccctgtttccttggccagccttgaggacatgggctgcaataggagtcccacttgagcacttaagcaccctgtgccatatcaaagcatttgagcttattttgattttttaaaagtttgtgggaaaaatgactgaataatatttcagttgcaactgatacctttgacaaatatttgtcagtgaattgtgggcattagctgatggcttattcattttatatactggactgaagagagaaaaatataatgctaagtaatgactaattgaggatttgactaataatgtcttctgccctagtgtcacgtatctgtgtcctttttgtcagttatacatttccagagcacgtacttgtcaaactcaagagaataaacaagtttttggtggggttttcttttttttgctttggttttatttgtatttatttatttattctcttgactgaatacccatataattacagtgagtaacatgtttgttaaaatgaaatatgttggaagcagttaagttgaaggccttggctggtatcatatataccacttaaattttcttctgtgtttagcaaagaaaaaatgtcaagtttcaaatttcgctgagcattactgtttttttttttaattgttgttaccaatcccttccccccaccctccccatccccaattcatttttgcttttactttttttattttggagaaagttaaaattaaaatggtgtagaactctttccctttcccctccctcttctgccactgtccccctcatccccacaattaggtctccatttcttttctcattgtggagtgataacttaccttctgtagaagaatcctgagttataaaattgggacattcctatactactgaatatatgaccctaaaatatagctttgaaatatctatttataaaagatatttttttcttcccactttcaatgcctgttcgttatctgcaatgggatttatttttatttgtttggcaaacctgataggttaagacttagccaagtaaatgccaggtatgtgacaggcacttatgtttgttaaattatttgttataaatcttttctccttctattcaatatttttgaaaagtggagctaatgtatatacatgggaaaagtttgctaaattgtagctggcagggctgataggaagttggaaggaatgtataattcaggatagtatagtgaatttagtcttttgagacagaaagatttgtatttgaatccaagtttagtgatttttgttttcaagctatgacttggtaaacttaacgcctcttaagcgttcatttccttgtatgtcagatttggatagaattattgcatagatttgcttctgatgaatatataggaatatttgtaaagtagctttcttagttctttttgtggtttctgagtatagcttatcaaacaaatgtgttatagaactccttttttcctcctaaccccatcatttgtcaagctttgcctaaagaatctttgtagccttcattttctctctgttgccacattcttagatctagcttgcatgttctcccttgcatgccttggattcaccatttctgggttttgccttcttgatcttatatgtgaaaagggaaaaattgtgcagagctctgagtttcaatttcagtatcttctctcattcttgagtagtatagtctatgtacactacttagtgtagaatggtctagttacaagaaaagttgggatgtttatcatattgcttaatagcagctctctaccaggtgtaggcatcagaattccttgtgtaactttaaaaattctaattcctgggccccattctggacctctgggatcagcatttgtggcatggagcctgagtataaattccactggggatttttatgcagacactcagttaagaactgccttattgagaggccatctcaagccactcaggcagatcaatatatgtaaatattagttttcatgacctcagtgtctttcctaacacccttctgtggctttcctattactaaagaataaagtcaaaatgaagcttatcattcaagaccaatttatggtcaccccagtttatcttgttaagtctgttttttatcattctttttgataactgttttcctatcagactgaaattgcagtctaacatcatttttcaaccaccctacttctcttatgatgatctagaatgtcctgttcccttaccccttcatcttctccttcatcttttatcttctaaactgtctctcaaaaaggtttaccttctcaataagcttttcctagtgtcctcagctagaagtcacattccttctttgaactccaaaacatttatgtactttattttttgcactgatccctgattgttttatctccagacatctttcttccctactaaagcttcttgctgactggttctgtctgtgtatgccaccaccactctctcagtagcgtgggtgcctgcttgctacatagtatgtgctgggtttccgtgtcctcctgccccttgccacttgccccttctgatttcaggaaaactgatttgcatttttacaatgcgtagtgaaatgtataaaaaatgctgctggtatattaaactggtcttaagtcattttctgtaaaatgtcaaatttcttacttttcttgcattttttagggtcccagaagaaaaataagaaattctacatttggctttgacaggcttctcatttataactaatgtttttgtgataaacacagggctcagagatgtcaggctagcttttccttttgtaatatttgctagatgtggtatttattgggagactattctccatgggtctctcacatgttatgcatgtcttggcaagcagagatacagactgactgctttttttcctggactatcattttcaaggatgtttatataacgagcagccttgcaagacagagatagtatttctcttcagagcaaagagcaggtttgcttatggtccagtataaaaagtgtctccttccagagcatgtttacatagagtttatagtaagtaaggataatgccaccctccagtgcaaagaatgggcatgcttatgcccattataaaatatttgagttccttttaagctcaggctctctttcctgtaacacaacccattgcatgtgtaattgttacctggcccttctatcgcaccccatggaaattggggcatggggaactggcttaaatactgacactggctactgctatttccttgagtagtgaagttctttgtctctgacctggggtcttgtgtcttctgccagtatccatgaaactggcagaataacttgttagcttacaagtagggtaaaatctcagacccttcacagttcttagtaataatgttaaagctgctgttttcatacctgcaaaatcagcccttctgtaagtaactcctgttaagtttggatgagattagaatttaggtgccttatgactatatactttatttttccccctattctttttcatgaaaataaattactcgagttaaaggactgtcattctgagattgtccttctgtgaaataatgatattagtgttgttctctttctctcttttccccaaataaaagcactgctgttttatgaggatgagctacactgacaagcatgttgatttgtttacttaaagctgaagtttggagtacatattgtcttaaaatgagaaatggggtatttgggaggacatttttttaaaattcgggtataacatgactttttaatgataaattagataaataataaaacatgttggataatgataatgctaagggaaaagaaaatgaaagaggatacgattgtttgggtggacaagacagttgaaattttagataatgttggctacagaaggccttactggtggcttctgagtaaagaactgaagtaagtttggagatgagccatgtgattttctggagggaaggcatctgggtagagggcacagcagtgcaaaggctctgcagcagagtgtgcctgatgggagacattgaggaggccggtttgtgatgctttgaaaacagataatgagagggttggagtattaacctttgtcttagctgtgtttctatactttaccccagagcatttgcttttatgtttatatattaatcacctttccatttgagaaatgagattcctttctttaaaaacattttgaaaactacagaactagataacttgtcttccaaactattcttagttctcattgacagtctctgtaggtgcttatttttcaacagtcaatttaagtcccagtctcacattggtgtgttttttaattcagcaggtattcgagagctatattcaaccctactttatgtggtttatttttaagcccccacatgattatattccttgcttctgttgaagagaagaggctgagacagcttggaacagttggagaataatataagataacattctacctaaaacctttctagccaaggttgcttcttaccctttgttaccaaatataaaagctagttttcaactcttgttggcctcttaatattaggaccatacatttccttgaaacaccatcctgtcactctggttgcaccatttctctttctcaaggattcctcattccttgagtttatgccttaactgcttcttctcactctccttaatctcttcggatgcttctatctactatatggcttcagttaccacctataggttgttgattctcatatctaaatttgtagtctaaacccctctcttgagctgaattgttagcatttgtaattagttggctttttacatattcatttttatatttaaagcaatttgatatcttttacctaaaaaaaaaaaaaaagctagttcttcctctctttactttggtataatagtattcttgtccagttgattaagttataatctttatgttcgtgaccattagtcaaaagctatcaggtacgcacctgtagtaaacaaagttaggtttattgatgctttctgcagcaagggaagccacataccatggggaaaccatgaaatgtcggtaagatgatgttggacagacttagagaatgtgggcttttgttgggtaattttggggaggattcagggaagtgatgaaggtttcctttggattggatgctgtgaagaagtggggataattctatgattgggtatcttcataaatcttatctaggaggtgacaagaacagagtgacgctaaaactaaatggtaaagaagcagcagtcacttgtgcaagatgggattttttgtggtttgcatggagtccttgcttttgtctgttctcagacgcaattccacagtggcttgggtttgcctcacttccatcatagtctgatgttagtgatctgtgagatcttgtttgacagaaaaatgccacagtctagctgtgagtgctgagccacctcctagctgtgaagggctgcatttctctctctttctcacttatttgggatagatgtagattaggtggcatttagacaataagaagatgtattttagggtatttgaacaaataatttacatgctattggctatgtgtgaggggcagtaaagaaaattattatactggtaatgtatcagtaggatctagtgttatgttgaagtagagatcacttggttgtttgttctttatgtatcaatcatacatggggccttttatagctaaatgtttgagtacttaactatttgccagacactaagtacttacatgttcccttttaatctttcaagtaagttgagtcagaaaggaaggatgcatattcctgtctttgggaataagaaccaaactggaaatccaggtgtggctagtggtgtagactgttaagtaatgtttaagagtgtgagttttagcataatagattgaattgattagatacaaatggttaataaattttaaaaaatagcctgtgacaatgttcaggatgactagaaactcttggttttaggtatttatttggctttccccataacgtaggcccaaatgtgtaatgtgaaaacaaaaaagactaaagctgccaggaaagggtacaagttgtggtggtaagctgtaaagaatttggctttaagttaaaataaatacatattagaaatattgtgattaaaaactatgctgaagttagggatgaaattactttgaatacatcaaaaatgatagatggatagatatgtgatgaatagcaaaatgctaattgtagaatctaaatggtggtcacatggctgttcactgtgaaattctttcaacctttgtgtatatttgaaagttttaataataagatattgggggagggtggaggtataaactatctgctaaagtcttctctctgacctgagatacttgttttctctgtaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagaggtgagtgtaggccctgtgctcttactaagaacacatttcaacctgttcttgttttaactacctgtaccttggagaacaagagtgggtaatttactaggagactcaagactgtaatgttacgtaggttctcagttgtgccacatttgtctgattaacgtgtgcctgtgatgaaattcgtttgttctaaatgcagaacactgtggacttcaggcaaaaatctttaaatatttaggtttgacttcaagtactcattctgcttgggactgcagcaactcagccaattgttagctaatcctaaattagttgtgccgcttggggatatttgaattttcctagccagcttctgaaggctgaaggcctttaaggaattcagcattttcttttttgtttttgaagcattttaatcacctttatttcttagttgtaattgcaacttccttgaaagtaaagtatagctggtgttacctatgggttaatactcctaacagtggctccctatttttatcagtgttccctaatgtttgaatttcagaggtaaccttagttttgccatgccagaaaaggtggtttatattctttcttgaaaagcataaatgaaaattggggtcagggagtgctctcctactctacccttttttttctctccctcttcccagcatcaagtaagggatatctttatttaaccttcacttcacccactcccttccaaagagctcaacaatcaggctgtatttgtatagtttttaggagcattcttagtattttatttcctgtggtactgatgttacagaatagccagtcctgagtaaattgggctccttttagatggttcaaagcaatccaattctacagaaaattttgtatctgtaagagttatgaattttctaatccagtaccgtgtgtcagttaggatgcctttgcctgtgataacagaatatccagctctagttggaattagaatccagtctagcagtagattgaacaataagaaaatttgtcttgcatgactagaagtcttgaagtagtacagttcaaaactggttaatttcacagctcaattatatcttcagggatctagatttgttccatctttatactctgctgaactcagcctgttgattatcctcttgggaccatgaggggagctagtctaatatggccatgtatttctaggtatcacgtgcagatgacaatgtccaaatgcagaaaaagggaccgtcccttccttgtgtcctattttaaaactgaagaaaggtttcccagagggctccctaggatactctatttatcccctgatgtctcactggctgcaattgttttatatgcatatttctaaaccagcagctggcaaaggaaatgagatcacatgactggtacttagactagttaaggtttaccttctaggactggggaaggtcccagagttctttggagcaaattgccattggtattttaataaaaccaataagcaaagaaagaaaggagccacagttgataggaaactaataacatctgtatcacagatagccttaacttttggtactggttatttatttctttttgtgtaagaaaaggaattcctcttttgaaaaaggaatttttctttttgtatctttttcagtccttttaagttatattgtagctctaacatacaagcttatgagggaaattgattttacaaaaatacaaaattttctaagcttatggattatttcatgttgaagtatgcgtcagtgtagtatctgattgcttcctacacaatatactatctgaattattctgatgtttcctctcctacctgtagttatttgtcctgtttatcaagatgcttccccactacaatagcattcagtcaccaccaccactggcttcctgtctctaatgttctccacctaccacaatccagctccccttccaggatctttatttccatatcccccactcactgcaggccttggatgagtcttagtggtacagtgacaccagaggcccaacagcagctctctgtatcaagtcatcttcttcttatcaggaatgatggtgactccagggatgaagaagaaccaggaaatagaggaaataaactgatcaggaaaaaaggatacccaaaaatctggtcattaagaaaaaagggaggaaatggaggcagacaagaaagacagaatggggttcctagagctgccagccagaccaaagtaaaatcatttccacgtggtcaggaaaaaaaccattaggttagaagatgttacccaggttataatgtccccaccaaagcatttgacaaattccactgcttggatataacatcctggaggtggtattgatttggcctttctgtactataggagtatgaagttttgaaatggcccatcctgccccaaggatgtaatagtccatcctgcctcagtacaagagaagaggcatcaatagaatggtatgggaactcagagatgatagcttttctttttttaaataagtggcaatattattagtttgattactgatctgtaatcagttaaattctagcttgtccctagatcagaaactaggggctacctctgcagaactgtcagtaggcctaacccaagaattgatggacaattctatcctttcagcaagtcaacctattgatgagatataaaaatcttcctatctttctagagtggaattccttgctagtaaccttccctttttcatcatctcttaacacttaccttaaagatttttaaaaatttagttttgaaataatattcccctctcatctctgagtaagagttgtatcttttaaaagttctaaaatttattaaataatataaaaagattcaaacatgaattgtcatttttgtcatcttcaattaaaattgttccaaattttaaaatttgtttgacttatggtcaaatgtctgctgcctcaaactagaataaaacccatcttgaatttctatgacagaatactaaaaacaaaagactttttaaaagtactcttgtgttaacatttattttaattctgttcttttctctctagctttcttgtttttctcaaagtactcctcataccttcataagacagtctttgtagtcaatgctaaagatagagaatagagaaaaactctgtgttcaggattatatataaagagaagcagtaacctcagagtgagtgagtcatttaagtctgaatcaaggaaagataaggatgtggttggccagatcagagaaatatgcctattctgtctctcccaggtgggtttagctaactcagggagaaacattttggggtggcagatatatagagcaggctcagcacatcaagatggggatgttggctgaggatagaagaggcattgaaaggagtcagagagacaaatgggtgtgagaggagaggccagaatgtagaataagcacagaaacataaaaaaccagatcagaccaagagaaaagagaaagtaaagtgaatgctgaagaagagaaaagtttgaaaagccaacctatacaaagtaagcagcatcatattacagtgaaggcagccacatagcctttaaaagaccacacagaacagatagaagatagagaatgactagggacagttaatggttaaattgagatgaacaagaaatgatacacaaagtaacatcaatgaatgcagaaagaaatagcagagagaaaccagttatgtgcaattgtagcataagacttcagaatatagcaaaaaaaaaaaaaaaatagatggattggatatatttacagagagatgcctcataggtctagacttagagtggagagcaaataactggtagaaagtaggagcagtgaggaggcaaaagaagtgattgagacatggaacaggtagaacaggcaccgggaagaaaaaggctgtgggagaaagtggtttacaaagtagccctgggcacagaggtggaataatgaaaagtatgcaaacgcagtacctggaaggcatggattaaatgactggatcagtgtggactgggcaactggagataacattatttttttgttgcacaagtagcatggccctatagatatccagaggcaggacaggataggtgggatgagctaagcccaagtttacctccagaggatggtcagaaacacagtgtaatttagggaaagatgtgatgggctaatcagatacacggacacagacctcagctaagtatgagttagaaaaccccagtagataagaagtggacccagaacaagtgaagagtaagggagtaagcagagatgaagtaagacaaaagtgaaggcaaaatagtgaatggcttaggaggaaagactaatgaagtatttattagattcagaatgagtcggggctccacacaggagataattcaggatccatggaaaagagtgagaaaaacggacgaaaaataaaggagaaacgtgagaccaggtcagtcatggacactgaaagaaacacccaaaaggtttggagtgagcaggcagttcaagaaacatgaagatggttacaggataaaaaatagctggacagagcgggaggtggagaagcatacgtagaagttgaagtggaaagcatcagtagcaggcagagaaaggcatgagctcagacagagaatcaggcatattcgaaagaatttggaacagattgagagtgaaacaggcagataaaatggggaaccatcagaaatactgaaaacttggcctaacacagaggttggggggaacttaagtgactagaagataaggaaatgatcagacatggaacaggctaacagacaaagaagatcgtgggtggtaaaagtaaaaagcaaaataaaatagactgagaaaaacagaccattgttactgcagagtagaatcagtggttggagatggatacagagtatcagcatagatgtggagatagaaacatacaactacatagaaaagcagctagtttgtgcagagggttataccttactgcatgagtggtgggagaagaacgttggttgaggtcaggctttgtagaatagttttctagctttttccatgatcagcacacaaaagaaaggaaaaagcacacagaaccactttgaattgttctgggttgagctgagataacatttttaaaaatacaatgtgttttgtttttgttttttaaacaaaatactgggagagatttttgtcagactagtggctttaagtagatgatgtcaccatatcactttctccttctccaagtattaatagatttattgaaacatcttaaatctataaaacctcagtcatttatatacatcagaggatcccatgtttgaggaacttaaatataaatatgatgtgtttttctaacgcatacaacttttaccctgaggtatagaagcactttcttggaattgttaaagcatgtgtgcatgattgctaggtagcatttacatgtagtatttcagtaattgcctccctagctgcccttcttttccaacaccaagacattaatttttcttcttcctgtactcctctattctttttatatagcaaggaccatgcagcaactactgctggagctgctagcctagcaggtgggcaccaccgggaagcatgggccaccaaaggtccttcctatgaagacttatacactcagaatgttgtcattaacatggatgaccaagaagatcttcatcgagcctcactggaagggaaatctgccaaagagaggcctatttggttgagagaaagcactgtccaaggggcatatggttctgaagatatgaaagaaggtaagagtagaagtcagtaaaatggatgtgtcttaggttctgtagaacatgaacttggcttagtgggaaactgcctgggcaattctggatctgttctacagaacaattaattgcattatattaggaagtaagaaattgaacaataagataaaaaccaactagtatacttccattgcccttcaacttagtgaaaataacaaatagccttttaaattttcatttttagatttgaaaaattgtcatctttttatcttaatttcttggaaaaatgctatctgttgttttcaaggtagccatactcacctttcctttaatcttatattaccctgacttatatgcatttaatttttctgaattgggagccaaaactatacgctaccccaaactttatgttttctcttcataaataccaaggagtgtatgctacctgaaatagatacaaagagaccacatgaataaaggattgagcattctcacagtccaagacggttagcagaactttgttctagaggattttggaaatttctgaggcataaagggttaagaattgcatactaatcttcggaagttagagaactgcaagattttactttctaagttttagtctaagttactgcattcaagactttgagtgatgatggtttaggagtatgtagaaaatgggaggcaaaaatggatgacgatgactcaagctggaaagtagagaggaagggtgtctctatttcttgctgaattttatcagtgtaacaatcaatgtgccgctactcccaagttaatatatcattactaacatatcacgtgagtttggtgatatgttagtgccaaagaataatcagtagctgaaaaccacttgttttttggcgtttctcctagcctcttttcccttcataattagcatttagtatatgtatatactagaaattgtgaaggtaacgtggagtttggtagtgatggtaaagcagctaatacctctactgtgattctctttgatatattaattttaataagaaaaggttttccaaggcaaccatactttaccctccttcttcctcactgattagcctgccatgttagtttttttgacggagtctcgctctgttgcctaggttggagtacagtggtgcgatcttggctcactgaaacctctgctttccgtgttcaagtgattctcttgcctcagcctcctgagtagctggaattgggcgcaagccaccatggccagctaatttttgtatttttagtagagacggggttttgccatgttgtccaggctggtctcaaactcctgacctcaagtgatctgcctgcctcggcctcccaaagtgctgggattacaggcatgagccactgtgcccagcctgttgtgttatttagattgaagttgttttagattatacagtagttaggctatactactacttaataaatttgttttccccaacttggcttcttgcctgttcttaaagcagccttcttttctttgaacttaggaagaaaactgaataaaataaaattattattaaccaacattatatattaagctcataagtttaacattctagtttacagttcctaaaatgatagaatatgaatcatatgggccttaaataagttatctggtctacttaagttttgtaaatatttatttctgcataaaataggatagtatgttgtcatgtctgaatttatcctaagtttcttgatagtagagcagactctatccagtgaatgtatgaagtgggtcttaacacttgattttcctcaaacttcaagtcatgttgatatctttcacaattgtatcgacttcaatcatgttctcattactatactgaagaaagttctaattccttttgattctgttttccttaaacagttctcttttccactgctgccacctcctacagtttttgtttatttttgtctttttctggaccatctctaattgtaatatactttacttgagacatagtgaccagaatgatacatgttgttcatgcatggattcaccattgatttgagttttatttccagtatctttctggtttttacttgagattttgtttgttgctttggttctggaagcatgttaagaccaaaaacttctagaaacacgtagaggtactttttaggttcttctgtgccttgaatccaatagcttggatcatatctttcagtatattttagattatttttctgcaggctgattttcttgcacttgctgaaatagaaatagatctgctacttttctgcccacgtatacaaccttcagctcttcctatatttttttgctgcaacttggcctttcagtacccacaattgcttagcatcaattccgtgaatatagtttcccagtatacatcttctttgtaatttataactctgttgaaaaaggctgttcctagaaccactgtttctactttaccatccagaaatttgctcatttatccttgttttttgttttctgtcttcatctgtaacagaataattcttttttctccaaacctctcaagacccttgtcagaaatctgttacgtgtgacttaatttagtttacaaaactaattttctttttccctaatttaatacttaaacattaatcaaaatactgtgttgatattattaaactatttggaacattcttttagaagcaattattgtcttaaaggcttgcatgcattccttaccttcttttctttctgttgtagtgctgcattggcagtaagctctaaggaggaggttcagcctttgacaatattttgaagtagttaagtttgattttaactctcattttgacagtcatgttatcaaaagcctcttttctctgacctaaacttttaacttgtctgcttctgtttccctttctctctcttatctgctcagtatctcattttaggagttctgtgccttctaaaatgtccagggatttagctaattcattttaatgtgttaatgagaagatgctttcactttatccatagtcagaattgaccatttctgagtcttctcttgatgacgatgatgatagataacactattctaagtgccaggcccattctagacacttcacagacattcacttaatccccacagtaatctagtgaagtaaatactattttccccctttctgtacttgagaaaattgaagcggagagatgaaataacttggccagaatcatacagctaaatagtgttaggatttgaatcagggagtcaggttccaaacaatacttttaatctttttatgtattttaaatggcagtatgtttggtagtagtatcagaatgcagaatgcagatggttttcttaaatatttcatctgcagtatatcaggtaagatatgtacacaaaatgataggaggtgtgtggtgagagaagcttcattcctaaaattagattctttttttataaagagttttaagtatgcttagtttgcttcatgaaaataaaactcacatttattcactcatttgtcagatgtttattcagtgcctaacagagtggcaggtactatttaggtaaatgggatatatccatgaataaacaagataaatatctgttgtggtagaacctacatccttggaaagggggtgacaaagacaatagatgtaagttattcattatgttaggaaataagtgctatgggggaaaaatagagcattgggaatgtagggataggatacatttaaaaggtaacatttgaataaagacatgaaagatggaagggagttagctgtgtgagtacctaaaggaaaaatattccaggcagagggaacaggtaatgcaaaggccctgaggtaggagtgtgtctgatatgtacaaggaataccatggaggctactgtggctagacaagaatgagcaggggaaagaagtaagaggtagatgatcaggaaggattccagatgatgtgggaccctataggccattgcaaagcttttggcttttaccttgagtgagataaagagccatgttttgattttctgttatgccagctactctagtcgattcttcatagacattatcttatatgtttttattcagaaccttagaaagtagatgcttttatcacctcattttacagaaaaaggtattgaagtttagagattaaataacttgcccaagatgcttgtgtgtagaagaaccaggattcaaatctatgctataatactcttaaagccaatgtacttgaccattatgctacttaagctccagtttgtaagaaatattttgaatattttatggatagcagctcaaaaatggaaccagtgaagtctgttattttatcgtattatttaaatatatgttaaaatattgtctatatgctataaagaaatgccatttatatttaaggatattgactttctgagttttactccccagggggcatagatatggacgcatttcaggagcgtgaggaaggccatgctgggcctgatgacaacgaagaggtcatgcgagcactgctcattcacgagaaaaagacttcctctgccatggctggttcagtgggggcagctgctccagtgaccgctgccaatggcagtgactcagaaagcgagaccagtgagtcagatgatgattctccaccccgtccggcagctgtggctgtgcataaacgagaagaggatgaagaggaagatgacgagtttgaagaagtagcagatgaccccattgtcatggtggctggccgtccgttctcctacagtgaagtgagccaacggccagagctagtggcccagatgacaccagaagaaaaggaagcatatatagcaatgggacaacgcatgtttgaggacctctttgagtgagctttccctaattctttctcctttctctaatgctcagttcaaaaaggaatgtctcatctttgaagaaaagtatttaagtggctttctgcccctcttgatgtaagcaactgtccatccttgtgcaaagattgatggtagagagtttgacttttatgccagaaactttcccagcaaggtagggtgctgagaatcctacccttccttgctgtcactacagtattaatattttactgtattttcttttctttttttttttttttggagatgaagtctcactcttgtaccccaggctggagtgcaatggcgtgatctcggctcactgcaacctctgcctcctgggttcaagcgattctcctgcctcagcctcccgagtagctgggattacaggtgcctgccaccatgcctggctaatttttgtatttttagtagaggcagggtttcaccatgttagccaggatgatctcgatctcctgacctcatgatccacccgcctcggcctcccaaagtgctgtattttcttatctgatttttttcttgccttattaagacataattttctcccttctgaaatgagtgagggaagttcataaggtaaatccttcccatccatctgtttactacaataggttacaataattcactgatcacatccattttatctgttctagccaggcattccaaacaatttcttatactgctgcccaccaaagcagcttgccaacagtcaaatcactgattgggggaaaaaatcctgaaattttgcttagaatttgagcatttcctcaaaattgagatggatcaatatgtaaggggaggtgggagcgtgtgtggaagggggagagatatacttgagtcttatgattaatgtctaaaccagaatttgtgtctttagaactgaccagactggtagattttattgtattgcttaatgtcttttggtttggatttaggatgatagaaaacagaagtataattggtaaacccttaggaagaaattagaaaaacatggacgtaagacaagaagtctctgtgaagggttgaagagtgacaagcattggtaacagtgccttagaactgtgtcagttagtctgatttggaaatcctttatgtaaagctgagactggtcctggttttgttccctttgggtacagacctcttgtcagtgctataaattgtttaatgaggccattccagcagaaatcaacagaataattgattactcttctctctctctgtcactctccctctttctaaacatcattgaaggctgtctctcttttaatttttgtcagacacagtattttagggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactgactgaagtttgttcattttaagttctgtaacatcttggggcatattaaaatgaatattcttcccattaaaaaaatgttaaagacttttttattagtcatatttcaaatgatagatgcatatgggatctaaactttttgtgcaataagatgcctttgtaccttgtatacgtaaagtattcaacttttacacttgatcttagccaaaagaccaagaagcaatgctcttcagcttttaaacattgttttttaaacttttatagttctagaagttaatttaaataaaatggtaatcagatgttaatttttaaaatgtagttaattttttaaactattttttgtaagtgtgttcatgtatatgtagaattcgtgttatgggaaaatgtcacaagtgaatatggaggtaagaataaaggtattcattgcagcagtatttgaaatagaatagaaagatagatatactcactaaatctgtatttagtcctaagtactcaggaggccaaggcaggaagattgtttgagccaggagttcaaggctagcctgggtaatgtaatgagatcccatccctccccaaaaaagaatgtattgagaggaaaagatatccataatgtgttaaatataggattcagtttttctaggggtgtgtgtgtgtgaagaagaaagtagctaacatatagtgaactgtgtgccagacactattttaagtgctttatatatgttaactcattcaatcttttataatctgtgaggtaggtatacatatataaatgtatatatataaattagggatgagaattacagtgatcttaatatattattatgaaaaagatattttcattttgaaaaagaatcaaacacatttaatgaaagaaatagtagagtgtcaaaagcaaggtctttttaggttgatgctaggatttttgggtgagtagaccctcagttaagtaaaatgaaaaaatccagagtttatcattttctcggataaacgtctctaaatttatactcaaaatcaatgggaagatataatttaataggtaactacctccctttcagtgacatctaataagactcaatagaatttatattactttatcagataggtttgtctcttgagtggcacaataatctggtgaggagagacagtcagtgacagaaggaccaaaaatgggagccctgccgattagcctctgaagctctagtaagggcaggctcacacccaaggttggtagatacatgtagtcactgtgtttcttgaccccaggaaaactagagtcaccaccacacacagcccataagtgatgatggaggaacttggtttccctgaatgcggttgactatattcgtgtatctcaagtgtcagctgaacaagtgtcccaactttcccactgtcctttaagatttaaatagaactttttatcctaacatgttggactacttcttctagtatcatttcttttgggagatgacagttcttttttgcaggtggtaggggaccggggagagtaggcagggagcttgtatcctctggcttcgcctttctgcttccctggttttccatctgtcctctacaccacctgtcctttactccccctagtaccatcaacacaagtttgtgtagcagatcttccctgaagtttttacagtagtgagcaaagggagcggggcaatgagggggatttttgtttctatgttcctcttatttttagttgacacaataattgtacatatttgtgggatgcagagtgattctttatctcttccaacttttaggctcaggggtatatgacgtgcaggttttctgtataggtaaattgcgtgtcatggagtttagtgtacagattattttgccacccaggtaataagcattgtatcagataggtagtttttcagtcctcaccctcctcccaccttccaccctcaagaaggccctctttgtgtccatgtgtactcagtgtttagttaccacttataagtgagaacatggggtgtttggtcttctatt

SEQ ID NO: 13177 - DNA, 48119 bp, Human; identical to SEQ ID NO: 12003

SEQ ID NO: 13178 - DNA, 6021 bp, Human
gccaggtgcagtggctcacacttatagtcacagctacttaggaggctgcggtgggagaatagcttgagcccagttgttcaaggctgagtgagctgtgattgtggcactgcactctagtctgggtgacagagtgagaccctgcctgtaaaaaaaaaaaaatctttcaggccagacgcggtgactcactcctataatcccagcactttggaacgccgaggcgggtggatcacctgaggtggggagttcgagaccagcctggccaacatggacaaaccctgtctctactaaaaatacaaaaatagccgggcatggtggcacatgcctgtaatcccagctactcgggaggctgaggcaggagaattgcttgaactcgggaggtggaggttgcagtgagctgagattgtaccactgcaatatgagactccatctcaaagaaaaaaaagaaaaaaaaaaaaagatagcatagcaatggctgtgggcctggatacaagtcttagcctctccacttctccacttcctggctctgtaagccttagacaagttccttaactccacacttccatttccatgtaacaaggggttataggccaggcattggtggctcatgcctgtaatcccagtgctttgggaggccaaggcgggaggatacttggggacaagagttcaagaccagcccaggcagcacagtaagacattggctctagaaaaataaaaataaaagaaatcatccaagaatggtgacttgcctactattctactcgagaggctgagaggggaggatttcttgagcccaggagtttgaggatgcagtgagctatgatcacatcactgtacttcagcctgagcaacagcaagatcctgtctcaaaaaattaaattaggctgggcttggtggctcatgcctgtaatcccagcactttggaaggccatggtgggcagattgcttgagcccaggagtttgagacgaggctgggcaacatgacgaaaccccggctctaccaaaaaatacaaaaaattaactgggcataatggtacatgtctgtggtcccagctactcggtaggctgaggtgggaggaatgcttgagcccaggaaataggggctacagtgaaccaggatcatgccagtgcactccaacctgggcaacagagcaagactctacctcaaaataattatttaaaaaaatggattaattgggcataggtggcttgtgcctgtagtcccagttactcaggaggctgaggtgggaggattgcctgagtctaggaggttgaggctgcagtgagccgggatggcaccattgcactccacctgggcaacagggtgagaccctgtctcaaaaaagaaaaaaaagggaggggttataatcactcctcctgacatgatacagagtatccatttgagttcataacataaatatgtacttggtgaatgctctgtaactattggcttttttattgttcccattttacatataaggaagctgaggctttgtgaggagaaatagcttagcccaggtcatccagtgggaagcgtctggtgcagaggaatagtgatcatggtgggactttgcctagcctaaggttcagcatacaatattcagtcagtactcaagggctgggctgtttctggtaatcaaagggctgccttgttctcctgccccacagcacaggaaattccaaggtggttttctttacaggctcctccgcttctgtggccagaggggacagcggaggagcccaggtacctaagccaactcaagagaagatggaattgaatatttcaaccaccttatctaggcctctgtgattgttgaggagggggctgtcactgggaaagttgtgagctgctttggaccttatctgggaatttccttgggcttacagcctttaccctatccttgaaatggttctggtttcatagcaacttctaggtggtgtgggcgaagtttgggactggtttagggcggggacaagaccaagaacacaagtttccttgtactacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccgtaagaatggggaggggagaattgggggcttgggcgttagcctgtgtggagggtgctgcattcccttctattccttccctagaccctatctccatggctgtggcccttcaggactacatggcccccgactgccgattcctgaccattcaccggggccaagtggtgtatgtcttctccaagctgaagggccgtgggcggctcttctggggaggcagcgtgagtcttgggagagtgaaagagggaagggtacagagctggggtagactcattatccccatgaagggaagatttgaggggggtgaactgaaatagacattgtggggggatattgttacttactttattttatttgcttattattttttaattttttccgagacagagtcttgctctgtcacccaggctggagtgcaatggcacgatctcggctcactgtaacctccacctcttgggtttaagcgattctcctgcctcagcctcccaagtacctgggattacaggcatgcaccaccacacctggctaatttttgtatttttagtagagacagggttttaccatattggccaggctggtcttgaactcctgacctcatgatctgcccgccttggcctcccggagtgctgggattacaggtgtgagccactgccccccagcctattttcactttatttaccaattttaggacctgatatggtcccatgttctgttctagacaccaagatacaacaacaaatgatcctttttattctaatggagggaaatgaacaaaaagcaaggcataaaaaatagcagcagccgggcacagtagctcacacctgtaatcccaagtaaggccaagttgggaggatagcttgagcccaggagttcgagaccagcctgggcaacatagcaagacccccatctctataaaaaaaaatttaaaattaactgggcatcatggcatgtgtctgtggtcccggctactcgggaggctgaggtgggaggattgcttgatcccagaagttgaggctgcagtgagccgtgatcatgctactgcacctcaacctgggcgacacaatgagaccctgtttccaaaataataataataataaaagcaaatatgcgctgctgtgagaattaacagagacttacttgggtgttcagaaagggcctctgaacaggtggcatttaagctgagattcatatgacaaggatggagcagttatgtggagatcagggagaagggagaatgcaaaggccttcagcaggcacaagcttgccatcttcccagaccctagcttttaactcctcttccccaggttcagggagattactatggagatctggctgctcgcctgggctatttccccagtagcattgtccgagaggaccagaccctgaaacctggcaaagtcgatgtgaagacagacgtgagtgtcatgggggctggcaagaaatgtggggggaggacccttaggttgtggggatgggcaaaaatgctcccacacttggctccctggcagcctaggtatgtgcgctgggagaaattctttccctgcctcaattttctcaccagtaaaatgggtccagttgggaggtgcaaagattagagggctctaggctaatttgcatagcacttgtgtggccagacctgggccctgcagctgcagcctttgctaaaaccactagatcctttgtggtgtgaccgctggttttctttccactgtttcccctttctctttttcagaaatgggatttctactgccagtgagctcagcctaccgctggccctgccgtttcccctccttgggtttatgcaaatacaatcagcccagtgcaaacggctcgtctccgtggtctttggggtggggtagggtagggtggggactgtacaaatgaaatgtttctctaggttgctgaatctaaccaattaacccgctgcctgtggtaacgtcagtggttgctaggcagagtttcactgatgaaagccctgtgcagtaggagcgctcctaagcttaggtttcggacacaagcaaaggaaaacctaagcagcccaactaggggattgtagtgtcctctctagaccagtgggagggagccaatcggactacgcggaggatataaatcgcacagtaaaggttttcttggaagattatctggaaagggaggtgggaagtaacctgcgcctatctgcccagttttcctccttttcgcctttgagaacagtaatcgctcccgccagctcaagatcagctcctcttccagcctctttctgtcaatcctgcccgtgcccccttctttgcatttgtatcccctcccccaagtccgctccgatccaatccggagactcgactctgccccccgtactccagactaaatccgttcctcggctcagctaagcagctctgcacgtcccttcccacttgctcagccaatcgctgggctcggccccgcccctttgggcttggtccttctcacgccaccaatccgcgcctcttgtcccgccccctgcccgcgagtccgccaatcccgcccttcggaaagcgtcgcctggtatccagctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacggtgagggtggtggacgaagctggggtcctgggtctgggcccagggaggatgcggcctgtgggaatgggcggggctttgtagatcagggggcggggtctggtgtgatggaggcaggacctaagtggatgctgggaggggtttagtgggtctgaggctgagcttaatcgatttaggtggagcctgagggtctggtgcgtgggttaaatagatctggggcgggatttgagggagctggtcctgaggggttcagggaggccctgagggaagaggtgggccttaatggatctgggcggagcctgagtgaaggggcggggctgactgcatgaatggcaggagtcgggcttatgggctagagggaacactgaatggaagctcgggaccctggggctgatctggctggagagagctctggaatgggtttggggatgggctgtccttgagttaggggcaggacttagtggcaaagggtgggacttatgcatgagaatggagccgggttctgggcagagggagggaaggagaggtcgggaagtggaaaatcagtagggatgcaccataggaggtggtgattggaggcaggggaagtgcaggtttaggagtcagagggagccgcattcactcaacaaatatagaagagaagggagaagagtgcaaagaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatctgggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcggtggctcatgcctgtaatc

SEQ ID NO: 13179 - DNA, 18094 bp, Human
acccggactggactgggcacttgtgaggacagctttcttcattgctggaggcacaccaccatggaagagatctaggtgggggacctaagtagtcagcctgtttgatcttgaggacacgggaaccccccccccaccccaagagatctgtgaagtgtctagggcagagcctgggtggtgggtggggcatggagaccctaccggtccttgtgtagtttcagaagcctcttcacatcttctctgcccttggggaccgggccggccttatcaaaggcctccttcaggagctggctcttctccaggccgaagacatgagggggagcaggccctgtggcagcgggtggaggaggcagtgggagcggtgggggaacaggggtctgctgactccagggaggggatggtaaagctgaaaagtccaggggacttgggggtagaggaggagatggaatgctgctggcttggggtacaggggtttttggaggagaaattggtggttttaggggaggagagcatggagaagtcattttggggtctacaggaggtgttgagaggttcagaaagcggggagggaaggatcctccaacggagaacggtctcagggatggagattttaaaggtttaagagctgagttccagaatctggggactgagcagtgggtgtgaaaggaccagggctaatatttgaaaccacgggagcaggaattgcgaggctgactcaagtcataaggcacctgacggttaacagggtggggtccttaaatccggaaccggatctgtggtaccggttgggttacctcgggagtcttaggtggagagttagtaggagttaactcattctttggggctggatgtggaaactcatgagtgagtttgggatatgaaggctcagatctagagtgaggtgccttaaggatgcgacttagggacccagggctaaagattcggagaacttaggttcagtaccccctcacatcccaggcccgagttcggaacctttgagctgacctttgagtcagaggtcaagaggtcaaaaaggacacctggcagggaaaatggcctagttgtggagaaggtcctggaaccagagcaacaaaaaacgtctgtgggttggagaagactcagagatcagaggccggtgggcgccgcgataaccactggaaaaaggaaaggagtcaggaagtaaagtgcacctcccactcccggaaaatggcggcccccgcacactgcctttcccatatcacgtggtattacacgcaacagttcccgcccattttgcgatcacgtgacagaaaacgcagctctggcgggggtaagaggcgggactccaaaaaggattgcctccggaagacaccgcagcgcgagacgcgtacagactcgtgaccttcactgattggtccgtagacccgggcgccacggaaggaggtgggctttcagggagtggggcggggtttttctacctaggcgggaacccaaatatcgttttgattggcaacagctgagcccagaaacgagacttgctctgattggtcaagctactgcgtttccgcgcggcgattggctggcagaaaggcagaggcggggccaggagagaaagctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatggtgagttctcgggatagtccggagtccagactgtcccgcacgggctggcccctcttccgtcccctgcacccgcctctctttctaagtgtttgtccagccaaacttcgagttaactccttggcctttacacaaactacttcctgtcttcaacactccattagttcatcttacactctgccctttaacgtggtcactgctgctcatcttacaaggtttgaggtcacaggacccttcctccaggaagccttgccttgtcccttcacgtggctgccgctgacttgccgtacgctgagaccatctcccatcaagccctgattcctctgagctgtcgtggggctctctctcctcccagtggcctttgaactccgtgagggcaaggactggggctttcttggtcaccggctttttcagtgatcagcccacaatgaaaatgtaccataatggtggctaacgctctgtatcatgggctggtctgtgtgctttcatataaatcttgataacatttaattctcacaacaatcttgtaggaagaaggctattgttattcccattcgtcaactaagaaactggggccgggcgcggtggctcacccctgtaatcaatcccagcactttgggaggccgaggcgggcggatcacctgaggtcgggagttcgagaccagcctgaccgacatggagaaaccctttctctactgaaaatacaaaattagccgggcatggtggcgcatgcctataatcccagctactcgggaggctgaggcaggagaattgcttgaacccaggagacggaggttgcagtgagccgagattgcgccattgaactacagcctgggcaacaagagcgaaactccgtctcaaaaaaaaaagaaagaaaagaaaaagaaactgagacaggggtgatgtgacttgcccagggtcacatagcaagtaaagtggttgaggccacccgtatagaattctgcttaggaacccaatttttggccgggcgtggtggttcaggcctgtaagcccaacactttgggaggctgaggcaggaggatcactgaaacacaggagttcaagatcagcctaggcgacaaagccagaccttttctctacaaaaaaaaaaaaaaaaaaaaaaaggctgggcgtgggtggggtgcgtctgtggtcccagctacttgggaggctgaagtgggaggatcgcttgagctagagaggttgaggctgcagtgagctatgattgcaccactgcactgctgcctgggctgagcaagaacctatctgaaaaaaggaaaaaaaaaagaactcaattattgaaatcggaaagactctctcacattctcaagtaaattatcacctttattgaacctcattttccagatctaaaaactgagcaaaatcataataccttttttgcatggatgttgggggagattaaattagctaaaccttgcagtatttcttttttatggtaactggcagctagtaaagggctggataaatgttagctcttatcacttcaagaaaattatcgggagaaccgaaggagcttgttgggattcagtttgaggttaccagtgaagttgctgttgaagaaagcaaaaccagcagccgggcactggctcacgcctgtaatctcagcactttgggaggctgaggtgggcagatcatttgaggtcaggagttcaagaccagtctggccaagatggtgaaaccccgtctctactgaaaatacaaaaatcagctggatgtggcggtgcgcacctacagtcccagctactcgggaggctgagcaggagaatcacttgaaccctgggaagcagaggtcgcagtgagctgagaccgcaccactgtactccagcctgggtgatagagactgtctcaaaaaaaaaaaatcaggagtgtaaattttgcaaatggtttttttttttttttttttttttttttttgaggcagagtttcactctgtcacccaggctggagtgcagtggcacgatcttggctcactacaacctctgcctcccaggttcaagcgattctcctgcctcagcctcccgagtagctggaattacaggcacccgccaccacgcctggctaatttttatatttttagtagagacggggtttcaccatgttggccaggcttttctcgaactcctgaccttaggtgatccgcccacctcggcctcccaaagtgctgggattacaggtgtgagccaccacacccggcctgcatatgtttttagagtgtggtgcccaaccattatcgggcagtgctggggacacattggtgacatagaaccctggttttttgtttttaaatcttattttatttatttatttatttttgagacggagtcttcctctgtcgcccaggctggagtgcagtggcaccatctctgctcactgcaagctctgccttgcctcctgggttcacgccattctcctgcctcagcctcccgagtagctgggactacaggcgcccaccagcacacccggctaattttttgtatatttagtagagaaggggtttaaccatgttagccaggatggtgttgatttcctgacctcgtgatctgcccaccttggcctccaaaagtgctgggattacaggcgtcagccccagcgcccggcgttttttttttttttttgagatgagacggagtgtcgctctgttgcccaggctggaatgcagtggtgcgatctcagctcactgcaacctccgcctcccgaattcaagtgattctctgcctcagcctcctgagtagctgggattccaagcacctgctaccacgcttggctaatttttgtatttttagtagagacggggtttcaccatcttggctatgctggtctcgaactcctgaactgtgatccacccgcctcggcctcccaaagtgctgggattacaggtgtgaaccaccgcacccggccagaaccctggttctttaggacagtgacagcccagagtagtcagggccatcaggcaggaagcttaggcagagtgttgagggctgggattgggaacttagaaagacagagagatccattcagcttccaggaaaaggagacattttggagagcctgccaggtacagtaagcagtatttatgttacactgagggagaagagcattcttaacttggtccagcttgttcagatgtttagggtcaaaagagcctggcgtattctgagtattacaagtagttttgaggcttgtaaatcatggggaaacttccagtgagctgtgcactggtggctcatggctgtgaggtgttggactttgccctgagggtgttggggagccagactgcttccctgtcctggctgcctccctggtggaatatcctcccagctgtggagggtaaatgcgaatgggcgaggggaggctggagagtagagagaggcccagagtcccgtggaatgagtgaagtctgagcaagattcatggggatggagtacggagaggaaaaccagaaatgtcaccaccaggagaatttttgactaattgcttaaaaacaaccttgactgctgtccctgcccccacccagcctacacattttcttgcttctttcctagcctggtatctattttacaagtggcttctgcttcagcttagcttttttttttgagatggagtttcgatttgtcacccaggctggagtgcagtggcgcaatctctgctcactgtaacttttgcctctctggttcaagctattctcatgcctcagcctccccagtagctgggattacaagcgccctccaccacgcctagctaattttttttcttttcctttttttttttttttttttttttggcatttttagtcaagacggggtttcaccgtcttggccaggctggtcttgaactcctgacctcacgtgatctgcctcagcctcccaaagtgctggaattataggcatgagccaccatgcctggccagtttttatgaaggttggagtccagtggtgaggtcatggctcactgcaacctctgcctcccaggctagagtgatcctcccacttcagcctcccaagtagctatgaccacaaggcatgcaccactatgcctggctaatttttgtatcttttgtagagacagggtttcaccctattgcccagactggtcttgaactcttgagtgcaaaggatctgcccacctcggcctcccagagtgctgggattacaggtgtgagccaccatgcttggccatctcagccatcttctttgcataagacattggtgccctttgcagacctgggtggtgagagggagtccatccttgttgagcttgaatctcacttgctgtcaagtgatgccctttgctggtgagatgtggtggtaccgggttcagatggaatacgtggactgggctctgccatacgcttccttatgccctccagattgatgccctgggccagtgaggaatcctctgagaacctgtttccagtaaaattgggacagtcatagttgccacctaatgggtttgttgtgaggaagtgaagttacctccataaagcatttgatgggggtgcgatgactcatgcctgtaatcccagcactttggggaagccaaggcaggaggatcactggagcccaggagttcaagaccaacctggccaacataggagactgtgtctacaaaaaataaaaaattagccgtgcgtcgtgctgcgtgcctatggtcccagctccttgggaggctgtggtgggaagattgcttgagcctgggaggtcaggcctgtagtaagctaccatcatgccactgaactccaccctgagcagtagaaggagattctgtctttaaaaaaaaaaaaaggcacttgatggtatctagtcaaatgtttgcagccaggtgtggtggcacactcctgtaatcccagcactttcggaggccaaggtgggctaattgctgaagctcaggagttcaagaccagcctgggcaacatagcaagaccctgtctctgcacaaaatccagaaattagctgggcatggtggcatacacctgtggtcccagctactccataggctgaagtgggaggaccgcttgagtccgggaggttgaggctacggtgagccatgatcatgccactgcactccagcctgggtgacaaagtgagaccttgtcaccaaaaaaaaaaaaaaaaaattgtggtggagtctgtgctaggcttggcatactgcagtaaacaaatgggacaggcttatagctcctcaggcaagatagacaagttaacgtaccatgacaggaggtgggaaatagtcatgaaagaaaaggaagtagagtaagaatgacatgggaagaaatttagacgtggtggtcagaggtggcaacatttcctctgagactgggtgactagaaggaggccaccatgtaaacctcaggggagggatgttccaggtaaagagagcagccagttcaaaggccctggggcaaaattggtgtgtcagacctgggggccagtgtggttgggaactcaggagggcggtggaatgtgggcagggatgaggtgggggaaatctgccagggccacgtcatgcaggcccatgtcagggtgctggtggcagtgaaaagaatcactcatttatcgagtgtttactacgtgccggatgctgtcctgagcactttgcatgtatgtgcacatgttcattatatagcagctctctgtaagcacatcttacagaagagtagaagagtgtacttggccacttgagtggttcctggctgcttctgtgattgttaggtcttgagagattatggacccgaggcattctgggtaccccatcaattggctgatggtcttctatttgggctgcgcttcttctaaaaaggggagctcaaaggtctttttttcccccactgcagagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatggtgagcattgcgggtacggaggctgtgtgggtgtgtaaaatgttataggagactgggcgggcctggattagaggaggggatattacggttcatttgccaaggtgaggctggaccaggctcccactgcaccttgcctcatttaaaaatcttttctttggccgagggcggtggctcacgtctgtaatcctggcactttgggaggccgaggcaggtggattacctgagctcaggagtttgcagccagcctgggcaacaccgtgaaaccctgtctctactaaaatacaaaaattagctcggtgtggcagcatgcacctgtagtcccagctactcctgtggctgaggaaggagaattgcttgaacccgggaggcagagattgcagtgagccgagatcctgccactgcactccagcctaggcaacagagtgagactctgtctcagaaaaaataaataaataaataaataaataaataaattattttgagacagaatcttcctctgttgcccaggctggagtgcagtggtgcaatcttggctcactgcaacctccacctcccgggttcaagtgattctcctgcctcagcctcctgagtagctgggattacaggcacgtgccaccatacctggctgatttttgtatttttagtagagacggggtttcgccatgttgcccaggctggtctcaaactcctgagctcaagtgatctgcctgcctcagcctcccaaagtgctaggattacaggcgtgagctactgtgccacactaagaatctttaacataccttcccctactgaataagcaccatgaaagaggggtttttgtctattttgttcattgctttattcccagagccttgaatggcgcctggcatctggcaggttctccttaaacagctaagtgagtgagattgaacctggaagactgaagtattcttgtgtgacaggaaatccccctgcactgcactcctctcctagcattgtctcctcggtcctttggcctgatgtttattgctgttccagcttcccttaaaaataccaacagcctttctactgaacacttgcttactgtgtgtcaggtactgttccaagcactttaactcatttagtcctcacaacagtcctttgaagtgggaagtatcataatccccatttttcagacaaggaagttaaggccaagatatttctgtgtttctcagtaagctcctgataaggtctgaatttttttttgtttgtttgttttttgttttttgttttttgctctgttgcctgggctggagtgcagtggtgccatctcagctgactgcaaccttcgcctcctgggttcaagcgattcttctgcctcagcctcttgagtagctgggactacaggtgcgcaccaccatgcccagctaatttttgtatttttggtagaaatggggtttcctggccaggcgcagtggctcatgcctgtaatcccagcactttcggaggccgaggtgggtggatcacctgaggtcaggagttcgagaccagcctggccaacatggtgaaaccctgtctctactaaaagcacaaaaattagccaggcgtggtggtgggcgcctgtaatcccagctagtagggaggctgaggcagaattgcttgaacccgggaggcagaggttgcagtcagctgagatctcatcactgcactctagcctgggtgacagagcaagacaatgtctcaaaaaaaaaaaaaaaagaaaagaaacaaagaaatggggttttgccatgttggccaagctggtctccacctcctggcctcaagtgatctgcttgctttagcctcccaaagggctgggattacaggcatgagccgcagcacctggcccctgataaaggtccaattttgaatcttggcaattgggctctgaatccacgctcttaacccgttctgctctctgtttggtagcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccggtaagccaggtcccggagaccaaccctcccactgccagaccttcctcagccacatggactggctttgggacagggtggggagagttctccccttggggcttcagacccctcctttccatttctttatagagatgtgtttctctctctcttttggggggtattgagcacctagatgatgctatctcctttcgaaactcttgttccctccttgtgactgtttctcaaggtctttcttcatggctatgacttggtttcgctctctccgtggccttgattttgtcgcctgtgtcttgtaactcattgtgcatgtagaaaatccaagtgtctactaagcaactgttaggattaataagtgaacttaaatttagaaagatcgctggatataaaggcaatatggaaaaaaattagttttatttatttattcatattatgttttgagacagggtctcactgtcacccaggttggagtgcagtggcgccatcacagctcactacaacctccgcctcccaggctcaagtgatacgcctcagcctccctagcagctggaactgtcagtccgtgccactccacccagctaacttttgcattttttgtagagacggggcttagccatatcacccaggctagtctcaaactcactgtctcagcctcccaaagtgctaggattacatgcatgagccaccatggctggcccccagttttatttttatatgccagtaacagaccagtagacttcacattgaaaagtagcactgaggggtaaatccaacaaaaggtttgcagaacgactacactgaaatcacagaatgtagctgggagaaatcagagactcagcaatggataggaagactcagtattgtcaagaggtcagttccatccaaattaattgaagattcaacgtgattgcaatcaaaatcccaccaggaatttcggtaaacactggacactgattggctctttctaaatgtgtggaaagacaaggccaagccaggcgaggagaataaagcaccaggacctgcatgaccaggggaagctccagcaaccaggccaggcccaatggctcatgcctgtaatcccagcactttgggaggccaagataggaggattgctttaggtcaggagttcaagaccagcctctataaaatagcaagacctcatctctacaaaaaataaaatagaaaactgggcgtggtgactcattcctgtagtcccagctgctcaggaggctgagctgggaggatcgcttgagaactggaggtcaaggctgcagtgaacagtggttttgtcactgcactccagcctgggtaacagagtgagaccttgtctcttttttgttttgttttgttttcttttgttttttttcgggagggagtctcagtcaatctgtctccccaggctggaatgcagtcgtgcaatctcggctcactgcaacctctgcctctcaagttcaagtgatcttctgcctcagcctcccaagtagctggatcacaggcacatgccaccacgtccatgtgcaaaaaaaaaaaaaaaacctgcagcaaccaaccaggatgatatacagttggcagaagggtaggaagacagaccaaggggacaggatgaagagtctaggcacagctacacttgtataattacttgatgtgtgatcgaggtaccactgcacttcactgaggaaaggactttttttcccctagttcatgatgcggggcagttgggtatctgcaaggggaaaaaattagccctacctcatactatatgcaaaatataacttgaagtgaattgcagatccaaatgtgacaactcacaaaatatagtttcttttctcttttcttttctttttctttttctttttttttttttttgagacagagcctcgctctgtagtccaggctggagtgcagtggtgtgatctcagctctctgcaacctgcgcttcctgggttcaagcgagtctcctgcccctgcctcccgaggatctgggactacaggcatgtgccaccacacccagctaatttttgtatttttagtagagatggggtttcaccatgttggccaggctggtctcgaactcctgacctcaagtgatccgccctcctcaccctcccgaagtgctgggattacaagcgtgagccactgcacccggccctcacacaataaagtttctagaagaaaacaggaaaatgtctaaatgaccttggtgagggcatgaaaagtggaaacatcctgttttccaaacaggatacaaaaagcaccgagtacaaaagaaaagatggatgaaccaggcccactccttaggtctctgagcctccgtgtctctctggctttcatgagtctcatggctctgactgggtcatgctctattcggtgccactcacactttctccaagttggtgatggtgtctggattactgtgggctcctgttaacctctctcctcttccctgcacctagttttctgtccactttggacttcagattgtgattccagcccctgagtgtgctgcctgccatctgttgtcttccctcttccccttgctgccacgcgttttgttctgcacctgccctgagtgtccctttccatcactgccctcctttgtttttgtttttgttttttgagacagagacttactctgttgcccaggctggagtgcagtggtgtgatctcggctcactccaaccttctgttgccgggttcaagtgattctcctgcctcagccactctagtagccgggattacaggtgcccaccaccacgcctggctaatatttgtatttttggtaggggcggggtttcaccatgttgcccaggctggtctcaaactcctaacctcaggcgatccgcctgcctcggcctcccaaagtgttaggattataggcgtgagccatcgtgcccggcctaccacacatttctttctgcacctgccctgactgtccctttccatctcttcctctcctttgattttgtttaagagacagggtcttgctctgcctcccaggctggagtgctgtggcacaatcagagctcactgcatgcagtcttgacctcctgtgctcaagtgatcctcctacctcagcctcacaaatagcatttaactctttctgatttaatgtcccactagaccctgggtttgttttgctctgtcgggccctctttgggtgccttttgcgcctctttctgggtgtttttccttacatctctcacccgctaggtttcctttcatggcctcttctctgcctcctggggctgctgtaaccacgcactctcctccctctctccacagggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctgtgagtatctagtcccacccaccaggtctcatataaatagtgagaatacaggactagaaagggaccagttggggggctgctgtaggttgggtggtctgggcaggccccctgaggaggtggtactgaatgaggaagtagcagtgggggtgggccctgggcagaggaattggcatgctggttggagggtacggaaggttagggtaggctggagtggtgccagcacctagattgattccatgagctattgagcgcctccttacgtgccaggccccgttctgcactgtagggctgcagcagggactgagatagaaacctctgctgtcctgtggcctatagtctgtaggggcaaagaggtgggaggcagacaggcaacagacaacaatatgtggtatgttgggtggaagtaccagagtgaattcaagcagggtgagggatggaggaagtggcagtactatgggtctcccactggactcagggctcttgtgctcaccgactcccctatacccccgcagctttctgagaatccaccgaatcacatcttgttcctcaccaacctgccagaggagaccaacgagctcatgctgtccatgcttttcaatcagtaagtggggcctgtggctgggtggtccctggagggtgatggccaggaggcatctccatggaaacaggcctcagaactctgccagcagagctctgagccaagtagggctttgcagaagggacagcgaccaaagatgtgaaaggaggaggctgtggctgggcccacggcctgtgggggacatgggggtgaggctggaaaggtctccatggccagggcttgccggcttttttcagccttgtttgagggctgagggagtccaggctctgggcctcattttcccagcccctaaaatgggggcatgcaaggcaaggtatgtgtaaaactgcattgagatgtccttgaacattggctaagactggcagaagtcagcgtgctcagaaacagcaagtgtgggagatggggatgcgtgaaactcttgtgcctggcgtcagggtggaggccggtgcagccgatgtgtagaggggctgttcaccattgttgagtgaagtcgtgggtgtgggtgagttcatctggtggttctgtttcaggggctgtgagtggggcattcgtcagtgtttgtggtggggagttggagggtgtctgggagaagggatggctacatgcagcatctcaccatgctgcactgcgtggcacttagaagaacagaaagcgcaactttataatagtgccgagagaagattgtgagaacctgaaaaatacagaaaaacaataccacatgtgcagcctgtccacaaagctgtatattttgtgagaatgccgatggaaaaaaggatacctagtaaacatgaggatggctgcttaatggagaaagaagtatggaatgagaagagggaaattagagaaacagcatatcagaaaagtgagggtaaggccgggtgcggtggctcacgcctaaaatcccagtatgttgggaggctgaggcaggtggatcacttgaggtcaggagttcgaggccaatgtgggcaacttggtgaaaccccttctctcctaaaaatacaagaataaaaatggaaaaagtgagggtattggttatttttttggtgtggcgggtgggttatgatttaggaagggcccaggagactgcggtgtactgtttcttgatttaggttgcagttgcatgggtgtttgtgtttaaatttttcattaaatgctatgtttacattagagtttttcaacttagtactatctgcattttgggctggataattctgagtaatggggccctgccctgtgcattggaggctatttggcatcatttctggcctctgtccacttgatgccgttacgttagggggaaatgctgagtccctgaggtctgtcgttctctttcaggttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaatcatttgtctgtctgattttcttgctcttcatggttcctttccctccacctcagcagcacatcctgggtttttggacctcttggcattttgaggtttgcaaccttggggaaacataggatagtgtagtaatattgttcaaactcaggttacaatgactactttggcagttttgtatgttgtcccaattcacagcaggaaatggaatcctgggtcaggaaatggaaagtcagggctgccgcgtacagttaggcaggatgggtactgcacaagaatggcaccttttaagggcacaccattcactttgtaggcttacaagtttatgccaccacttttctaacagatgacaagagtgttcagggagaggtgtttcttcaccttttttttactcttctcaaaagtgcagcctgttgtagcaatggccccagagaaaccacagtaggtagttcaaacagaaaggaatttaatacaggaaacttggtgctgctgaaatcatggggcgtgtgggtggtaggagtggcggtctgggtttgagactcttgagttcgagtttgcagcccccgaatgagctcctagctagagttcagcgggatgccactctggcttccggcagtgcctggactcatttggtcactcctgggaagctactgacttgatgctggtatgaggggtgtggccgcctcacacacaggtgatctactttcctggccagtggccagccaggagcttcaggcaggtgcctgaccccaattcccctgcagtgtctagctgcagggaagtctaggatatgtgacttctggctgtacagccacaaacccagctgcagctctggattagaaagggagattgggcagggtggctcacgcctataatcccagcaccttgggaggccgaggtgggcagatgacgaggtcaggaattccaaaccagcctgaccaacatggtgaaaccccgtctctattaaaaatacaaaaaaaattagctgggcataggggtgcgtgcctgtaatcccaactactcaggaggctgagacaggagaactgcttgatcccaggacggggaggctgcagtgagccaagattgagccactccactccagcctgggccacagagcgagactcaaaaaaaaaaaaaaaaaaaaaaaaggttgagtcaggcgtggtgtctcacacctgtaatcccagcactttcggaggccgaggcgggcgcatcaccagcggccaggagttcaagacaagcctggccaacatggagaaaccccatctctactaaaaatacaaaattagccaggcgtggtggtgtgctccggtaatctcagctacttaggaggctgaggcagaagaatcatttgaacccaggaggcggaggttgcagtgagtcaagatcgtgccattgcactccagcctgggtgacagtgagactccgtctcaaaaaaaaaagggaagggagattggttggggggaccatccttaggagtttgtcacatccctgtcctggggaattttaaattgaccaaaaataatatgcacatggcccggtgctgtgactcacgcttataatcctagcactttgggaggccgaggtggacaggttgtctcagctcaggagttcaagaccagcctgggcaacatggtgaaaccccatctctattaaaaatacaataaattggccaggcgtggtggttcattcctgtaatcccagcactttgggaggccgaggtgggtggctcacctgaggtcaggagtttaagaccagcctggccaacatggtgaaaccccgtttctacaaaaatacaaaaatcaaccaggcacgggtggcgggtgccaatcccagctactcgtgaggctgaggagggagaatcgcttgaacccgggaggtggagattgcagtgagccaagatcacgccattgcactctggcctgggcaacagcaagaatctgtctcaaaaaaaaaaaattagctgggcatggtggtacacacttgtcccagctacttgggaggc

SEQ ID NO: 13180 - DNA, 112874 bp, Human
  misc_feature (1)...(112874): n = A,T,C or G
agttaacagctgtgtgatattgggcaagtcactctctgggtctcagttttctcatctgtcaagtagggtgatactagttcccaccccattttgaaagctctcatgtgaagagacgacagagcaagcttggcttagtaaatcctctctgggagtgcgaacaaccaccaccacaaccacaataatgacaaccgcattgcataagagccctggacttacacacgactgtgccagtggagtcctcccggggctcccggggccaattcctctctggcttggactcacataaacttggatctcacatctttccccatttctgcccccgtggccacttgctttggcccctgagtcctcatacacctggctggggcgctcatggccccaatcagcctcggcccgaccccatggtgccccttcctaaagttctgcccgtctgtcccgtgacatgccccgcccgccccggctcatgcctgcttgcaccgcctgcgccagggtggtgagcccggtctggccagtggcgccgaagatcgcgatcttcttgacggccatcgtacgggatcgtgggggtgcaaggcctcagagtctcggcacgcgcgggaacccactggctgctgggcggtgctctctgccctactcaagccaggaacaacggggcggagctggctcgaagggccacgcctcagactctccgcccgcggctcaggtcaaggggcggggcctaacgcggatgggcggggcaggcgtcagcttgcattcgctcaccgtccagcaccgccctctctgcgcgccacttagactggaaggcggggccacagaaggccacgcctccacatagcaacaaatagagtggacggagccgagataacttgtcactcagcgccctgcctccgcgctccacctcccggagaggggcggggccaggcgagcctcacccacggcctctcgtagctcacgccccctctcccggagcctggagcggatctggggcgcactctaagccccagggcctcccagaaccagcaaggggagaaagttaggaggacagagtgtgtgtgtgcacttggatgtaagacactgtgtcacggcgtacctatgcacttatatgaccctgtgtgactcagtgacccggagggcaagcaggactgtgggtgacaccttgtgtcatcctctgagtgtgatcccgtgttacagtgtgactacacgtgcgtgacaccacgtgtggcaggcattgattctgttcttttgtgaccttgtggtgacaccgtgggtgacactgcgtcagcctgtacgatagggtgtgggacgtgtgaggtgtgctacatggaagcgtgagactaattagactgtgacagtgtgtgacaccacatgtctcgtgtaaggatgtgtgacaccgggaccccattcgagtgtgtggctgtgggtgtctgtgttgagctgctcattgtgaccccctgtgactatgatgtgtgaggtgcggcggtgcagcatgtgcggggcgactgctatgaaggttcgagtgtgtagagtgtgtgacactgtggctgtgaagctgtgcgtgatgtgtgggcctatgacactgtttgtgactgccggggagtgtgcggctgtgtgtgacaggtgcatttgtgtgtgacgccgcgtgggcggtggttaccctattggatttgtgtggtggtgggtgacaccgttccagtgtggacgccgcgtgtgacggcgtgagggtgtgaccccgtgagaccccacaggagggagtgacggcgcgcaagcgcgtggatgcgggggtgagtttgtgcgccgaggcccccgcgagtatggcagcgtggcgagcgtgaccccgtgggagtgtgcagcgcgtgacgccgccgtgccctcgcgagtgcagccgtgcaccccacgccgcggccgggtgtgactgcgcgtgggcctcgggcggcggggcgcggggaccgcgggcgggagggggtcccgggggcgcgctgagcgcggcggcggcgcgagagagggaggcgcggcggcgcatgcggatctggctgagccgcgggccggcggggccgagctgagccgggctgggccgggccgggccgggccgggcagcggacgccgacagggagggcggtcggtcgcggcgagcagcggagacagcgacgctggcggccgctgggcccagtgtgagctgctagtgggggccgacagcccctcccccaagtatgtccccacctggcgagcatccctcctccgcgcgcacggggcatggctggagccccgggtctccccggctggagggaggcaaagggtcgagggcaggacgagcccacaacccccccacccggtctagcttccgcgccacgcgtgggtcttacccccaggccttgtccttcccaggccccctccttgggcgcagtgtctggaccgcagggagagaggcgcggcctgggaagggttaaagcctctgatgccaccgcagcccagcgccccaccagcctttgcgggggggggggggtgttggggggaggctcgcaggacaccccttcccggcttccctattacctgctcccttccttcccattcaatcgcgttatggccagagctgatcctcggcctggccagagggctaacaggagtgctaagggcctccccatctctaagtgtcttccactgaagaaaacagctgtaaccaccgtttaacagggagggaaactgaggcacagaaaggccaagttaaagatactcggttaaagatacagcaagaataaagcggaacttgaactcatttctgtctgactccagaagaggcaaatcgatttgctgagatgtgtgaggaaaagatgaagaataatagcaaggaacatgtatcaagggcttgcagtgtaccagataccatgatccctgcattaataacttacctcttcaaacaccgctaagaaacgggtacgattatcattacttttttttttttttgagacggagtttcactcttgtcacccaagttggagtgtaatggcgcgatcttggctcactgcaacctctgcctcccgacttcaagcagttctcctgcctcagcctcccaagtagctgggattacgggcatgagctaccatgcctggctaattttgaatttttagtagacatggggtttcactatgttggtaaggctggtctccaactcttgacctcaggtgacccacccacctccttggcctctcaaagtgctgggattataggcgtgagccaccgcctggcctacccttttgtgtgtgtgtgacagagtttcattctgtcattcaggctggagtgcagtgagtcaatctcagctcactgcaacctccatcccccaggttcaagcgattctcctgcctcagcctcccaagtaactgggactacagacacgtgccaccacgcctggctaatttttgtattttttttagtaaagaccgggttttgccatgttggccaggccggtctcgaattcctggcctcaagtgatccacctaccttgacctcccaaagtgctgagattataagcatgagccaccgtgccgggccatcattactattttgcagatgaacaaactaaggcccaaagagtggaagtatttcagccaaggtcacacaggtggtaggtagctgtgtgctcactttcacttttccatggaaggagggaagaacaaaaatggatttgggactgggcacagtggctcacatgtgtaaccccagcactttgggaagttgaagtgggcaaatagcttgagcccagatgtttgagaccagcctgagcaacatagtgagaccccctctctacaaaaaatacaaaaattacctggtcatggtggagcttgcctctagtcccatctactcaggaggctgaggtgggaggatcgcgtgagcacaagagttggaggctacagggagctatgattgtgtcactgcactctagcctgggtgatagagcaataccttgtctcagaaaaaaaaaaaagatttcaatgtgtccccctaagggacaatttccactctactcactctactgaccaagacttagaccctgccttcctagaattcagtgggttggcaattgtctgggtcttttgaggacattgatctcccaacttcctcctttgttagtcttttttttttcctttttcttttgagaaggagtcttactctgtcgcccaggctagagtttagtggcacaatctcggctcactacaaccttcgcctcccggtttcaagcaattctcctgcctcagcctcctgagtagctgggattacaggcacctgcaaccttgcccacctaatttttgtgtttttagtagagatggggtttcaccatgttggccaggctggtcttgaactcctgacctcgtgatccacccgcctcagactcccaaagtgctaggattacaggtgtgagccaccacgcccagccgttagtcttagaatcaggcctgggggcccagaaggtaaaggagatacatctaatgtcacttaaccctttaaatttcttctctttttttttgttttttttgagatggagtctcactctctcacccaggctagagtgcagtggtgcgatctcggctcactgcgacctccgcctcctgggttcaagcaattctcctgtctcagcctcctgagtagctgggattacaggcatgtaccaccatacccggctagtttttatatttttagtagaggcggggtttcaccatgttggccaggctggtctggaactcctgacctcaggtgattcacccaccttggcctcccaaagtgctgggattacaggtgtgagccactgtgcccggccaatttcttctttttttaaataattttttgttttctatttttttattttcatttaatttaattttattttttctgagatggggtctcactctgtcgcccaggctggagtgcagtggcacgatctcagctcactgcaacctctgtctcccaggttcaagcgattctactgtctcagtctcctgagtagctgggattataggtgcacaatgccatgcctggctaatttcttgtattttagtagagatggagtttcaccaagttgcccagactggtctcgaacccctgagctcaggcaatccacccgccttggcctccctaagtgccaggataacaggcatgagccaccgtgcccggcctatttttatttttttatttttgtttgagatggtgtctcgccctgttgcccaagccggagtgcagtggtgccatcttggctcactgcaacctctgccttcccaggttcaagcgattctcctgcctcagcctcctgagtagctgggattgcaggcatgcactaccatgcccagctcatttttgtatttttagtagagatggggtttcaccatgttggccgggctggtcttgaactcctgacctcaagcgatccgcctgccttggcctcccaaagtgctgggattacaggtatgagccactgtgcctgccccctccactttaaatttttcttcttcttcttcttctttttttcttgagaatgagtcttactctgtcgcccaggatagagtgcagtggcacaatctcagctcattgcaacctgcgcctcctgggttcaaacgattctcctccctcagcctcctgagtagctgagattacagtagcccgaaaccacacccagctaatttttgtattttcagtagagaccgggtttcaccatgttggccaggctggtctcgaactcctcacctcgtgatccgcctgcctcggcctcccaaagtgctgggattacaggcaggacccactgtgcccagccccattaatgcaaatattctatcaccttttttttttttgagacggagtcttgctctgtctcccaggctggagtgcattggcatgatctcggctcactgcagcctccacctcccaggttcaagtgattctcctgcctcagcctcctgaatacctgggattacaagtgtgtgacaccacgcccagctaatttttgtatttttagagacagggtttcaccatgttggccaggccggtcttgaactcctgacctcaggtgatctacccatctcagccccaaaaagtgctgggattacatgcatgagccaccgcgcctggccctatcatctatgtttgaatcctagatactaactggctgtgtaaccttggaaaaatagatcaactcctctgtgcctcagtttcctcctctgtaaaataggtgtaataatagccaactgttagggaattaaatttgtggaaataataagagaaggtacatgaagtactgaccacagtgcaagtgttcaatatgttcattattgttattactgcattacagaactctattgttctaataataacagtgacaatttgctgagcccttaatatgtgccaggggctaagccatgtgttttatcacatcctgtgaagtggtgagggtgaacattattattattattatttagaaatagggtatcgccatattgcccagtttggagtgcagtgtcactattatagatcactgtagccttggcttcttgggctcaagccatcttcctgcctcagcctcctaaatagctgggactacgggtggcaaccaccacatttggctaatttttaaatttttttaaaagacagtttctggctctgctgcccaggctggagtgcagtggcgctatcttggctcactgcaacctccacttcacaggctcaagccatcctcacacctcagcctcctgagtagctgggattacaggcacgttgccaccacatccagctatttttttttttttttttttttttgagacagagtttcgcttttgttgcccaggctggagtgcaatggcatgatcttggctcaccacaacctccgcctcccgggttcaagcgcttctcctgcctcagcctcccgagtagctgggattacaggcatactccacctcgcctggagaattttgtatttttattagagacagcgttctccatgttggtcaggctgatctcgaactcccaacctcaggtgatccgcccgcctctgcctcccaaagtgctgggattataggtgtgagccaccgtgcctggccaatttttgtatttttttgtagagacagggtttcaccatgttgcccaggcttgtctcgaactcctgggctcaagcaatccgccctcctcagcctctcaaagtgttgggattataggcctgagccactgcgcctggcttatttttatttttatagagatgaaatcttgctatgttgcccaggctggtctccaacccctgggctcaagcgattctcctgcctctgcctcccaaagtgctgggattacaggcatgagccactgtgcctaggccttatcattgttattatgtccactttaaagacagagaaattgaggacaagagaggggacaggactcaaagccagtcactgttagaaatgagacttgatcctagacctaacctacctctccctatgtccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcaggtacctggaggagggctggggtgggatgaggaggagggggaagggggaagggtgcccgagaaccttggtggctgggagggtgggaaaagagaccagcactgtccaatagaactttccatgatggtggaaatagtctatatccataatgtaccatataataatcactagtctctgtgacttttgaatgctagaaatgtggccagtgctatgtgacagcctttgagttttaaattttatttagttttaattaaatttatttatatatatattttttgagacagagtcttattctgttgccccggctggggtgtagtggtgagatcttgggtcactgcaatctccacctcaccggctcaagccatcctcctacctcagctccctgactagctgggactacaggtgcccgccaccacacccggctaattctttttgtatttttagtagacaccgggtttcactgtgtttgccaggctggttttgaacttctgaccttaagtgatccacttgctttggcttcccaaagtgctgggattacaggcatgagccactgcacctggcctggtgttttttttttttttttttttgagacggagtttcgctcttgttgcccaggctggagtgcagtagcgcgatctcggctcaccgcaacctccacctcccaggttcaagcgattctcctgcctcagcctccctagtagctgggattacaggcatgtgccaccacgcccagctaattttgtatttttactagagacggggtttctccatgttggtcaggctggtctcgaactcccaacctcaggtgatccacatgtctcggcctcccaaagtgctgagattacaggcatgagccacggcacccggcctgttttaattaaatttaaatagccacatgtggcttgtgactgctgtataggtcagcacagccttagagccttagaaatgtacagtcccagaatggtgggactctgtaagcatattcccttagaatcccgaaatgcagagccatcagatccttggaacttgaaatgtctaagagattcttagacctcttgaaatgaagacctctggcctggcgcggtggctcacgcctgtaatcccagcactttggggaggcaaaggtggacagatctcttgagtgcaggagttcgagaccatgttcgccaacatagtgaaaccctgtctctactaaaaataaaaataaaaaaaaaaattagccaggcgtggtggcatgcatctgtagttccagctatttgggaggctgaggtgggaggatggcctgagactgtgaggtggagattgcagtgagtcaagatcgcgccactgcactccagccccagcagtaaagcaagaacctatctcaaaaaaaaaaaaaaaaaaaaaaaaaaaagagctttggaaatgtgaaacgttatcatcacagacctaagaaattttagtcattgttccctaggatcataggcccttagaaactgaaactgtaatacacaggaacctttgggacttgataatactaaacctttggagtttccaattagaaatgtggatcttgagaaatctgacatagagtgaccaaaaccttcctgcttttaccaccgaaactctcagccttgggccaaccagtacagtgggtcaccctaccattttttttttttttttgagtcagggtctcactcttcacccaggctggagtgcagtggtgtgatcatggctcactgcagccttgaactcctggactcaagtgatcctcccacctcagcctcctgaatagctggaactacaggcatgcgccaccatgcctggctaattaaaaataatttttttttttggcgaagcatggtggcggatgcctgtaatcccagcactttgggaggctgaggcagatggatcacttgagatcaggagtttgagaccagcctgaccaatatggtgacactactaaaaatacaaaaattagatgggtgtggtggtgggcacctgtaatctcagctacccaggaggctgaggcaggagaatcacttgaacccgggagatgggggtttcagtgagctgagatcacaccatttcaatccatcctaagtgacaagagcttaactccgtctcaaaacaaaacaaaaaaatttttttgtaagatggggtcttgctatgttgcccaggctggtgtggaactcctgggctaaaataaccctcccacctcggcctccgaaagtgctttgattacaggggtaagccagagtgcctagtagtcaccctactttgatgtatcagaacaatattagcaaagaccagagaactttatagttatagaaagaccttagacctttagaactgtagacccttgaaccttagtacttagtattcatagaggtctggaaccttagaagtgtttaatcatcagcattaaaactggcaaagaccctgaggagcctcagagatatggaacgtcataatcataagcctttaaaacatgacaccctagcacctttgacccttgggaccttaacatcttagaaacacggagcgctagaatcataaaatatagatgatcataatcatgaattcttaaaacccaaaggtcagaatcagttccctccaaatcttagaactttagtaactcagcagtttataatcacaagatggatctctgatactaagatttttggaactttatttatttatttatttatttgaggtggagtctcactctgttgcccaggctggagtgcagtggcgcaatgtcagctcactgcaacctccacctcccaggttcatgagattctcccgcctcgggagtcccgagtagctgggactacaggcccgcaccaccatgcctggctaatttttgtatttttaattgaggcggggtttcaccatgatggaccaggctggtcttgaactcctgggctcgggcaatctgcccaccttggcctcccaaaatgctaggattacaggcatgagccatggcgctggctcaagaaacctggctgatctagaaacctgtagtcccagcactttgagaggccgaggcgggcggatcgcttgagcccaggagttcgagaccagcctggccaacatggtgaaaccccgtctctactaaaaatataaacattagccaggtgtggtggcgcatgcctgtagttccagctagtcaacaggctgaggtgggagaatctcctgagcccgggaagcagaggttgcagtgagccgagattgtgccactgcactccagcctgggcaacaggttgagaccctgtctcaaaacaataagaaacctggttaggcgcggtagctcacgcctataatcccagcgctttgggaggccaaggtggggggatcactggaggttgggtgtttgagaccagcctggccagcacggcaaaaccctgtctctattaaaaatacaaaaattagctgggtgtggtggcgcgtgcctctaatcccagctactcaggaggatgaggcaggagaatcgcctgaacctcagaggcggaggttgcagtgagcctagatcgtgccattgtactccagcctgggcgtcaatagcaaaactctgtctcaaaaaaaaaaaaaaaagagagagagagagagaaatctgtatatgccacaaagtatgaaccagattcaactggtggattgccagctttgtctgatctagaaacctagactgatgaaaacatacgctcatggaaacttacagtcatacttttagagccttagaaccttaaaaaggtaggaacatatcaacttagaattctagaatttactaatttagtgtaagtgagtttgtttttagttttgtttgtttgtttttgtttttgagaaggagtcttgctctgtcgcccaggctggagggcagtgacactatctcggctcactgcaagctccgcctcctgggttcatgccattctcctgcctcagcctcccgagtagctaggactacaggcgcctgccaccatgccccgctaattttttgtatttttagcagagatggggtttcactgtgttagccaggatggttttgatctcctgaccgcgtgatctgcccgccttggcctcccaaagtgctggaattacaggcatgagccaccgcgcccgtcctgtttttagtttttgtttgttttttgaggaggagggggtctctccatgttgcctagacaggtctcaaactcccggtgtcaactcatccttctgagtagctgggattacagatgtgtaccaccactcccagctgtagaatttattattattattattattattatcattatcattattattatttggactgctgccaggctggagtgtggtgataaaaatcatagctcactacaacctccaactcctgggcttgagcaatcctcccaccgtagcctcccaagtagctgagactacaggcatgcaccatcatgcccagctaattttcttattattttatttttttatagagacagggtctcgcaatattttccaggctgaacttgaactcctggactcaagtgatcctcccaccttggcctcccaaagtgttgggattacaggtgtgaaccactggaatttattttatctagaaaatattaattcagtgcctgctgtgtgcctggctcatgctggacaacatgaggggcatagtggtgactgaggcagcctgggtcctgcccccacaggactcataggtcagtgagagagagagatccggttagacaatgatgacccagaggggtcagagacagggtaggggaggcacaggcagagaggttggggctgttgacagaaaggcacaagcatcaggctgtgatggggaagcccaaggactgtgggagcccataggatgtacttgatccagcctggagaatcaaggagggcttcttggagaaggagaggcctaacttcaggcctaaaggatgaattggcatgaacactggagtgaagagtggaagagtattctaggtagagggaactgcatatgcaaggcctccagaagctgggagtggcttgactgagaaggatacaggtgaggagtaaatgatgatgggagaggagccagtggaagccagatcctttttttttgagacggagtttcgctcttgttgtccaggctggagtgcaatgccgcagtctcggctcactgcaacctccgcctcctgggttcaagcgattctcctgcctcagcctcctgagtagctgggattacaggcgcctgtcaccttgcctggctaatttttgtatttttagtagagatgggggtttcaccatgttggccaggctggtctcgaactcctgacatcaggtgacccacctgcctcagcttcccaaagtgctgggattacaagcataagccactgagcctggcagaagccagctcttaaagggccttgcggggtaccagggagctatggaaagattttaagcagaggtgggaagattttaagcagaggtgggatatggtaagatgagaattaaggactctccaaatcttagaaccatgcttctgagagcatcttgcccagggaaatgtagaaatcccctttaagataaaaaaaaaaaatcctctccagtttgggcaacaaagcaagatcctgtatgcacaaaactttaaaaattaactggccacagtggcatgtgcctatattactctggaggctgaggcaggaggatcgcttgagcccaggaattgaaggcagtgatctatgatggcaccactgcattccaaccttccagcttgggcaacagagtgagatcccaccttaagaaattttattttattttattttttttgagacagagtctcgctctgtcacccaggctggagtgcaatggcacgatcttggcttactacaacctctgcctcctgggttcaagctgttctccttcctctgcctcccgagtagttggtattacaggcgcccgtcaccacgcccagctaatattttgtatttttagtagagatggggtttcaccatgttggccaggctggtcttcaactcctgacctcaagtggtccacctgcctcagcctctcaaagtgctgggattacaggcgtgagccacgcccggcctgtatgactttcataaatgctcacaaatgcacaactctgcttaaatctcccatgcttagggttcacatatagctctacaagtaaaacacatttatagaggaactccagaccccaaaccagtaacattcagcttaatagtaacttcatgatgctgctctcctgctgaaaccaccttgccactcaaagtgcaaatatgacgtagaccactacgctgcatttcttttgcatccctttgcccagctctctcatggtttttctcccgcttttattttgaggcagagtctcactctgtcacccaggctggagtgcagtggtgctatcacggctcactgcagcctcgacctcccaggttgcctgtaatcctagcactgaggctgagatgggagcatcacttgagcccaggagtttgagaccgacctggacaacatagtgagaccctgtctctatcaatgttttcaacattaaggaaaattgtttggaccccacgttcagtgtgttctcctactcaccctccacagtttgtggctcactactgtcattgatctgtgtgacgcctctctccaattctcttttattcccaaatctcaaatcaatttcttctcccctgtaggcaaccactgacattgttttgttttgttttttaaataaagatggggtcttgctatgttgcctaggctggtcttgaactcctgggcccaagcaattctcccacctcgacctcccaaagtgttgggaagccactgcttctgaccccattcagatagtttttaatgtgaatctttttctttgcatgagaataattttgcaaaatgtgcattgctaatgagtaagcatatatatatatatatatatatatatatttaactttttattattaaagtagttcatgacacagaatggcagataaatcatgccaatatttccacaaatgagtactctcttgtaaccagcacccatattaaaaaacagaatatacaatggggtgtggtgactcatgcctgtaatccgagtgcgttgggaaactgaggcatgatgatcacttgaggccaggagttcaagaccagtctgggcaacatagagagaccccgtctctacaaaaaaaaaaaattaaaaattagctgggtggggccaggcgtggtggctcacgcctgtaatcccagcactttgggaggcagaggcggatggatcacgaggtcaggagattgagaccatcctggctaacacagtgaaaccctgtctttactaaaaatacagaaaattagctgggcgtggtggtgggcacttgtagtcccagctgcacgtgaggctgaggcaggagaatggtgtgaacctgggaggcggagcttgcaatgagcggagatcaagccactgcactccagccggggttaacagagagagactccgtctcaaaaaaaaaaaaaaaaaaaattagctgggtgtggtggcatgagcctgtagtcctagctactcaaaagactgaggtgggaagattgcttgagcccgagttccaggctgcagtgacctaagaaggtgccactgccctccaacctgggcaacagaatgagataccatctctaaaaaacaaacaaacagaatgtgacatatgacagctccagaaaagcatcctcatgccacctccctatcactacagtccaagggtgtactctcttaacttctaacagctcagcttcattttgctggtgttttaactttctgtaaatggaataatgcattgtgtgttgttttatgtccggcattattcactcaacattatgcttgtgggagattcatccatgtctccctgtgcttgtggggtggtccttctccttgctgtatagtgttgcgtggtgtgaatgtaccacagtgtgtttgtgcattcacctgttgataagcatttgggttgctgctagtttggggctactataaatggtggtgttgggccaggtgtggtggctcatgcctgtaatcccagcactttgggaggccaaggcaggcggattacttgagtccaggagttcaagaccagcctgggcaatacagtgagaccccatttctactaaaaatacaaaaaagtttgctgggtgtggtggtgcatgcctgtaatcccagctactcaggacgctgaggcaggagaatcacttgaacccaggaggtggaggttgcggtgagccaagatagtgccactggactctagcctgggtaacagagtgagactctgtcttaaataaataaatacataaaataaatggtggtgttctcaagtttctagtacacatatttggtggacatatgcgcttgtttctggtggtttacacccacgcaggagtgaagctgtccaatcatagagtaagggtatatattttattttacatatatatgtatctgttgttgttaattgagacaaggtcccgctatgttgctcaggctggtctccaactcctaggctcaagcagtcctcctgccttggctgcccaaagtgtttggattacatgtgtgagccatgcgcccggccaagtgagtgcatatctaactttagtagagactgcccgtttgtatcgttttatattcccactagcagtgtaccagagattcagttactgtgcaccccacccttgcgatggtcaggttttttgttttgttttgttttgtttgagacagagtcccactctgtcgcccaggctggagtgcagtggcgcgatctctgctcactgcaacccccgcctcctgagttcaagcaattctcctgtgtcagcctctcaagtagctgggattacaggcgcacaccaccacgctcagctaatttttgtatgtttagtagagacggggtttcgccatgttggccaggctggtctcgaactcctgacctcaggtgatctgcctgcctcagcctcccaaagtgctgggattacaggcgtgagccaccatgcccagctgatggtcagtctttttaattttagccattttggtggctgtgcattctgttgtggttttactttgcattttcctgatgactaagaacaacgaagaaggtgaagcacattttcatacatttattggccattcaaatatcctttagtgagatggccattcaagtcttttttttttttcttttgagatggaatcttgctctgttgcccaggctggagtgcaatggcacgatctcagctcactgcaacctccgcctcccaagttcaagcaattctcctgcctcagccttctgagcagctgggaatacaggtgcccgccaccacacctggctaattcttatatttttagtagagatggggtttcaccatgttggccaggctggtctcgaactcctgacctcaggtgatcgacccacctctgcctcccaaagtgctctgattacaggcgtgagccaccatgcctggcctgatttttaattttttatacaatggggtctggctatgttgccaaggctggtgtggaactcctggcctcaagcaatcctcctgcctcggcctcccaaagtgctgggataatgggcatgagccaccatgcctggcctgatttttctattcctgattacagtcttgttagcatggagcaagagttgagaactgaaatgcccaccaagaccagacgggctgcatacactgagagaactgggacctcctgtaagagggcagcggccacatagctcccgcgatggcagcctggcaggaatggaggtccagggttgccgtatcatgtgatatttcatgagaagcccaaaatctaaattttttaaagacaaagtcttcctattttaaaatgttggcaactgatttacatttttataaaacgcagtcggggtgcaaccaaatatatctcagaggctgggcgcagtggctcatgcctgtaatcccagcactttgggaggctgaggcgggcggatcacctgaggttgggagttcgagaccaacctgaccaacatggagaaaccctgtctctacaaaatatacaaaattagccgggcctcgtggcgcatgcctgtaatcccagctactcgggaggctgaggcaggagaattgcttgaacctggggggtggaggttgcaatgagccaagattacaccactgcactccagcctgggagacagagggagactccatttcaaaaaaataataataaataataaaataaataaataaaatatatatgtatacacacacacacatagacacacacacccctacctctctcaagtatgagttcccaaaatcgatgatcccccagaatccactgaagaaagccaaatctagtccaaatccctctttttgcgaatgtgaaaactggggtcccgagaggggagatgacctcgagaagtcacctggccagttattagtacagacagggcagaacccagttgtcctcattctggtaccactctagggatgcactaaaattccactttggctttagtactagccaaaacctgctatttggcatgggcatcatctgttagaaggcagaggaataaatcctcaatttaaaataattaaaagagtataattggattgtctgcaacacaaaagtatctatcccttaaatatatataactgctatgtacccactaaaattaaaaatacaattttttaaaaaaaatattgcttcttactctagcagtagaaaatatacatttacttatctgtattttttaactttaaattgcaccttgaatgtttacctctagtttgaaaacaaatatgcaaatattaacagtaaatgcaaaggaaatatcttgtttgtgtcagtgtgggttttgtgctgtttagataagatgggaccctatgtgaatactgatcatcaatcatacctgagaaagtgatggcagaaaagatgctaaattgaggatttattcctctgccttctaacagatgatgcccatgccaaatagcaggttttggctagtactaaagccaaagtggaattttagtgcatccctagagtggtaccagaatgaggacaactgggttctgccctgtctgtactaataactggccaggtgacttctcgaggtcatctcccctctcgggaccccggttttcacatttgcaaaaagagggatttggactagatttggctttcttcagtggattctgggggatcatcgcaaagctcttcgcaaagctgaggtggaacgatggcttgagcctgggaggcagaggttgcagtgagccatgatcttacatcaccgcactccagcctggattttatacagggcagaccctgtatcaaaaaaaaagagagaaaaacaagtacaattaaattattattgaatataatcaccctgttgtactgatatcaaatactagatcttactcattctttccatattttgtacccattaaccatcaccccttcccttaaccccactattgataatgttacaaaaggtaaattttatgaaaaaggaaattattgagagatttcaaatggttgaaggagaaataaactggaaatatacatctttattcctgaattaatggaaaacttaataggaaacttaatattatttagtaatgggattttaacagtaactgtacaggctaagctgccaacaaatcgacttcacagtacagtggcttaatggagaagctatttctccctcccagataacctcgagatgatcaacacagttggcaggaagacttagctcagagaggtcagtgtacattccaggttaatttcatcttgtattctgtagacattgaccttggttttccagtttatgggagtcaggggaagaaagaggaaggccaggcagcaattttctttttcttttttaaactttatttttggccaggcgaggtggctcacgcctgtaatcctagcactttgggaggccaaggggggtggatcacgaggtcaggagatggagaccatcctggctaacatggtgaaaccccatctctactaaaaaaaaattaaaaaaaattagccgggcgtggtggcaggtacctgtagtcccagctactgaggaggctgaggcagaagaatggcgtgaacccgggaggcaaagcttgcagtgagctgagatcgcgccactgcactccagcctgggcgatagagtgagactccgtctcaaaaaaaaaacaaaacaaaaaccaaaaaacaaaaaacaaaaaaaccactttattggcacccaccaccatgcccgctaatttttgtttttctggtagaggtggggtttcaccatgttggccaggctggtcccaaactcctgtcgtcaggtgatccacctgcctcagcctcccaaagtgctgggattacaggcgtgagccaccgtgcctggcctaaactttattatttatttattttggaggcagagtctcgctttgtagcccaagctggagtgcagtggcacgatctcggctcactgcaacctccacctccctggttcaagcgattgtcatccctcagcctcctgagtagctgagattacagatgtgcgccactaagtcctgctagttttttgtatttttagaagagacagtgttcgagaggctggtctcgaactcctgagctcaggcaatccacctaccttggcctcccaaagtgccagaattacaggtgtgagccaccatgcccagcctttttaaaactttagattatgaaataattacacattcataggaagtcgcaaagatagtagagatgataaaaagacatgtaactggctggttgtggtagctcgagcctgtaatctcagcactttgggaagcgtacgtgggaggattgcttgagcacagaaggttgagaccagcctgggcaacatcgtgagacccttgtctctacaaaaataaaaattaaaaaatcagatgggcatggtggcatgtgcctgtaaccccagatactcaggaggtgggaggactgcataagcctgagaggttgaggctgcagtgagccatgattgtggcactgcactcaagcctaggcggcagagtgagattgtgactcaaaaaaaaaagagtaatcctactaaaaaatgtccaagggattttaatgacgtttctccaaagatatacaactgtctgatggagcatgaaaagatgctcaacatcattagccattagggaagtgcaaaagaaaaccacagtgaggtacaacttcacgcccactaggatggccataaaaaaaaaaaaaaacagtagagggaaatgaccaagcgcagtggctaacacctgtaatcccagcactttgggaggcctatgtgggtggattccttgagcccaggagtttgagaccagcctgggcaacatagtgagacccctgtctccacaccaaatacaaaaattagccaggcctggtggcatgctcctttggtcccagctacttgggaggctgcgatgggaggatcacctgaggctgggaggcagaggttgcaatgagccaagattgcaccattgcattccagcctgggcaacgtagtgagacccccgtctcaagggaaaaaaaaggaggggttgggaaacagcaagtgttggcaaggatttggagtcctcacacattgctggtgcagcaacttttttttttttttttgagacagggtctggctctgtcacccttgctggagtgcagtggcatgagcacaggtcactgcagcctcaacctcccaaggtcaagcgatcctcctgcctcagccactcaaggagatgggactacaggggcattccaccctgcctggctaattttttgtatttttttgtagagacagagtcttcaccatgttccccaggcaggtctcaaactcctgtactccagcaatccacccgccttggcttcccaaagtgctgggattacaggcatgagccaccatgcctggcctatggtgcagctactttggaaaacagtttgacagttccttaaggccgggcgcaatggctcatgcctgtaatcccagcactttgggaggctgaggccatggctgtatttatccgtgtcctctctgaactgagctctgtgagggccctgctgtattcacagagccttgaacaggcacagagtgtgcattcgaatatttattgaatgaatgaatgactagagccaactggggtcacaagcagggaaggcttcctgtgcaagtgacatgtcaggaaaacttcaagggacaggaaggttttcaccaggtgggtggcagagggtcggggaaggcgtcacaggtaggaggagacatgactgctgaggctggactctcttttttttttttgagaaggagtcttgccttgttgcccaggctgcagtgcagtggcgtgatctcggctcactgcaacctccgctccctggttcaagcaattctcctgcctcagtctcccgagtagctgggattaacaggcatgcaccaccatgcccggttaagtttctttttgtatttttagtagagacaggatttcaccatattggccaggctggtcttgaactcctgactttgtgatctgcccgtctcagccttccaaagtgctgggattataggcatgagccaccgcgcccagccgactcactctttttttttttttttgagatggagtcttgctctgtcgcccaggccggagtgcagtgatgcgatcttggctcactgcaggctccacctcccaggttcaagcaattctcctgcctcagcctctccagtagctgggattatgggcgcccgccaccatgtccggctgctttttgtatttttagtagagacggggtttcaccatgttggccaggctggtctcgaactcctacctcaggtgatccgcctgtgaggctggactcttgcagagagctgggtctgagcaggcttggctcgcggagggctggggtgaaggtggaagcgcctgggggctcatcagggcctctcctccagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctggtgagggggcctgaagggctggggcaggggtcctccctggggtctcaggctgggggttgggcttctctggaagggctgaactgcaagcaggggcctggctcatgggcgagtggaacgtgctggaagggccctgtgggtaagaggtccctctactcgggtgtgtggggctgtggcgctggggcggagcttggtcgtgagaagcctgggcgcgtggctggaaccgaagctgatggctcgctagctacggttgcgaggcggggcttcggtggaaggggccgggctctgttgcaaggggcagggctattagagaagggaggagctttgttagaagggactggcccgggttatgagctagtaggggcatgctataaaacaggggcagaactgtattgcgggttgggggtgggtagtggatgaaggtgcggggctctaggctagggggcagtgttcgttggtagggtgacacctaggtcgtcggtgtctagggacgcagacggtgtcctgggatgtggcttgttgtataaattggggctgtgtctctgggcttgaatggggtttcatctaaaagcgtgggattctcatggggtagagattcgttaaaggactggagcctggatctcaaggaattgtgaggggcatggctatggaataggaacaaacagctgggcgctgtggctcatgcctgtaatctcagcactttggggagccaaggtgggaggaacacttgagctcaggagtttcagaacagcccgggcaacataatgagacccccgtctctacggtttgtttgtttgtttgtttatttgtttaaattaaccaggcgtggtggcgcaggcctgtagtcccaagtacccaggaggttgaggagagaggatcgcttgagcctgggaggtcgaggctgcagtgagccatgattgcaccactgctctgcagcctgggcgacaaagcgagactctgtttctctctcttttttcttaatttttttattcttttaaatagatacgaggcgtcactatgttgcccaggctgatctagaactcctggactcaagcgatcctccagcctcggcctcccaaagtgctgggattacaggcgtgagccactgcaccgggcagagaccctgtctcaaaaataaataaataacccaagcgctgtggtgagacccgtttctacaaaaaatttttaaaaaatcaaaaagcattagctgggtgtggtggcgggcacctgtagtcccagctgctcaggaggctgaggcaggagaatcgcttgaacccaggaggcagaggctgcagtgagtcaagatcgcgcgactgcactccagcctgggcgacagagtgagactccgtttcaaaaacaacaacaaaagccaaaaaaaaaaaaaaagaaagaaaaaaaagaatagataggaaccaacgctgttggaaggaattgagccataaacaaggggaagagcactggggcagggcggagcttgattgggatgggcgtggttctagctagggacccgaaagggaagcagcgaggggtgtgacgcggagtttttgtttgtttgtttgaaacgaagtctcgctccctcacccaggctggagtgcagtggcgcgatctcggctcaacagcagcctccgcttcccgggttcaaaggattctcctgcctcatcctcccgagtacctaggattgcgggagcgcgctaccaagcccggctaatttttgtatttttagttagaggcagtgtttcgccatgttggtcaggctggtctcgaactcctcgcctcaagtgaaccacccgcctcggcctcccaaagtgctgggattacaggattgagccactacgccggggcggccatgggattagtggcaaaacattggtagagagggatccaatggcagggccagggctgagactatgggctaggagggcggggcttcatgatgggggcgtggttatcaggttcgaagtggggcgcccgtggaaggggcagagccagggacgtgaataaaccttgaagggatgtgattctttaaagggtctggctatgggaagagacagagcttctttagaaggattgagtcctgtgtcttggataaaacgagaggaggacagcctgatcctggacactcagggggcgtggccacgggaggcgggcttctttggaagctgcggggccgagggcgccatactcctgtctgtccagacccccgatcgcccaccgcccctgtcgccctagcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccaggtgaccctcgagtggcccctgccaagccccgcaacatgggacttaggaaagcgttccccaccatttacccattcattctttccttccaataatatcctaatatgctggaatcctattccaggtgttagggatgaaaataatgataaaaataattgtcacgatcaccaccatcacgataatcattttgtatcgaccctgttccaaacactgttctaagcacttgacatttaatacacacagcaaccccataaattaggtactatttagtaccccattttaccagtgaggaaatggaagcccagataggtggtgtcatctgcccaagatcacatatacctgggtgttggagctgaaattcgaatccaggcaatcttgatccagtatagagacaaatagacaaaggtgtgccttttaggagcttacattgtggtgaggaagacagataataaatacataaatatgtaaagaagacatgtatggaaaaaggaccagttctagttagagaagtttaaaaagctatgcagggccaggtgaagtggcctgtaaacccagcactttgcgaggctgagatgggaggaacactaaggccaggagtttgagaccagcctggccaacataatgagaccttaaataaatttaaaaaattagccaggcatggtggtgcatgcctgtggtcccagctactcaggaggctgaggcaggaggatcacttgagcccagcagtgtgaggctgccgtgagctatgatcatgccactgcactccagcctagacaacagtgagaccatgacttaaaagaaaaaaaaagctacccagaaaaatacagattatgataaaacaagtaatagggatataaaatgtcagttggtggtgttgagattttagatatggtggtcagaagagggctgtctgggaagttgatggctgaatgacatacaaagatgaagagagaatgcattccaggcagggggcacagcagatgcaaagtccctgagatagaaatgagcttggcctgttggaaatacaggaggaagagcagagtggctagagaatgggaggcaacgggagacatggaggagctgaggctcaggggatggaaggggctaggtgatctgtgatgagtagtttggattttattctgtctgagatggggagaggttgcaacattttatcaaggggaggtgcatacaagtttagaaagatagatccctttggctgggcatggcggctcatgcccataatcccagcactttgggaggctgaggcaagaggattacctgagtttaggagttcgagcccagcttggccaacatggtgaaaccccgtctctactaaaaatacagaaattaactgggcttcatggtgcacgcctgtaatcccagcgactcaggaggctgaggcaggagaatgtgagccgagaccacaccactgcactccagcctgggtaatagatagagactctgtctcaaaaaaaaaaaaaaaaaaaaaaaaagtgaccgggcttggtggctcatgcctgtaatcccagcactctgagaggctgaggtgggtggatcacctgaggtcaggagttcgagacaagcctgacaaacatggagaaaccctatctctactaaaaataccaaattagctgggcctggtggcacatgcctgtaatcccagctactagggaggccaaggcaggagaatcgcttgaacctgggaggtggaggttgcggtgagctgagatcacaccattgcactccagcctgggcaacaagagtgaaactccatctaaaaaaaacaaaaacaaaacaaaaaaaaaaacaaagaaagatccctctgggttggaggtgttcaccaacattgggagctgagagcccagggaggaggatagagttggaccagggtgggactatggggaagcaacaaggggcaggtggggaagacactcagggagtggagtggacaggccttacgggaggggagagggagagggtgtccaggggaagactcagagctctggcctggggactagaggatgatggggctgccctgagacagggacagggagaaggagcaggtttgaggaacaccctgaggccagtttgagatgggtccagtggttatgggtccaggacattggagttggggatgttccaggtagatggaacagccagtgctaaaggaccaaggagggaggatgcttgtgattcaggaaaaaggccagcaggtatggagtggagtgagctgttgaagatgaggtcatcaacttactgatgggagatcatgggaacttttacttttaccttgaatgaaacagagatacggagggtgttgaaaagaggagcaaggatctgatttgagtgttcgcagggtccctctctctgccatgtggagaacacactgtggatgcaggagtggggagatcagcatgaaggccaccgcactagcctaggcaggagacggcagtgccttagaccaggaaagtggcccagatgctcagtttggaggctttcttggaaacagagaccgaagtcctaactgatcccctaattgtggatgtcctggccctcaggaattatcctcacactcctggacccccacccccagccagaagctgcctcccccatctcctctgtcacctgccaccttctctggtagcagatggtgagtggggggcattcgaagcctcaagctctccaggccctggtagccattttttgtatcttcacagattcaagtcatcaaaattgagactgaggacaacagagagacacgctcagccaaggatgctctgctcttgtggtgtcagatgaagacagctgggtaagcacccccaccaccttccttaggaggttaggcaagtggtcccctaacctctgcaattccttcccagacaagagctcaaggggcagcccatgtcctcagggtcaaaaagttacatctgaaactaaccagctggtaaataaaatatgtccacttctccagccttgactaataatccttcctaacatgctagaaggccaggttcaaatttattttgaacttgctctgtcacccaggctggagtgcagtggcatgcactgaatagctcactgaagccttgatctcctaggttccagtgatcctccctcctcagcctcccaagtagctgggactactgcaccccacccagtttcaaatgtagaactcttggcctcactaggcacagtgtctcatgcctgtcactttgggagaatgaggctaggactttgagatcagcctaggcaacatagcaagaccccatctctacaaaaagtggtggggttttttttgttgttgttgtcgttgttgtttttaatcacaggcatggtggcagacgtctgtagtcgtagcttctcaggttcccaggaggctgagatgggaggatcatttgagtccaggagttcaaggtgcagtgagctacgatcatgccactgcactccagcctgggctacagagcaagaccctgtcttgaaaataaataacaaacacataaataaataaacaaacaaataaataaaaataaaatagaactcttggactcctcagagaccaatgctggaaagaggtgaactgtccccagcctgctctcttctctctctcccccatcccatttcatcctacatttcaagagatctcacattcacctgtgtggaccctcagtgctatgtccaagctctggccaccctctcccgctgtgagcatctcccttctgcctcacagggcatacacaggaaagttcaaagtccttggtcgcttcagtgtggctgagctggtggcggggtggggtgcaggctctactgggaaggttccctttggcccccaactctctgccctgcagggagcagtaagacctgaaactcaattgtcctctgtagagcagctcctgggaggacggagggaggggcaggtgtgggatggaggtgggcttctctgactctcatccttctggctgtctgtcttgcaaaggagatcatggggacttttgccatctgtttctccatgtgtctatctctatatctgcttttccttgtacttatctcttctctcctccctccttccctcctttcctccttcccttttctcttcatgtcttctttctctctcctctcctttccctccccatctctgtctatatcttgctctctccctgtcttgatacctctctccttcctctctctctccttccctctcttctctcttctttcttttgcttctctttttctcttctctcctgctatctatcttctatcaatctatatatctatcatctatcaacctatatctattatgtatgtatgtatctatctatctatcttctatcaatctatatatatatcatctatcaacctatatctattatctgtctatcatctatcaatctatctatcacctatttatcatctatctatgtatctacctatctctctctctactcaccatctatcacctgtctatcatctatctgtgtatctacctatctctctctctacctacccaacacccacccatccatccatctttctatgttctaccccctctctctcatcttccttccctatcattcggtctccctctgtctttttcccctttcttccctcctaactctccccatctctgcctctgtttctcccttcacccttccagttaccctgaggtaaacatccagaatttcaccaccagctggcgggatggcttggccttcaatgccctcattcaccggcacaggtaccacctggcctgggacagcccagtcctgcccttcagccccccatatccctgcagctgcacacctgtacatgtacttgtgtagatggcacacacagacataaagacccatcccttcacctctacacacacatacagttttctttcccttcacacacatgccctgcacatttacacacaggaacacacacccacacaggctcctgtccaggccacataccctgtgcacacatggacacacatgagccctcgcacagatgcatacacacacacagatacccacgcacgtgcacagcctgcccgcagggtaggaagctcgctcccctgtcactgtcatgctgctgtgtacccagcacctcctcctatcagaaaatgctttctcaggccaggcgcagtggctcacacttgtaatccctgcactttgggaggccaaggtgggaggatcacctgatgttaggagttcaagaccagcctggccaacatggcaaaaccccatctctactaaaaataaaaataaaaaattagccaggtgtggtggtgcgcccctgtagtcccagctactggggaggctgaggcaggagaatcgcttgaacccaggaggcggaggttgcaatgagccgagattgtgccactgcactccagcctgggcaacagagtgagactccacccctaacccccccaccaccaccaaaaaaaagaaaagaaaagaaaacacttcctcaaagtgagcccttagagtccccgtccctgtacacccacggattcataccttggggcctgacattgaaatagctgagggtcagacacccacacaaattagacacacatcatgatcattcgcatgacatattggggaaactgagactcaggcgcaggaaggggcttgtggtggtgtagctgaagccagaacccagctttttctgctgtggacacctgtccactcacaatccctgcttctcacacctacacacactcgtacacacatggggagacccagacccacctccatacacagaaactcacaagctgcaccagggtcatcctcacactaggtgacattcgctcagtgttttctatgcacaggcactgttctaagggcttcccactaaaacattcaatagtcaatgtatccattcagtgtgtccgatccacctatgggcaggtgctatttttatttatttatttattttgagggtgagtctcactctgtcccccaggctagagtgcagtggcacgatctcggctcactgcaacctctgcttcccagattcaagtgattctcctgcctcagcgtcctgagtagctaggattacaggcgcccgccaccacacctggataattgttgtatttttagtagagatgaggtttcaccatgttggccaggctggtcttgaactcctgacctcaggtgatccacccacctcggcctcccaagtagctgggattacaggcatgtgccaccacgcccggctaattttgtttgtttagtggagatggggtttcaccatttgggccaggctggtttcaaactcctgacctcaagtgatctgcccaactcagcttcccaaagtgctgggattacagggatgagccaccatgcccggctggcaggtgctattattatccccattttagaggaaaccaaagcacagagaaacgcagtagctcacctagagtgacacaaccaggatatgaccaagctggggctcaagctctgatgaactggctctggtcctcacacttctaaccactgcataacactacataagaatccccaaagtaagcatatgtgtgtcagaggtacatgtgtcctggccagacgcagtggctcacacctgtaatccctgcactttgggaggcctaggcaggcagatcacttgaggtcaggagttcgagaccagcctggccaacatggtgaaaccccgtctctactaaaaatataaaaattagcagggcctggtggtgcacacctgcaatcccagctacttgggaggctgaggcaggagaattgcttgaacctcggaggcggaggttgcagtgagctgggatcgcgcccctgcactccagcctgggtgacagagcgagactccatctcaaaaaaaaaaaaaaaaaaaaaaagaggtacatgtgtcctcacacaacacacataagggctgtacacactcgtattgtcatatgatttcacagagacatacacaggcaggcaccgtgtgggctcatctcttccaagcacactcaggctggcctacccattcgtctgtgtgcacaggccggcccagcaacaaatgcacatgcacacacacattcccgggaacgcacagagacatgcccgcgtccatcacactcacatcacagctaaatgctgcacagcacacacagcttgccccttggctagactgtgcccttctgcccattgccctgggcagtgctcagacaagggtggcttcttccctgcttgcccgccggctctggagcctgcctgctgcctgcctgctctgtgcccctgcccaggcctgatctcgtggacttcagcaaactcaccaagtccaatgccaactacaacctgcagagagccttccgcacagctgagcagcacctggggctggcgcggctgctggatcctgaaggtgagcctctcgcgggcccagcccagacttcgtcttgggggactcccaaccccaatgccatgtcacactcaactccatcccaccccagcaccatcccaaatcctgaggcctctccaaatcccaactctttccaaatcccaactgtctcctcagcctcctccccttgtgcctccccttcctcatgtgcgatccctcccacataccatcctcacacctcttcctctctcatccccaaccgtgtcccaacgtaacccctcctcttccccattctcaatttccacccatccccaacaccctccccaaccctgctttcaaccatctcccactaaaccaactcccactcccctaccccagccccaaacccagtggcatctccaacgccatccccacccctaacgccaaccccatcttcaagtgtctccatccccaccacatcttcggctccaactccattcctatccccaccctaatccatttccaacctcatttcgccctagcccatccccatgtctatctctcccacaactccatcctcatcctcagctgcttttccatttccagtctatccctaatcccatccctgacttcagcctcagccccaaaccaggatcagccctgacacccgtctcccatcccaaattaaagctgctcccttcctctgagctctactgtgtgccagacacatgtctgggaaccttatcagagctgttcactttcatcttcacactgacctggttagagagaatttatcaaccctgttttattttattttatttatttatttatttatttatttatttatttatttatttatttttttagatggagtctcactctgtcgcccaggctggagtgcagtggcatgatctcggctcactgcaagctccacctcctgggttcacaccattctcctgcctcagcctcccaagtagcttggactacaggcgcccgccaccacgcccggctaattttttgtatttttagtagagacggggtttcaccgtgttagccaggatggtctcgatctcctgaccttatggtccacctccttggcctcccaaagtgctgggattacaggcatgagccaccatgcccggcctatttatttaatttttgagacggggtctggctctgttgcccaggctggagtgcagtgccatgatctcggctcacagcaacctccacctcacaggctcaagtgattctcccatctcagcctcccaagtagctgggactacaggcgtgcaccatcacacctggctaatttttgtatttttagtagaggtggggtttcatcatgttgcccaggctggtctcaaactcctgacctcaggtgatctgcccactttagcctcctaaagtgctggaattataggtgtgagccaccgtgcctggacgttttatttatttattgttcttatgttcatttatttatttatttgagacagagcctcgctctgtcactcagactggagtgcagtgggggcgatcctagctcactgcaacctccgcctcccgggttcaagtgattctcctgcctcagcttcccaagtaactgggactacaggtgcacgccaccaagcctggctaatttttttttttttttgtatttttagcagagacagggtttcaccattgttggccaggctagtctcaaactcctgacttcaagtgatctgcttgcctcgtcctcccaaagagctgggattacaggcgtgagccatcacacctggcttacttatttatttttttatccaactgaatttaatatttaaaccctgtttaattattattattatgtttgaaatggggtctcactgtgttgcccaggctggagtgcagtggcacaatcttggctcactacagcttcaacctcctgtgctcaagcaatcctctcacctcagcccccagagtagctggggctataggcgtgcacgaccatgctcagctaatttttgatttttttttttttggtagaggtggggtctcgctatgttgcccaggctggtctcaaactactggactcaagcgatcctcccaccttggcctcccagagtgcctgggattacaggcccgagccacatgcctggcttaacctgtcttccaaagtgatgagaatgacagctcagggatgttgtcacttgcccagcatcacactgaaaatcaggaaaccagaccttatggctccagaattcatggtcttaatcagtcctctaccctgcctcttatagctgtatcctgtgctcagtgcctggtacgtagtaggtgctaatggatgtcagttggacaaggcagtgaagaataaaggccaggtatactgttgtgcatccagtgggtaaattaaaatgatatcactcagtcatggtgatggcttgtgcctgtaatcccagcactttgggaggttaaggcaggaggatcgcttgaggccagaagttcaggaccagcctgggcaatgtagtgaaatcccatatctacaaacctgtagtcccagctacacaggaggccaaggcaggaggatcacttgagcccaggagttcgaggctgcagtgagctctgattacaacactgcaccccagatcccaactcaaaaagcaaaaaacaacaaccaattaaagtgatgttagaatttgttgagtttcccctctgtgccaggctagtctttctaatacttacattgttcccaggaggcaggaaccatgataatctttattataacaatggggaaactgaggcttagagaagctaggttattttctaaggacatgcagtgagtaagtgttgaactgggatccaagtgcatgctgcctccaaagcctatgttcttgacatcaagccttgtgcacaatttgcaagctaactaaattttaatttagcacctactgtgtgctgggtaagacagaacagtgataaagaagataggcatacggctgggcccacgcctatagtggcccacgcctatagtcccagcactatgggaagctgaggcaggagtattgtttcagcccaagagttcaagactagcctgggcaacacagagagaccctgtctatgttttataaaaaataaaaagtctatttaaaaaattacaaaaaattagccgggcgtggtggtgtgtgcctgtaatctcagctacttgggaggctgaggcatgagaattgcttgaacctgggaggcagaggttgtggtgggccaagatcacgccattgcactccagcctgggcaatagcttgagactgtctcaaaaaaaaagaaagaaaaagaaaagaaaggaaaggaaaggaaaggaaaagaaaggaaacaggcatagtgtttgtcctcatgaagctcaagctctagataatgacataatcacataagtgaatatgtaattacaaattgtgatacattctgggaaggacatcataagatgctaagaggagaataacatgaggattatcaactatagacagagtgaacatggaggcttgtctaaggaaatttgagttgagccaggcatggtggttcacacctttagttctgactactcaggaggctgaggtgggaggattgcttgaacctaggagctcgaggctgcagtgagctatgattgcaccactgcacaatcagcctggacaagagagccagactccatctcttgaaaaaaaaaaaagtaaaaagttgagctctgaagaataagtgggaattaggaacacagaagaggaacagtgctccagacagtgagaacagcacatgcaaaggccctgaggtggaaggtagaaaggtgtgttcaagaaacaaatataggccaggtgcggtggctcacatctgtaatcccagcactttgggaggccgaggtgggcggatcacctgaggtcagcagttcgagaccagcctgaccaacatggtgaagccctgtctctactgaaaatataaaattagccaggcatggtggtgcatgcccataaccccagctacttgggaggctgagacagaagaatcacttgaacctgggaggtagaggttgcagtgagttgagatcgtgccattgcactccagcctgggcaacaagagcaaaattccatcttaaaaaaaaaaagaaaagaaaaagaaaagtatagcttatttctctgcggtggtttatatgtgtcaggcactatttaattccaggaggtagatttctatttgacggatacaaaacctgaggaacagagaggttaattatcttgcccaaggtcacacagctagtgagagtggcttctccatccctccatccaataccttcaagcactctgtcaaagtgcccactgtcttgtttccccactccctcttgcttccagatgtgaacatggaggctccagatgagaagtccatcatcacctacgtggtctctttctaccactatttctccaagatgaaggctctggctgtggaggggaagcgtatcgggaaggtataaggagccaaggagtgggtgagtgggaagctggaagctggtggcaggcacgggtgggatgaggctgaccccccttcctctgctgtgtcaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagtgaggcccagctctggagggagggtgggcaggggtggcatgacggcagggctcctgagctcatgccccttcaggttccaggagaaggggaacctagaggtgctgctcttcagcatccagagcaaactgcgtgcctgcaaccgtcgcctctttgtgcctcgggagggctgtggcatctgggatattgacaaggtgaggccggggatgcaggggagaggcggggttgcactgtggagttgtataggttgcacactgctcaagggaatcattcacattgtagacatgatggattagatattcattctgacagtttttcagtagtaaagtgtcataaggaagcaatattttttccaatttgcatgaagttgccataatgctatgagtgacctcagactaagtcaagaccattaaactgtggggagctgtcagagtctgagtgcctcctcccatctcctgcaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggtacaaggtgtagggcttggctccagggtaaagggacggagggcggggctgatggtcctgggaccagagagggagacttgatcttctaggcaacagggaagagttagattagtctcctggtgataaatgaggatggggatgggagacttggccttccaagtgattgttgggtgaggggaatgggcctgatctccagggtaatgggagagtgaggctggtctccagggtaactagagagggcagaattcatcttttcaggaatgggggagtgttttaagtgacaagggaggttgtatcttgtgtctagggtaactcagaaggatagaattggtttcctaagtaacagagtcaggtaaacctggtccctaatctccaggacaggggaagcatgggcctccttcctgggtaacaagtttaaggttagagatgtaacaggagggtgggacttgtttccagggtaactggagagagtggggctggtctctggggaaacgggaaggtggggttggtctctagggcaacaggggagggtgggtctggtctccagggtaactggggaagattgggctggtctccaggacaacaggggagggtggagctggtctccaggataactgtggaagatgggctggtctccagggcaacaggggatggggggttggtctttagggtaactggggagggtggggctggtctccaaggtaacaatggagggtggggctggtctccaggttacctgggtaacaggggaggatgaggctggtctccaggataactagggagggcagggccagtctccaaggtaatggagtggggagtccccagggtcacacagggtcaaggtaacaggtggactgctgaggcagcatgggtgagtgtctggctcactgccccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggtgccggcgggggggcggggatgcgggtggagtgccaggagggaggggaggatgcagacgctgaaagagttgtcagacagctggagatggagagggaagggcagagatagaagaagatagagagaaagccagggagacaaaaagagagaacaagagagagagggagagaaagatacagagatggacaagagaggcagacaaagaaacacagaatgagaaagagacagagacaaatagagagaaatagaaacatgctggacacggtggctcacacctgtaataccagcactttgggaggccaaggagggcagatcacttgaggtcagcagtttcagaccagcctggccaacatggtgaaaccccatctctactaaaaatacaaaacaattagccgggcgtagtggcgggcgcctgtagtcccagctacttgggaggctgaggcaggagaatggcgtgaacccgggaggcggagcttgcagggagccgagatcccgccactgcactccagcctgggcgacagagcgagactccgtctcaaaaaaaaaaacaaaaaaaacaaaaaacaattagctgggcgtggtggcgtgtgcctgtagtcctagctatttgggaggctgaggctcaagaattgcttgaatccaggaggcagaggctgcagtaagccaaggtggtgccactgcactccatccagcctgagtgacagagtttgattctgtttcaaaaaaaaagagagaaatgaaaaaagacatagagatatagaaacagagtaaaccagggatgcagacagagagatagtgacagtttgagagagaggaaatcagagagacagagagaggagaaggcagacacaaaggtgacatggaaatctacatgactacagagaaagatacaggaagatggaatcaatttaagagagagagagagagacctaccagatctagagagagatgagacaagaaagatagaagccagctgggcatggtggctctcacctgcggtaccagcactttgggaggccgaggtaggcagattgcttgagccccagagtttgagaccagcctgatcaacatagtgagatcctgtctgtacaaaaaaaaaaaaaaaaaaaattagctaggcgtggtggtgtgcgcttgtagtcccagctactctgaagtgggaggatcgcttgagcccaggaggttgaggctgtgtgagccatgattgcaccactacacttcaacctggatgacagagtgagaccctgtctcaaaaaaaaaaaaaaaaaaaaaagaagaagccgggcacggtggctcacacctgtaatcccagcactttgggaggctgaggcaggcagatcatctgaggtcaggagttcaagaccagcctggccaacatggcgaaaccccatctctactaaaaaatacaaaaattagccgggcgaagtacatctaatcgggaggcaggagaatcacttgaacctgggaggtggagtttgcagtgagctgagatcgcgccactgcactccagcctgggtgacagaggcagactctgtctcaaaaaaagaagaagaaaaaagaatgaaagggaggaaggaaggaaggaaggaaggaaggaaggaaggaaggaaggaaggaaggaagaaagaaaggtgaacaggagacacagacaggaaggtgaacaggagatggagagaaagagaaaagggtagaaatgtagaaagagaggcagagaaagatggagacaaagatgtatagataagaaagacatggaggcagagagtgagccactgtgacagagacagagcccagaaatgtggagtccacgagagatggaaacattcagagagagactggtagagagagagggagacagagacagaacaccatggctagctgtgagagctgacagcagctggggctcagcttttttctttctgatgaggaaaccgaggtccaggccacagagctggtaagagagtcttgaggctggtccatatctctccaagagggtcagagtcgggagtgatggtgcagagtagcaggggctggcataggcaatgggggagaggtgagtggcccagggcagtgccagaggtgtgctcagtgctgtccccgcttgtaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggtgagtcttggggctggggctggggctatgggtggagactgtcaggactggtgctaatagaggcaagagtgactcctgagagaaggaaagagtgagctccttgtccttggaggcatttaagcagagcctaagattacattccactggggaagtcatagggagaatcagtgccctgagtggcaggatgggccactcgacctcttcctgctttagattctgcagtaataacccacatttattgagcacttgttatgtgccaagcccttcacagattgatctcaacgaataccatttaaaaagacttgtgtgggctgggcacggtggctcatgcctataattccagcccttttggaggccgaggcaggaggatcacttgagcccaggaattcaagaccagcctggccaacatagaaagacatcatctgtaccaaaataaataaataaataaattagccaggcacggtgatacaagcctgtagtgccagctatttggaggctgaggcaggaggctcacttgaggccaggaattggaggcttcagtgagccatgatcatgccactacactccagcctgggtgacacagtgagatcttgtctcttaaaaaaccaaaaagaaaacttgtgctaagtaatgttaatcagggcctatttaacacaagtgatagaaactcagttcaaatggcttaaggtgaaaaggagtggattggctaatgtaaccaaaatgttcagggaagcctagtcaacatggcgaaaccccgtctctaccaaaaatacaaaaaattaggtaggcatggtggtgcacgcctgtagtcccagccactgcagaggctgaggtgggagaatcacctgagcctgggaagtcgaggctgcagtaagccaagattgtgccactaaactccagcctgggcaactggactgagaccctgtcagcaaaaaaataaaataaaaaaaaaaaaagtctggggaagggtgggttttacctcaggcatggctggatccaggtatggctcaagggtgcttttaggactccatctgagaccaggcatggtgtctcatgcctgtaattccagagctttgggaggcaaagatgtgaggattgcttgaggccaggagttttgggcaacatagtgagaccccatctctatatcaaaaaagaaaaaaaaaagaaaaagactcaggccaggcacggtggctcatgcttgtaatcctaacactttggaaggccgaggcaggcggatcacttgaggtcaggctttggccaacatggtgaaactccgtctcttctaaaaatacaaaaaaattagccggacatagtggtgcacacctgtaatcctagttactcaggaggctgaggtgggaggattgcttgaacccaggaggcagaggttgccatgagccgagatcgcaccactgcacactccagcctaggtgacagagcgagactccttctcaaaacaaaaacaaaagactccatctctctcgtctctctccatcactagtctttgtgttagtgtcactgttgagcagtcctgtcccttgtggtataaatctgggatcattcagccccaggtatacagcctaacaggttagcagagccaatgggacccaggcccctttctcccaagagttctgacaaaaagtcctaggagagcttgcattggctcacagtgggttccatcattgctcagccaatcattgtggccccagggcatgcagtgatctaatcggccacatgcatgtgacctgcctaccccagggccaggagtggggtcagcccattacaaaggcttagactgaaaaagaggagagagggacggccttaccagatatggatgggacatggatgctgataggcaaaaccaagactggctctaataaggttcctgtcttacttatgtcaatgccctccagccagagaccaccaggagtccctctgtggtcaaacgaagttgggtttggtggctctttacacccaccatggggagctgtggggcttctcagcaagaaagtatgatggggggctaggcgcggtggctcacgcctgtaatcccagcactttgagaggccaaggtaggtggatcacatgaggtcaggagttcgagaccagcctggccaacatggtgaaaccccatccctactaaaaatacaaaaaattaatttggtgtggtggcatgagcctgtaatcccagcaacccagaaggctgaggcaggagaatcgcttgaatctgggaggcggaggttgcagtgagcctagatcgtgccactgcacaccagcctgggcaacagagcgagacctcatctcaaagaaatatatatatatatatgactggtggcttattgtaggatttgggcttgtgttaggtgatttggaagatgattcagtgtagtgagttttgctgtggattggatgctgtcagaatatgggggtgactaggtgattgggggtcttaatcattttgatctaggtggtgggaggaagagaaggaggctgttgcattcattggcagctgtcattcatctgagccggcgaggggatgcgtggtcatttttgtggtttgcacagtgaccttgattttgtctgtgctcaggcaagattatggagcgagcttggttttgtcctactccatcgcggtcagagtggccccatctgatatgagcgttctgtgagttttttttattattattgttgttgtttattgctttttttttttttttttttagacacttgatctctctatgttacccaggctggtcttgaactcctgggctcaagcaatcctcccgcttccacctcccagagtgttgggattacagacgtgagccattgtccctggccatttctgtgagattattatttttacttatttatttatttttgagatggagttttgctcttgttgtccaggccagattgcaatggcgcgatctcggctcactgcaacctctgcctcctgggttcaagcgattcttctgcctcagcctcccgagtagctgggattataggcatgcgccaccatgtccggctaattttgtatttttagtagagactgggtttctccatgttggtcaggctggtctcaaactcttgacctcaggtgatctgcccgctttgtcttcccaaagtgctgggattacaggtgtgaggcactgcgcttggcctgtgagattatttatactcctcagaacacgatggctagccctgagtgctgacggcagttggggctgctttatttctttctcactgatgaggaaactgaggcccaggccatggagctgataagagggtcttgaggctggtccgtatctctccattaagatgttctcctcctttatctggagcccacagccctttggaatcttggagcattattcgaaaaggaagaacctgtctggcttgcaggttgatggggaagtttctcaccctagccgacctgggtcacatcctaaatgcaaatgctgaagtttccctccacgccctggtgtggacatcctgaccctggctcagctccctcccatccccatctcacctccaggggaggttgttgggaccctctccttcaccttagctaggtttgtctcaggaagctccctttgccctcgccttgtgaattctcggctcctgtgacaatcagcagctccgagaatacagcagaggggccagtgtggggagtgcgagtgtggggagtgcgttgtcatggggatgggaggcagcgcttcctgatgggtggtccagagtgtgagctcctgatgggccacttcttagctgatcctagggcaatccttcccctctctgaggctcagtctcttaatctggaaaatggggctgataaggacactggcctcataggatggttgtgagaatcaaatgacattgtgtcagagtaagggctgggtacatggaagctgttttttttttgttgttgttgttttgttttctaagacagagtctcactctgttgcccaggctggagtacggtggcactatctcggctcactgcagcatcaacatccctggctcaagtgatcttcccacttcagcctcccgagtagctgagactacaggtgcacgccaccatgcccagctaatttttgtatttttggtagagatggggttttgccgtgttacccaggctggtctcaaactgctgacctcaagtgatctgcctgcttcggcctcccaaagttaggattacaggtgtaagccactgcgcctagcaagaagctgttgttattgtaactattattcagttggataccttgtggtttgagtcaacatcagcgaatgtccagaattacagaaatcccgcattccacatagggcagtgtctcacttttatgatccagtaagaaatacacagccaggcagtggctcacgcctgtaatcccagtactttgggaggccaaggtgggtgaatttcttcagcccagatattggagaccagccagcgagactctatttctacaagaaacttagaaaaaaaattagccaggcatggtgttgtgggcccatagtcccagctactcaggaagctgaggcgggaggattacttgagcccaggagttggaggctgcagtgagccatgatcatgccactgcactccagcctgggtgatagagtgataccctatctctaaaataaataaataaataaataaacacacttacctcatgactcacagttcacatgcatacatgggcacacaggctaacacagaggttttataaaacaatacttccaggctgggcgcggtggctcaggcctgtaatcccagcattttaggaggctgaggggggcggatcatgaggtcaggagttcgagaccagtctggccaacatagcgaaaccccatctctactaaaaatacaaaaaaaaattagctggacatggtggcacgcgcctgtaatcccaactactctggaggctgaggcaggagaatcacatcaacctgggaggtggaggctgcagtgagctgagatcaagccattgcactccagcccaggcgacagtgagagactctgtctcaatcaaacaaacaaacaataccaaacaacaacagcaacaacaacaaaaatactcccccgaccttgttttgcattgtgatattttccgttccttctattctattccaccaaacaaatgctggctgtgacccattaaattaacttcactgttttctagtcgccaactagccatccaggaggaaggtgaactatttaaggaaaaagagggagttcggggttaagcacagtggctcatgcctataatcccaacacttcgggaggccaagtggaaggattgcttgaggccagccgttcaagaccagcctggccaacatagtgagatcctgtctctattttaaaaagaaaaaggagtgcagataaccactgggattgatagataatgcaacagaggatgacagagggaacctagaaacatggtttaagaaaagagaagttggccggtggcagtggctcatgcctgtaatcccagcagtttaggaggccaaggcgggtggatcactggaggtcaggagtttgagaccagcctggccagcatggtgaaaccccgtctctactaaaaatacaaaaatgagccaggcgtggtggcgggcgcctgtaatcctagctactggggaggctgaggcaggagaatcgcttaaacctggaggtggaggttgcagtgaaccgagatcgcgctactgcactccagcctgggcaacagagtaagaatctgtctcaaacacacaaacaaacaaaaaacaaagaagtttcatttgactcagttctgacataagcacaattttcactcaaatatacagaatctgagatgctctgaatccatccatcattcagtcaacaaatcactacattcactaggctacagctctgggctccaccctttgctgggcagtgtttgggatagggtgtgacagacccaggtcctgcccttaaggagctctcagtccagtgggggagacaggacaaggcaatgacaacacagagtagtcagggctaggatggggaagcagagaagcctgagagggtcgaggaggagcctgctccagccttggggtgtcagggaaggctgcctggaggaggagccacgtgacccggcatctgatgaagtcacaccaaggacagggtaggtagcccgcaccatcctctcttgggcgccccttggcttgtgaccaatcctggatgctccccttctcctggctcaggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccggtgagcgcgcacatgtgggactccggggtccccttcctcatgcacccagtctcaccttcattggctcaacagttcccatgtttgctcagctggaactaggagttccaatccctgcttcacccatagccagctttgtgacagttctgcaacctgcctaatcttcctgaacctcagcttgcccacctgtataatgggggtgatattagtccctacccaggcttgtgatgaacggtaaatgagttcatacatgcagaatacgaagcaaatgcctgggggtagaggaagcattcccccagcatttgctcttgttacccaggcttacattcgccaagcatgaaatcaacgacctatgcttctacagggacacctcagcctggcccctctgctgggaggcctcccattgcttctgcataaatgtcacctccctagctactaaaatagctctgactcttgtgattttccattgtttcatcctgttttacatttctttgtagcacttaccatcccatgacatattgtatactgacttgtctgttggctgacttagcaatgagttgttcaattagtgggtgaacaatgcctattccccctctgcaccactctgtctgagcatcttattcatccatacattcattcagcaggtgtttactgagtgcctatgcctttctaggtcttgtgctgggcactgctggaaacacagggctgctccttgcccctactgtgcctgcagttgcccagttctttgaaacattgatttaaagatgggaggaccatgtctagcttaaagtagacctcagtggctgccatgtggagggcaggttggagcgggtaagagttgtggctgggaacccagagaggcaactgggctggggacccagatggagcggaacaagattagaccagggcgggaggtaagtaaacaggccatggagactgatgggctggagcgattttccaaaacaaagcccagggctctggcctggcagatgacagtgctgtccccaacatgggggcccagaggaagaacaaatttgagtcaggtgggtgtgaatagccccaagaaggtatacagtaggctttgaggtcgaagacaggttcaaaaggtaagaggttgaggctggagactgaggtgtgactgtcatgagttcaggggcaaagaccaaggctgtggggctgggtggaatcattgaagaagggtgtgaaggaaaacccagagggctcagggtggagttgctgctgaggaatctcacatttaaacatcaggtagaggctgggcgtggtggctcacgcctgtaatcccagtactttgggaggccaaggcaggtggatcatataagatcaggagttggagaccagcctggctaacatggtgaaatcccgtttctactaaaaatagaaaagttagctgggcgtggtggcgcatgcttgtaatcccagctacatgggaggctgagacatgagaatcgcttgaatccgggaggcagaggttgcagtgagccacaatcgcgccactgcactccagcctgggtgacagagcgagactctgtctcaatacatacatacataaattaattaaattaaattaaataagttaaattaaattaaataaaataagcagcaagtagaagagaaggagcccacaaaggaggctgaaaagaagggtggattgagaattaggagtagaaccagtagaaggtatttcataaaaccaaggtccgcagggttcgggtgtctgagcatctccatcctcctgcagattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtaggagggcctggggctgggagtccctcccatccttcccttccacactcacacagccatggacagcaagatgtgcaatctcaaacccctggaatcataatggccacccgataaatcaacaaaatgttgaccaaaaatcataatccctgatactggtgatgacgtggtaaaattaaaacaacatttcagttggctgttcatttatttgtccagaaagaatgtattggatatctacaatctgccaggagtattcccaagcactttatatacctttctaaagtatcccaacattcttccgggcacagtggctcatactgtaatcccagcacttcaggaggctgagatgggtggatcacttgagctcatgaattcaagaccagcctgggcaacatggtgaaaccccgtctctctctctacgtgcgcgcacacacacacacacacacacacacacaaaatatatatatacacacacatatatatacacacatatatacgtatatatacacatatatacgtatatatacacatatatacgtatatatacacatatatacgtatatatacacacatatatgtatatatacacatatatatgtatatatatatacacactatatatatgtatatatatatacaaaatttagccaagcatggtggtgcacatttgtagtcccagctacatgggaggctgagttgggaggatgccttgagcccaggaggtagagattgcagtgagcagagattgtgccactgcactccagcctgggcaatagagccagaccttgtctcaaaaaaaaaaaaaaaaaaattcccaatatcccaatttccatagtaaagatcctagaattcagaactctctctctctctcttttgagacaggatcttgctctgttgcccaggttggaatacagtggcatgatcatggctcattgcagcctccaacacctaggctcaagcgatcctcccacctctgcctcctgaggaactgggactacaggtgcatatcaccatgcccagctaattaaaaaaaattttttttgtagagacagggtctcactgtgttggccatgctggtcttacaactcctgggctcggctgggcgtggtagctcacacctgtaatcccagcactttgggaggccaaggcaggtggatcacctgaggtcaggagttcgagaccagcctgaccaatatggtgaaaccccatctctactaaaaatacaaaaattatccgggcatggtggcatgtgcctgtagtcctagctactcaggaggctgaggcagaagaattgcttgaacccgggaggcagaggctacagtgagccaagatcacaccactgcactccagcctaggtgacagagcaagaatctataccaaaacagacaaacaaacaaacaaacaaacaaaaacctcctggcctcctcccaccttggccttccaaagagctgggattacagtgtaagctactgctcctagcccagaactctttaagataagtaacaaactaatatcagtacctctggaatactaccagcaattctcccagtgcaggtggggttcatagatgaagatacaagtccaaaaaggtgaactccttatccaagattactcagtctataagtaggagtcaaatacagttctggctgaatcctgagctgtagctgtttatctaatatatccagtcttcctggtaacactatgaggtggaaactaccccacattagagaggagaaaactggatctcagagaggcgaagatggaggcccaaggttacacagcaagttaggggatcaaaccgggctttgaagatggatatgtttgacttcaaagactgtgctctttttttttttttctttcttgagacagggtcttgctctttcgcccagactggagtgcagtggtacgatcatggctcactacagccttcaccgcccccgacccgagctcaagaaatcctcctgcctcagcctcttgagtagtgggactatggatgcacaccactgcacccggctaatttttgtattttttgtacagatggggtctcactctgttgcccagactggtctcgaactcctgggctcaagtgatcttctgccttggcctccgcaagtgctggaattacaggcatgagccactctgccccacccaaagactacgctcttgactctgtgctgcaagattccaatatccagggattttaaaacctctgtagccaagaccatcgcaaagcatccaggcctaaaaaaataactacaatcataacgatttacagcatgtagagagatctatatgccaagtgctttagccacatgatctcgttacacactcaatgaagtggactttattatccccattttccagatgaggaaactgaagatcagagaaggaaatgatttgcccaaggtcacatggcaaatctggccagagcagaacttgaactcgggtctgcctgatttcagagtcctaatctctgtcctcatggtgtgtccattctagagggggcagaaagacagttaaatacactaataaatggacaagatatttagagaatcataatggctttatgcaagaaacaggcagggcatggtggctcacgcctgtaatcctagcattttgggaggccgaggcaagcagatcacttgaggtcaggagtttgagaccagcctggccaatgtgatgaaaccccatctctattaaaaatataaaaactagccgggtgtggtggtgcacgcctgtaatcccagctacttgggaggctgaggcaggagaatcccatgaacctgggaggcggaggttgcagtgagctgagatcgtgccactgcactccagcctgggcaacagagcaagactctgtctaaaaaagaaaacaaaatttaaaaaacccaaactattgaggaccccaagagcttgttttagtgggtcatatctattgctatttactatattagaacttagtactgagaaaatttaaaatgtttttatttttatttatttattttgagacagggtctcattactctgtcacccaggctggagtgcagtggcacaatcatggctcactgcagcctcgacttcgcaggctccagcaatcctcccatctcagcctcccaagtagctgggaccataggtgtgcacccccacgcccagctaatttttgtattttaggagtctcaccatgttgcccaggctgctctccaactcctgagctcaagcgatccacctgcttccgtcttccaaagtgctgggattacaggtgtgaaccactgcacccggctgagaaatttgaaaacattatttaaaaataacaatacactgggagtggtgcgtgcctgttagacctgtgaggctgaggtgggaggaccgcttgagcctgcgaattggaggcttcagtgtgccataaacgagttcatgaatagccactgcgttctagcctgggcaacatagtgagatctcacgtcttaaaaaaatttttttaaatctaaatatctaacgtgttaatataacttttttattaaaaataacttttcataacacaaaatgtactaagagtggcattgtttcgtacctttgcaaatctctttaaagtctggtttaagagatggcagctgggcttctcttaaatcagagtcggcttctgctctcagtctctcctgccgcctctggaaaactccactgaacactcgggaaagaatgagagtgaaaaagcaaatggcgtcttaacacatttttatgaagatagttttgtcctctatcagattacatgttgagaatggctgccctaagcaaaagtgctgcgtagggttccattttacaccggcagaaactggagaaactttctgaggtcacacagtggctgggtggcttgggcctggattctaccctgggtcggcgggccctccgcgcccaagaggagtccctgtcctcctcaagtcactctctttcccctgggcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggtgcccactcggggtgtacatttcggagagggagagtccgaggccgcggggggattgcagggacagggacatgcgggggtggggaggagggtgtttcctgggaccactgggttctgaggtgggtgggaggtgagagagtatccggaatggataactgagtttgtggaacatccagtgtgtgtggaagtgtgtatgtaacagaatttgaggagtatcatcagtggggtaggttggtgtcttatcggaggtgacagtttgtgggctatcccgagtaagtaatgcacgaggatatttattggagtggcttcctgggttcgtggattatctgaaaggaaataagactatgaggttgattggcgatggttaaatggggttcaaagaagatcttggtatggataacaaaggattaggattatggaggtaggtaacaggctgaggggttattggagtcagtcagtgattgtggattacatggtgtggatggctaaattagcacaatatcttcatttctgggaatgacaactatggattctctggagagagtaactgtgtctgtggcatgaggaaccaagtgcagtggttatctggggacagccaatccagttgggagatcactctgggatgggaaccaagtttgagaattttggcaagatggaacagccagttttcagattgtccagtgtttggggatcatgttagaaagggtgcctgcctgtactggttatataagggatgctgacccagtttgaggattatctacagcagtggtccccaatcttttttttttttctttagatagagtcttgctctgtagctaggctggagggcagtggcgtgatctcagctcactgaaacctcagcctcccgggttcaaacgattctcctgcctcagcctcccaagtagctgggactacaggcgcgagccaccatgaccagctaatttttgtatttttagtagagatggggtttcaccatgttggccaggatggttttgatctcttgacctcatgatccgcctgcctcggcctcccaaagtgttgggattacagacatgagccactgcaccaggcccagtccctaatctttttggcaccaaggactggttttctggaagacaattttttccacaaaccggtgggaaaaggaggaatgttttcaggatgattcaagcgaattacatttattgtgtgctttatttctattgttattacattataacatataatgaaataattataaaactcactataatgtagaatcagtgggagtcctgagcttgttttcctgcaactagacgttcccatctagtgacatctaggggtgatgggaggcagcgacagatcatcgggcattagattctcataaggagtgtgcaacctggatcccccacatgcgcagttcacaatagggtttgtgttcctatgagaatgtaaagctgctgctgatctgacaggaggcagagctcaggcagtaatgctcactcgccccccctccacctcctgctatgcggcccagtttttaacaggcgatggactagtacccctctgtggcccagggcttgggaaatcctgatctagggagtggaggagaaaggacagagagcccctgaatcataagattactaaatatggagctgaagtggccttgagagaccctttctgacccacccatttaaaaaatagagacaggatcttgctatgctgcccaggctggtctccagctcctgggctcaaacagtccccctgctttggcctcccaaagtgctgggattgcaggtgtgagccaccatgcccggccctgacccactcattttactagttagaaaactaaccccagagggaaaagaacttccttgagttcacacagtacccagtttagttgtcttctttttttgagacaggacctcactctgtcacccgggccagagtacagtggcacgatcatgactcactgcagccttgatctatggggctcaagcaatcctcccacgtcagccctccaagtagctgggactacaggcacgtgccaccatgcctggttaattttttgtatttttagtagagatgggatttcaccatgttgcccaggctggtcttgaactcctggggtcaagtgatcctcccgcctctgcctcccaaagtgctgggattataggcatgagccaccgtgcccagccttcagtcttcatagtaaccaattttttttttttttttttttgagatggggtcttgctctgtcacccaggctggagtgcagtggcgtgatcttggctcactgcacctcctccgccttctgggttcaagcgattctcctgcctcagcctcctgagtagctgggataacaggtgtgtgccactacacccggctaatatttgtatttgtagtagagatgaggttcaccatgttggccaggctggtctcgaactcctgacctcaggtgatccacccacctcggcctcccaaagtgctgggattacaggcatgagccaccatgtccggcctaatattaaccaaatatttactgagtgcctcctctgtgctgggcgctattttggggctgagcacacctcaggcaacaaaatacaaaatcctgccctcatgtggttgacattctagtatgtaggggaggagagagtaaacaagtcaatgcatcgctaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtgaaaccccgtctctaccaaaaatacaaaaaaattagccgggcatggtggtatgcacctgtaatcccagatacttgggaggctgaggcgggagaatcacttgaacccaggaggtggaggttgcagtgagccgggattgcaccactgcatccagcctgggcaacagagtgagactccatctgctccctccctgccaaaaagaaataatacaggagggtagtgggatagggctggggtgggagttgataaatttggcaggttggtcagagacctgaagaaagtgaaggagccagccatgggggtatctggagggacagactcccaggcagaagcaccagcatgggcaacagccccgaggtgggaccacaactggaatgttctatgcttgcaaggttgcggggagtggtggcaagccaggctggcagcctctcccaggtcctggaatggaatgaggctgacctttgcaccacgctccctcctccccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagtaggtcccctagacccatccaccccagggagggggcagaagatggggcccagcataggggagtggtgtgggaggccagggtcccactcctttcatcacgatttctgcttctctggggctctttcctatttctatttaattccatgttgtcttagatttgatttaagtggatttttttttttgagacggggtctcactgtgttgcccaggctggagtgcagtagcacgatctcggctcactgcaaccctcacctcccaggttcaagtgattctcctgcctcagcctcccgagtagctggggctacaggcatgagccaccacgctggctaatttttgtatttttagtagagacacggtttcaccatgttggccagactggtcttgaactcttgaccacccaccttggcctcccaaagtgctgtgattagcggcatgagccactgcacctggccttaagtggatatattgtgaaaaggtaacctgaggctgtcaacccaaaagatacagaaggatatacaatgaaaggtttctttcttaagtctgccctgagcatgggatagctggtcctgttgttaaaatgttaggctgggtgcagtgactcatgcctgtaatcccagcacttcggtaggctgagacgggaggattgcttgtgctgaagagttccagaccagcctgggcaacatagtgagaccccttctctaaaattaaaaaaaaaaaaaaagctgggcgtggtgatgcgtgcctgtagtcccagctactcttgaggctgagatgggaggactgtttgagtccgggagattgaggcagcaatgaactgtgatcatatcactgcagtccagcctggatgacacagcaacattctgtcccccctccaaaaaaaaaatgtgttaacttacttccctagatgcctcattatccatcctgctcttctgcaccctccttgggaacccccagacctccccagatccagcagctagaggccaggcacaggtgtgttccagctttccagatgggacagtgtcccctgccaggctggttgtcaaatattttgcataagcacctcttcctggccccagccactctaggaagcatgcaaagtgagtgtctgcatgtctctgtgtctctctcatctcttgaacctcattgttctctgcttctgtcgccatctgtctcttgccaccactctcttgtctgtccttgcactaatcaagcgaagatatttattgagcatctactgtgtgccaggcactattgtaggtaggcactgaacaaaacaacaccaccacctccagccatcatgggaagtcctttctcatcttccagacccagttctgtctgtcattagagctgtttctgctcctcctggtgaccctaaatttctcctctcaggctctctggctctctccggcatgatccaggccagaaggggacccagtacccctccttctgtcttcccatctcctgacagaaagcatccctggtcacttcactgtgccacccccagccccaggaccgctaccccttttctgtttacggctcagacatcctttccctagatttatctggggcaaggcagcatgcttctaaaggaaacttttatgggaattctgttcttgaggatgcaaactcatcatttagtgcccccttttccatccaggcctggatccttcctttgttccactttttttttttttttttttgagacagggatcttactctgttgcccaggctggagtgcagtggtgcaatcatagctcactgcagcctggaactcctgggctcaaccaactctcctgcctcagcctcctgagtagctggactataggtgtgagccactgagcatggcctgttccacatttcttgagcacctgctgcatgccaggctcagcaaaacgaggaggaggagcccgggggactgttcattccatgattcattcattcattacttttcagtcattcattaattgctcctttcactctattgtttattcactcatcctccagtcaattaaacatgtactgagcccgtgctctgtacggagtgggggtgtgttcacagaaatgaccaggacagaacatgattcctgcctcacagagctcgaacgttatctgacaaggatggcccagaatgctcggggctgggatggaggaagtccaggcagaaaggtcagggcccggatgggagacgtgcagccgctgtgggagaggcagcatttgtcccaggcttgtggtgggtgaggtgtggtcacagagggattgagacggactaatctctgcaccttcccaccatcccagtcatttatttgtctagggacacatttcccaccctgtgggaggagtgggaggagtgggaggagtttccacatccgccaagggggcagagccatacagagctggggactggggccctggggccctgggggtcttagacctggcttcacccctgaatccgtgacattcagggcaagtcacttagagcttcagcttgcctggcccctcacctggaacctgtgtgtgaggtgctgttctttttttttttttttttttttttgagatggagtctcactctgtcacccaggcaggagtgtagtggcgcgatctcgcctcactgcaacctctgcctccagggttcaagctattctcctgcttcagcctcctgagtactgggatcacaggaaagagccaccatgtccaactaatttttgtatttttggtagagacagggttttgccatgttggccaggctggtctcaaactcctgacttcaagtgatccacctgcctcggctccccaaagtgctgggattacaggcgtgagccaccgcgccggccgctaggtgctgttcttatctgcgttttgcatgtgaggctcagaggggaaaactgacttgcccagagtcatggccaggaagtgccacagcctagatttgaaccctgttgctttcttttcttttcttttttttaaagacagggtcttgctttgttgcccaggctggagtgcagtggtgcgatcactgctcactgcagcctcaatctcctgggctcaaacaatcctcctgcctcagccttctgagtagctgggactaaaagcatgtgccaccttgctcggctaatttttcattctttttttgtagagatgaagtctcactatattgcccagggtggtttcaaactcctgggctcaagcaatcctcctactttggcctccccaaagtgctcggattacaggcgtgagccatcgtgcccggcctactctgttgttctttcaccctcatggagactcagggtcttcctcatctctaggactgatgcttgacagtttggctgctgaaggcctggaaagattgatttcagctcaatttcagaggcattttatctttcctggctcctaagctaagttgggcaggaggcagtcagtgcttcgcttgcttgtctcaggcccttcctgttccttctctctggttctgtctctgcaactgtctcctatacactctgtctctttgcttccatctatccatctatttctgtatctctgtttcctgctccctctctgtttttctctctgtttttctctccctccatctgcacctctctaaccctgtcttttctgcctctgtctttcacagatactgtacttttgtttctcccatcttttttctctctgccactgtgtttcttgcattcattcatttaacaaatataagtcgagcgtgtactgtatgccaagccctttttctaagcattggggacacatctatgaacaaaacagacaaaaatccctgccctcatggaaatgatatatcctagcatgggagacagccaagataaataagtaacatatagcacgtgttagattgcgttaagtgctaaggagaaaattaaagaagggaagaaagccagaaagtgttggggagtggtcaggagggacctcacgaagaaggtgatctttgagtagatgttgggggaaggagcattcccagcagagggaacggctagtgccaagggcctgaggcttgctcaaggcacagcgagaagggcagtacagttaccacagagtgagggggaagagtgcaaggagaataagagtttggaaaggtgggggtgtggggcctggtaggtcagaaaggcctctgagattggccgagtgcaggagctcactcccatcccagcactttgggaggccaaggcgggtggatcacttgaggtcaggagttcgagaccagcctggccaacatggcgaaaactcgtctctactaaaaatacaaaaattagccaggcctggtggtgggcgcctgtaatcccagctagttgggaggctgaggccggagaatcgcttgaacctggggggtggaggttgtagtgagccgagatcacgccactgcactccagcctgggcgatggagcgagactccatctcaaaaaaaaaaaaaaaaaaaaaggactctaaggactctcatggagaccctgggaggatctctaaggactctcatggagaccctgggaggatagtctcattctctctctctccctgggggagacagatagcaacaggacagggatgcatgggagcccatgtgggatgccccagccccatccaccaggcctcttgggcactttgccttgcactgtgggcaggaggccagactgcccggggcccatggtcccagccggctccagagtggtacggcctgggtccagcctggtcagttcagtcaggccaagggcctcgctctgcctgcaggagtgcccacttcagcttctctgcgactctgctgtcatctctccccacactctgctctcttccctctctccaactctgcggccccctggtctgtctgtcgtctgtggggctgtcttttcctggtggcatttgccactcctctgcctgtctctctctgggctgtccctgaccggactcctcctgtcactttccctctctctgcctcctctctttcgtcgtctgctgctccctgagtttctttctggctctgccttgctccatctcttttctcgtctttttttattctctctctcgctctctttctggtgtctcctctcactttctcgtttgttttgttttgtttttgtccctaggtatgtctgtctttacttctctgttatctttctctctggacttgcctttttttctctccgtctatatctctttctttctaagtgcctgtctctgcctctccctttctcttcctctgtctgtctctctctctgcccttcttcagccccgtccctgcgtccctggctttgccccactaattcctccctctctcttacatattttccacgcccttcttcccctacccagcccagtgccctcacagtcctactgccagcgccgcaccccccaacccagggcctttccccagcccttatctccccatccccaggaaccaagaaaaccagttacgggcccagcaatggatgcaaaagctacatgaccaacttgagctgcagcacttcctccgagactgccacgaggtaggaactccaggtgtgctggggacggagacatcccctttagtcgggagggaagtgcttctcggccgaggtgggggtggggacgccccgtctaagtgggtcgcggagcgatgctcgctctaagccgccagggggcgcgcggagccgggtctcagtgcgcatgctccgcaagtccctgcccgcccacgccgactccgggaaacgaaggaggggccccgggcgcccctggcaaccgcgcgtgtccgcgcctacgggtcccgcggggacgcgcgctgatctcacctttctctcctgagatttgtgagaatcgctctaccccaggagaggggcggggcgggcggtggggataagggccgagggccgtgggggggccagcggccctgcgccctcctgcagccagcgatggctctgaaccaagccctcgcccctttaaaggtgttcagtaatcaagccccttcccttagggatgatctgcacacattagggacgatctcccctaatccgagatggtccaggcccccttccttattagtgacggttcaggagacctgctgtcttcccctccttcccttgcattccatagaaacgattctagactttggccacattagagatggcctagtaaacattttcctaaaccctaaacagagataggcctggccctgagcccctccatctgtgtgacccaggatcatcccctcctccatcatcaccccgtacctaagtttcttccaaccaaagctggttcaggaaccaggtctaacccctaaacccctcagcctcaattaaagacgattcgaccctcccccctatgttgaacacccatgggagattgttctctccgcacacggaataaacaagggcctccataccgtgcccccctcccccataactggggtaggccgggacttgagccactggaggaaccccctgttccccctcgcccccactggagattgtgagatgttccaggtcgccctcccatatcccctgtccacatgtggtggccaggagcccgagcttcttcccattagagatggttcaggaggcccccacccagcccctcaccataatccccactcccttagtgaggcagtccaagccccaggcgctccctcccggcattagatttggtccaggagcaccccccatccctcatgagattgttctggatcaggcagcaatcatctgagatggcgcagaagccccccacccgaagccttggggcgagtggtggttcctcctgcacccccacctggggccccgcaaagaggcgggcagggaggcaggcagggggcgcacgcgggcgggcgcgcggccgccgcgcggggcgagggagggggcgcgcggccgccggagcctcagccttcgccgccgctgccgctgccgtcgcagttgaggggcgagcacccgcccgcccgctgcagggacgccccgccaacgccactgtcacttcaggtgtcgggggcgcccaggggagggggttggcgcgcacccccnnnnnnnnnnnnnnnnnnnnngtcatggcgtcccggtcccccacccttggggaggggcaaggacgccgggagctgtccgcggtgctggcgcgggcgggactgaggggccggcccccaagggaggggagcgaagcggggggacttctaagaccacttctagggtaatctggatttgccctaagggttcagggcgtctcagcctttcgagggggggctcttctccgggtaatggggcatctaagatttgccctggggttgggggtttctcaaccttttggggggtttctttcttgttttgggaggatctgtatcagccttggatgatggaggtgaatcacttttggggggctctgccttggaagatgaggggccttggattttctctgggtctagggggctctgactttgtggggcttttcctgggttgttggatagtctggttttgccctccatcatgaaggaatcacttttgagggggctttactttgaggatggggtaccatctctttaagggctctgctttcactgcgggctgtggttgccgttggactcttccctgcacgtcgggaacctgtgaattgagttggggggttcagcactggacttggttctagtgtgtgtatgaaggagtgtgatgctgtcctggacccctggggagcacatgctcaggggacatgggctggggtttggccggctggggatctgggatttgtccttggctatgactgcatttgcctcccgggaccgcggagctggagtccagtgtttgtttttttttttttttttttttttttttttgcaggagggaggagggaggatcttgtgactggagtggggaggagaaaggggaggagcaaactgtttcaggtgccaggtttggtcatgagtggggaagttctggcttggaggataagtctggttttttactggagggggttgggggaggctcaaaaagcagcctgtgattgatcctctctagtgccgtgagaggggcccactcttggtgcttgcgttttggatgactggttttgttggtgggtaggaggactagaactggctttagttgtaggggtgggggtgctggccgggcttgggaggtccgatctgatccacgatggagagtctgtggctagattttggggtagactggtttggagagccagaacacagctttgtttttcacatttggctggggttggctttggttgagggctagaactggtcatggtttggggatctatggtcttagagtcccagggctagaattggggagccctgtgggctcattaggggtgctagatctcgattatggaggatgggtctactccagattagagggttagtttagagagagctagagttggctttaattgggaggttgtttggggggtttatctggccatactggaggaactggggctagatatgggggcttcatttgatacccttgggaatgggttgaggctcttgaattggtccttattggggggtggctaagattgaatgaagtgtctaagtgttgctatgggaggggtggtcctggggatgaattgggagttagctaaattgggttggagagcttgttttgggggggtgatctgtccccaagtctaagaggctgactggccctgccttgggggcttgtggggagttgaggagggcttccctcaggacaggggacaggggagcaaaggattgggcattctggggacccttccatccatcctctatccaggaaagagcttgagctgcacccacccccaatataaaggcctcacttgcaaaggttttttcatcctttcctattccttccacccatacaccctagcagcccaggccctgaacctgggacttcctgaagggatggggggctgtggcaggttgaggggaccagctgagccctcctgccctgttctgcacagctggatggctggatccatgagaagatgctgatggcgcgggatagcacgcgggaggacaaccacaagctgcataagagatggctccggcaccaggcattcatggccgagctggctcagaataaggagtggctggagaagatcgagcgggtgaggaagctgatggcccctctgcctgtgccaggtgcaggaggcctccagggagcccacgtctcacctgctgcacccgctgctgccatcctgctggtcttacacctctggactgactcaaatcagctccagatctgctcctagctatgtggctttgagtgattcatgtaacatctttgagcctcaatttgctcatctgtaaagtggccagcatctcttctgaatggtgcctgtatcctactgtttgttaaatatttcacttcttaatataacctcctctaccaggttccttccataccatttggggcatttaagatggaaggttggggagatgggctgggacagaccctgggaagcccagggttaaagtaaactttggattcttagagccctgggttctaactgtgtctatgcctgttaccagctgtggggccttaggtaattgtgttaacctcttggagcctcagtttgctgttctataaaattaaggaaataataaatatagctacttcctgggctctgtgcacataaagtacttaacacaaggccacgcacctaagagctgtaattactgtggtcttgttacttttaatacttaatgttacctaagtagctctgggccactaagaaccttgacttcagtcttggagggactgaggtagatatttgctctaagcctcaaccctcagaacttccccctcctctggctgaacccctagacctgtagccctggatatacacacttttctgactcacacagagacacccatgttggccttaaacccttaaatggtcattgatgtttcataaatggtggcatatggcgaaggcagtcttcttgactttgagtttaatggaagttcattctctccctgcctctctggctccctctatctttctttcctgtctgtctatccctctatccttgtctttcttacggtcctctccccatgtttctgattttctgtgcctgtctctctgttgatcactctgtgactgtttgtctctccctgactccttcccatgtctctgtgtccatctgtctctccctgtatctttctgtctccctcccctcacttctgtctgtctgtctctctcttcttgtctctcttccttggttccttccatttctgggcctatctctgcatccacccctcatgtctctctctccctatgtgtctcccactccctgcctctgattctcttttcacatccttccctgtgtcctgtcactctcccacacttctctgattctccccaccatctatctatcttctccatctcctgccatccacccacttggggcaggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcaggtatggtcttcctggcccagatgagggctccctatgccacatgggggccaggtcagggtccaaccccactcaaggtatgtcaagtggaggggatttaatacagggatttatttcaaacttgtagaagatgagaaagggaatattgaagcaatccagctagtaataactgttggaagcagccaccactccctaaggtatggagtacaaagggaaaaggaaggatctagagccacaaagcagtaggtaaatgactagcatgctaaaggtttcacaggaccctgacactcatttcctggatggagaaaccaaggctcaggggtatgggaatggctttgcatggaataacaatgacattcattgagcatttctctaccagtctctgggccaagcactcactgaactcatcccagccacttctggagattggtactgttattatcctgttttaccaatggggaaactgaggcacagaaagtaaggcacctggcccaaggacacacagctaaccagtgtctcctttatgaaacagggcactcttagagaacagacgcagcgtctgctttgtatctgctcccagcttggcagctccatgcttggtacacagcagttcacgtggaatgaccagaggtgaacgtagccattgcttctcacctcccagggagtaatggctcctgcctttgattttctttttttgttgctgttgttgatgttgttgtttgtttttttcttcaagatagttactcactctgtcgcccaagctggagtacagtggcttgatctcagtccattgcagcctcaaactcttgggctcaagtgattctcccacttcagccttccaagtagctgagaccacaagcgcataccaccacgtctggataatctttttaaattttttatagagacagggtctcaccatattgcctagggtagtctcaaactcttgggctcaagcaaccctcccgcctcagccttccaaagtgcttggattacaggtgtgagccatggtatctggcccacgtgactcctgcttttacctgtcaggaacaatgcctgactgactgatgggaaactgaggttccaggaggtgagaggtgaacttacttgtccagagtagcaaatagcaaagcctggatttcagtccagtgcccttgactcttcactcctcctttttgatatatttcctatgtagttatatagtgcttggcatagtgtatggcaaaaaaaaaaaaaaaggctagtaagaaatacataatgacactgattagtatgtattcattcatctctgtggcaaataattattaggtaccagctgggtgtggtggctcacgcctgtaaccccagcacttcgggaggccgaggcgggcggatcacgaggtcaacagttcgagaccagcctgaccaatgtggtcaaacctcatctctactaaaaacacacacaaaaaaattagctgggcatggtggtgcacgcctgtaatcctagctactcaggaggctgtaatcccagctactcaggaggctgaggcaggagaatcacttgaacggggaggcagaggttgcagtgagctgagattgcatcattgcactccagcctgggagacagagcgagactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttaaatagagatggggtttcaccatgttggccaggctggtctcgaactcctgaccacaggtgattcacccgccttggcctcccaaagtactaggattacaggtgtgagccactgtgcccggccaatgaggtcactacttaatatagaatagcagttctcaaatgtctgggtctccaggaccccccttacactcttaaaccgcattgagatccttagaaagctttgtctgtgtgggttagacctattgacattcactgtattaaaaatgaaaatcgaggccaggcataatggctcatgcctgtatcccagcactttgggaggccgaggcaggaggattgcttgagcctaggagtttgagactagcctgggtaacggagcaacagcctgtctctattttattttatttagttatttgagccaggatctcgctctgttagcaggctggactgcagtggtgcgatcacggctcactgcagcctcaacctctggggctcaagtgatgctcctccctcagtcccgcaagtagctgggactacggacccacaccaccatgcctgattgattttttttttaagaaacagaatctcactatgttggccagtctttatctctatttattgaactaaaaaaaaaaactaaaacggagtctggctctgccacctaggctggagtgcagtggcttgatctcagctcactgcagcctctgcctcctgggttcaagcagttctcctgcctcagtctctggagtagctgagattacaggcctgtgccaccaagcctggctaatttttgtatttttagtagagatggggtttcagcatgttgcccaggctggtctcgaactcgtggcctcaggtgatcggcctgccttggcctcccaaagtgctgggattacaggcatgagccatggcatccagactgtagttctctttcatgtctagaatagaagagagctagcttctcccatccgtgtctgtattcaatccatttcactagcacaggtcatcaggtctctgaaaaacactgctgcatgctggagagagaatgagaatggtgaaggcaaataacatcttagtatttttataaaaatagttgtaaccttgcagatgccttgaaaagatctcagggatcccccaggggttccttggccacagtttgagaactgctgatgtacacaatgtgctgggcactgttaactcctctctcctccccaacagccccatgagggaggtcctgttattatccccacccagcagaaaaccacagcacagaaaggatctgtggctcacagaggtcacatggctaccaagtggctattcaataccacctttagtccctccctgagcctctgtcctccctcttaaataggactctatcatcagtgcaggtctcccagggccaggtggggatgtgcacagaaaggagccacttagcacagtgcccaggatgtggtaagcctgcaagaaaggggcatctgactgtcagggtcccagccagaaacagaagcaggctcacctgcagaaaacttgagtttcttgacaaaggtgtgagtggagaacggggaagctgcaggaagcatatagggctgtgggactcatggaggggagcttttgctcctccctagccagagaaggtagagaaggaaaagttattggaacttggaaggggagagttgccagacaggagctggcactcttagtcaagaacggcagccatggccagacgcagtggctcacgcctgtaatcccagcactttgggaggccaaggcgggtggttcacttgagatcaggaattcaagaccaacctgggcaacatggcaaaaccccgtctctactaaaaatacaaaaattagccgaacgtggtggcacatgcctgtaatcccagctactcgggaggctggggcatgagaatcgcttgaacttgagaggcggaggttgcagtgaggcaagattgcaccactgcactccagcctgggtgacagagtgagactctgtctcaaaaaaaaaaaaaaagagaaagaaagaaagaacggcagccagaccatggcaccatagcagggaagagctggggagataataccccagactcactttcctctgggcttccctttgtcagccagggctggcttcatgggtgtttgcccgtgcagtgacacagggctccatgcttggtttaatgccctactattgatgtcttgaatttttttgtttttgaggcagtttctacctctgtcacccaggctgaagtgcaatggcgtgatcatggctcactgcagccttgaactcctggactcaagtgaacctgtcacctcagcctcctgagtagctgggactacaagcgtgtgccaccacgcccagataatttttgtagtattttatagagacgggggcctcactgtgttgcccaggctggtctcaaactcctggcctcaagtgatcctcctacgttagtctcccaaagtgctgggattacaggggtgaagcactgcccctggataaaattcttaataaatatttgaacaagggaccttgtgttttcattttgcactgaaaagtataagccatgtttgaggccaacccacatggaagccagaggacaggagggctggtccatgcaggtcagtcctgcacagggcagggtgaagaagcttggactatgggtctcaagatcccgggctgaagcatccatccacctcggcctcccaaagtgctgggattacaggcgtgagccactgccccagcctattgctaggattcataattatcttgcagtgattactaattcttccccagcagtgttttgcagtggctgaaggcacagacttgggactccagcaggtctggttctgagtcacagctctcccacttgctgccttcgtctctccctctgagccttggatgccttctccttgcaatgggaaggacctcaatgctcaccccctggtggatagcaggagtgtgggaagcagcagagcatctcagtgaagggcatggatgctggcgctgggctgcctgggtcaagccctggctctgtgccttatcacctggatagcccaaggaggttacttttctctccatgcttcagtttctttttctttttttaagagggagtctcactctgttgcccaggctggagtgcagtggcaggacctcggctcactgcaacctccgcctcctggcttcaagtgattctcctgcctcagcgtcctcctgagtagctgggattacaggcacctgccaccacgcctggctaatttttgtatttttagtagagacggggtttcaccatgttggccaggctggtctcaaactcctgacctcaagtgatccacccacctccgcctcccaaagtgctgggattacaggcatgagccaccgcgcctggctgtgcctcattttcttcttcagtaaaatgggcataatgatatttctgacctcataaggacattgtgaaggtgaaaagacataatgcattaagtggtttcagaactgctgacccaacaaatctaagattcagtatttattcacaggtctttaatttttttttttttagaccaagttttgttcttgtcacccaggctggagcgcagtggcacaatctcggctcactgcaaccctctgcctcctgggttcaagtgattctcctgcctcagcctcccgagtagctgggactataggcacccgccaccatacccggctaatttttgtatttttagtagagatggggtttcgccatgttgtccaggctggtcccaaactcctgacctcaagtgatccgcccgcctcggcctcccaaagtgctgggataataggcatgaaccaccgtgcctggccagtctttaattttaactgtcataaaactgagagcatatcaccatcactctactgttttcaaaagctagttgtttcaccttccctttggttgttacttatgtgatacacggttacttcatttgtttttgttcatattccatttggggcatttacccctctccatgctgctttttaattttaatttatttttattttttgatagatggggtctcactatgttacccaggctggtcacaaactcctgggctcaaacagtcctcctgccttagcccctcaaagtgctgggattattcgcgtgagccactgcacctggccccaaaacacattttaaaaaagcaacatggatgattgggcacagtggctcatgcctgtaatcccagcactttgtgaggccaaggcaggaggatcgcttgaacccaggtgttccagaccagcctgggcaacatagcgagattcacatgcctgtgttcccagctactcagaaggctgaagtgggaggatcacttgagcccaggaggttgaagctgcagtgagctgtgatcgtgtcactgcactccaatctggtcgacagagtgagacccccatctcaaaaaaaaaaaaaaaaaaaaaaaaagaaaagtaatttggaggtggtaaatgaaatatttatatagtgttaaaagttagaaccatctttagctcacttgcttttgccaaattgcctgcccaggtccttctgtggctgctcactctctccccagcagtacacatgagctcctgtttcctctcgtccttgccaacacttggttttgtcagacattttagatctttctcagtccgatggctgggaagtggtatctcactgcagtgtgtgtatttgtatttttttccaatgctactggcgagcttgaccatctttgaccttcttttgtactatttaggttttagaggaaggagttggggcctcctgctttagccagagtacagagttagctcttccctccctgtagggggttcagtctcaaccaagcccagcaaaccatgagatgggggtccccattgttcaagggaggggctgaagcccagaggagacaagggagtggccctggggtcacacagtgatgggtgccagaggcaggctccagcacgagactcctgggcccttttcccagcagagggagcccgaggcaggaagtgactgtgtgggccagggcacccagacggagcccagctgcccctcaggagctgctactggggaagggacctgccaaggccctgctgtcccctggggcatacacaggagaggggttggctgccatccagcctggcacgtttcctggctgtcccatccacccttagggcactggggccaggctgggctgagggaggtactggctcggggtctgaggggtgtagtggtatgcagtgtgtgagcgatctgtccccctcagcctctctcctgtcctcccgtcgccatctctgtgtctctctcttccctttgtgtccctctctgtcctactctctcactcccttctctctgtctctttatttattttgagacagaatcttactctgtcacccaggctggagtgcagtggcgcgatcttggctcactgcaatctccgcctcccaggttcaagcgattccccagcctcccaagtagctgggattacaggcacccgccaccatgcctggctaatttttgtatttttgtatttttattttttctttttgagacggaatctcactctgtcacccaggctggagtgcaatggcacagtctcagctcgctgcaacctccgcctcccggattccagcgattctcctgcctcagcctcccaagtagttgtgattacaggcgtgagccaccacgcccggctaatttttgtatttttagtagagatggggtttcaccatgttggccaggttggtcttgaactcctgacctcaggtgatctgcctaccttggcctcccaaagttctgggattacaggcatgagccaccaccccagtctctctgtctctttttatttgacttctctgtctctgcctccttcccgtgttcctcatgtcctccttgtgtcctctccctcatcccgtaccacacccgctgctgcagcaggctctctgggaccccacctcccaggtcctggccacgtgacccagaatcctctctcggggcctgttgccaagctgtgcttcctggccaagaagccagatggtggagtctcaagtcctggctccccagccctcagggacctggccagctggtcggcctcagccacaggctcctgcttggagagatgggggactggtctcctgccagatgagaaaatgcactagaggctttgcagctgccaggctctgtccctggggaccccacactttttccaggcccacccccaccctaagcaaagctctttctctggccaaggaaacaccctcctcccccctgttctgcttctctgtcccatgtttttgtatccagctcagcatggcctaggagaggagtgcacattcagggactatacagtcccagtccttgccttattgggactcaaggcaagggaccccatcctttctttctttccttttttttttgtttttgtttttttgttttttgagacagagtctcactctgttgcccaggctggagtgcagtggcgcgatctcagctaattatgtcttcataattcacaaattatgtcttcaatttatgaaggtgctggctcggggtctgaggggtggagtgatcagtaactcaaattacgtcttcacaaatctccttgtcttcatttctgagcaccgctttcttctgtgttggcctcatggtcagggagtccctgatgttggcaggatgaccccaggatgcccggcctacctcctcccaacttaggaagcccatgggaaagagagcatctcttctgtgcacacacattttcctggcgaaaatggggagagtggccgggcacagtggctcacacctgtaatcccacactttaggaggccaagatgggaggattgcttgaggccaggagttggagacccgcctggccaacacagcgagaccccacctctaccaaaaaagaaaaagtgggaagagttttcattggcccatctaaggttacgtgctcatatctgacccaatctttatgaccagggtgttttcagtgttctgcttggccccacttgggtcatgtgattacccatgactctctaggtttcatttgcccttcaggaagctcaggacctgagagtgagttttgatgtatttggaaggagaggatggattttgggcaggcaaaaccaacaactctgcactacagaactttgaatcaagaagtcttggcttggttcttgagtttggggttttgttttgcagtcatttgtggtaatctgctaccacttaattttttaattgttattttgttttcttctctagctttcctccatctgtttagaattacaagggtaatatatgaatatattcttttgggaaaaaattttactaaccgagcagtcttcagtaaaacataaagtctcactcctatctgcctcccaatcccacatcccaaagagagcctcagttatttggtgtgcatccatctagacctctttctgtgcatttacaagtgtacctatatggatgtttaatgtttttatattatttgcttttcatgtttaatttcaatttttgaataaataaattttcatggtgaagacatcaaaacctctagggaaatcccatgggaaaattatcgccttcatccctgttccccattcattaagttctcatcccgtcccccagtaagtaccatctgttatgaacttcttgtttactccagggaatttttatgcatgtgcaatccactataaatttatattcataggtaggttctaaattgcttcttcttcttcctctttttttttttttttttgtttgtttgttgttgagactgagtttcgctctttttgccaaagccggagcgcaatggcacgatctcagctcactgcaacctccgcctcccgggttcaagcaattctcctgcctcagcctcccaagtagctgggataacaggcgcctgccacaatgcccggctaattttttgtatttttagtagagactgggtttcaccatgttggccagcatggtgtctatctcttaacctcgtgatccgcccgcctcagccttccaaagtgctgggattacaggcatgagccattgtgcccggctttttttttttttttttttttttttgagatggagttttgcttttgttgcccgggctggagtgcagtggcatgatctcggctcactgcaacctctgcctcccgggttcaagtgattctcctgcctcaggctcccgagtagctgggattacaggtgtctgccatcacgcctggctaattttttgtgtttttagtagagatggggtttcaccatgttggccaggcaggtctcaaactcctgacttcaggtgatccacgcgccttggcctcccagagtgctaggattacaggcgtgagccaccgcacccagcatgctttttcttcttaacagtaacacttggctatttttccatactggtctggatttgtttaaccattttactcttttttattttttatttttttttaagagagggggtctagctgtgttgcccaggctggtctcaaactcctgggctcaagcatttctcccacctcaacctcctaagtagctgggattacaggcatgagctgctgcacctgacttaaccatttctctcttgatgggcattgaggttgcttccagttttttcccattataaactctgctgtgatactacaactttgtgcatctgtgccagtatttcttttttttcttaaaaaaatttttattattattatttaaaaatttttttttcaggatggagtcttgctgagtcacccaggctgaattgcagcgacgtgaatctcggctcactgcaacctccacctcccaagtacaagcaattctnnnnnnnnnnnnnnnnnnnnnnnnnnnnnnnnnnnnnnnnnnnnnnnnnnnnnnnnnntttcatttttaatacagtgaatgtcaataggtctaacccacacagacaaagctttctaaggatctcaatgcggtttaagagtgtaaggggggtcctggagacccagacatttgagaactgctattctatattaagtagtgacctcattggccgggcacagtggctcacacctgtaatcctagtactttgggaggccaggcgggtgaatcacctgtggtcaggagttcgagaccagcctggccaacatggtgaaaccccatctctatttaaaaattcagaattggcagggcgtggtggctcacgcctgtaatcccagcactttggaagtgccaaagggcaggcagatcacaacggtcaggagatcgagaccatcctggctaacatggtgaaaccccatctctactaaaaatacaaaaaaaattagtcaggcgtggtggtgggcacctgtagtcccagctacttgggaggctgaggcaggagaatgccgtgaacccaggaggcagagcttggagcttgcagtgagccaagatagcaccattgcactccagcctgggcgaaagagcgagactctgcctcaaaaaaaaaaaaaaaaaaaatcaaaattaaccgggcgtggtgatgtgtgcctgtgatcccagctactcgggaggcggaggcaggagaatcacttgaactgaggaggcagaggttgcagtgagccgagatcatgccattgcactccagcctgggcaaaaagagcgaaactccatctcaaaaaaaaaaaaaaaagaaagaaagaaagaaaagaaaaaagaaaaggaagtcttgttttaatttctattttccagcttattaataagactgagcatcttttcatatgcttgttttgtctgttgcctgttcacatctgatgcccatttctctttttgggcagtcctttttttttgctgatgtcattcatgtatgcattgaacaaatcataactggaggcctattgtgtaccaaaaattgttctaggctttcaagaatatagcagtgagtgtgacacagcccctcccatcatgtgggtcacattctggaagcaagggaccaataaaaatacaaaagtacctgagtgcagtggctcacacctgtaatcccagcactttggaaggccaacgtgagaatagtttgagtccaggagttcaagaccagcctgggcaacatagcaagaccccatctttatgacaaatttcaaaaatgagctgggcatggtggtgtgtgcttgtagtcctagctacttgggaggctgaggcaagaggatcccttgagcccaggagttcaaggctgcagagagttattatcttactactgcatgccaacctggatgacagagcaagaccctatcaaaaaacaaaacacacacacacaaatcaagagagttgtctgatggtggtaagcactgtgaagacgaagcaggatggagggaaattctttgattgttaaactagttccttgcactgatacatatcaatttttacagtttgtcatttgccttctaactctatgaaattttggttgatgcagaagtattttttaattattttttaattatactttaaattctagggtacatgtgcacaacgtgcaggtttgttacataggaattcatgtgccatgttggtgtgctgcacccattaactcgtcatttacattaggtatttctcttaatgatatccctcccccctccccccaccccatgacaggccccggtgtgtgatgttccctgccctgtgtccaagtgttctcattgttcagctcccacctatgagtgagaacgtgtggtgtttggttttctgtccttgcgatagtttgctcagaatgatggtttccagcttcacccatgtccctacaaaggacatgaactcatccttctttatggctgcatagtattccatggtgtatatgtgccacattttcttaatccagtctatcattgatggacatttgggttggttgcaagtctttgctaatgtgaatagtgccacaataaacatacgtgtgcatgtgtctttatagtagcatgatttataatcctttgggtatatacccagtaatgggatcactgggtcaaatggtatttctagttctagatccttgaggaatcgccacactgtcttccccaatggttgaaccagtttacattcccaccaacagtgtaaaagtgttcctgtttctccacatcctctccagcatctgttgtttcctgactttttaatgatcgctattctaactggtgtgagatgatatctcattgtggttttgatttgcatttatctgatgaccagtgatggtgagcattttttcatatgtctgttggctgatgcagaagtatttttatgtgatcaaattataaatctttccctttatgttttttatgcttggaaagatttttctccatcccaacattataaaagcatttgcccaggttttcttttagtgccttatggatttacttactctgtttaggtctttaatccatctggaattgttttcagtacaaacagcaaggaaaggatccagctaaattggttagccattggcccatgaccattcattaaataatccatctttcccttggggatttgaattggcacctatgaaacacatgaattttcctgtgtatttgggtctgcttttgcactttctgtctattcctaagacacagcagccatccaaattactatagctttgtatttatttttgataatttcttactatcaaatttttttatccggtaatcccagcactttgggaggccaagatgggcagatcacttgaggttatgagtttgagaccagcctgaccaacatggtgaaaccccatctctactaaaaatacaaaaaaaattagcaaggcgtggtgtcaggtgcctgtagtcccagctacttgggaggtcaaggcacaagaatcacttgaacctgggaggtggaggttgcagtgagctgaggttgcccactgcactccagcctggatgacacagcacccaggctgatttgttcatcctgaggtcaggagttcaagaccagcctggccaatatggtgaaaccccatctctacaaaaatacaaaaattagccgggcatgatggcaggtgcctgtaatcccagctactcaggaggctgaggcgggagaatcacttgaagccaggaggtgaaggttgcagtgagccaagattacgccattgcactccagcctgggcaacagagcgagactccatctcaaaaaaaaaaaaagcgttaacaaaaaattattactatatttgatggtaataattttggaaagttgactctttggacaaattctttaacttctcttggccttggtttcctcctctgtaaaacagggagactaccaatcttgaaggttgttctgggaattagtgaattaatggaccactttagttccggggtcaggtaagcctctttgagaaggtaatactccagctgaaatctgattgacaaggaagagcatgcctggcagaggaaacagcaaaggcaaaggctccgaggcagggactagcttagtgtgatgcaggttcatgcggagcgcatcgctcctggaggggactgaacaaggagagggtggaagggtgggccgcggtgaggggtctggctgtcaccataagggtactggagagccacagcaggatcaggagggcgggtggggcccattgaccctgcctctgtccccacagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggtgaggccagcgcaggggcctggggcggggcggggcggggcggtggggcggagaaggtgggcatggggcggggctgaagatggagacggctgagaccctcccactcatacgctgaaagacgcattcagccgttcactcattcattcattcacactcatttactcactttgaatcattcgttgatttattcatgaagtcactcatttatttattcactcatccatagtttgttctttcctccactcatttatttacttaactattcattcattcactcctctgttcctcattccatcactcaatttcctgatttgctcattcatttgttcactcagttgatcattctagccccagccctgtgtttggatgatagtggggccacaggggtggccaaggcagaccccattgtgccccagagggttcagagtccaacggggaaaacagacttgtccccagacagtgacaattcagggtggttaggaatatgataggaaacaagacctgtatgtgcaaaggccaacggtgtgagcctggcttaagtgcagacagcaagaaagagtatgtcaacagaggagactgagacaggtgtggtggtgcctgttgtcccagctacatgggaggctgaggtaggaggattatttgagcctggggattcgatcccatctcaaagaaaaaaaaaaaacaaaaaatggaggaggctgaatattcaactgggctcttaggcaaggaagggcctgggatgccgtgcaggtttaaagtttagttgcgatgcaggggttcttggatgcattctccccttgacctgcttcctgtgtcctctccaggcatgggttcaggagcggctgccactggccatgcagacagagcgaggcaacggtttgcaggcggtccagcagcacatcaaaaagaaccaggtgagcagagccaggtgagggagcgagttaggacatttggatacatgtgatagaaacagctgaaggtggttaaagccaaaacaatgaatgtattggcttttggaattaacaagactgtggacagcagatacagatgtatccaggtgcttccatatattttcatgactcttggctctattttttttttttttgagatggagccttgctttgttgcccaggctggagtttagtggcacaatctttgctcactgcaacctccacttcctgagttcaagcgattctcctgcctcagccatccaagtagctgggattacatgtgtgcaccaccacacctggctaatttttgtatttttagtagagatggacggcggggggtggggtgtttcaccaggttggccaggctgggctcgaactcctggcctcaagtgatccactcgcctcagcctcccaaagtgctgagattacaggtgtgagccaccgcgcccggcctgtttgtttttctgcatgagctttcttcttaggccagtcctcctctcctggtgataaaaggcctccaatggattcaggtttacctcccaccagcaaaactgaagagaatttcccacctcaataatgtcagcagtagtctcaggaataactctcattggctcaccatgcccatggcatcccacgcccatccctgaactaatcatgatggatggggtttcggactgctccttgggctggcctggttaagcgccctcccctggaacctgctgctggaatcagccttagcttaattaccaaggctgagatggaggcaaagggggtttcccaaaggaaaatcaggggcttgagactagaaggaaggggaatagctattggacaaggaaaaagtaaaacaacaacaaacaaaatcacaaaacatcgagttagcctggtgtgatggtgtacccctgtagtcccagctactctggaggctggggagggagggtcccttgagtccagaggtcaaagctgcagtgagccttgaacaccccactgcactccaccctgtgcaacagaatgagaccctatctctctctctctctcacacacacacacacacgtcccccaaaacaaacaaacaaaaacacccatagggacaaaggacagagataatcagcaagaggatactactgccccctaacctgagcaaggtgggggagggggcctttgagctcctaaaaaatctctgaatctgttcattcctctggggctcagtttccacatctaaagtagagttggtttagagcagtggttctcaaactgcatacgaagggaaccccttggtcaaagcaactatttcaccaaagcctaaagcaagacataaaagaggaataataataataaggcattgtgccaggtgtggtggctcatgcctgtaatcccagcactctgggaggccaaggcaggatgatcacttgagcccaggagtttgagaccagcctgggcaacatggggaaaccccgtctctaccagaaatacaaaaattagctgagcatagtagaaggtgcctgtaatcccagctacctgggaggctgaggcaggagaattgcttgaacccaggaggcagaggttgcagtgagccaagatcacaccactgtactccagcctgggtgacagagtgagaccctgtctcaaaaaaaaaaaaaaaacatcgattaaagatttactaagtgctggctgggtgcagtggctcatgcctgtaatcccagcactttgggaggctgaggtgggtggatcacctgaggtcaggagttcgagaccagcctgaccaacatggtgaaaccctgtctctactaaaaatgcaaaaaattaaggccaggtgcggtggctcacgcctgtaatcccagcactttgggaggccgaggcgagtggatcacgaggtcaggagatcgagaccatcctggctaacacggtgaaaccgcgtctctactaaaaacacaaaaaattagccgggcgaggtgtcgggcgcctgtaatcccagctactcgggaggctggggcaggagaatcgcttgaacctaggaggcggaggttgcagtgagccaagattgcaccattgcaatacagcctgagtgtcaagagcgagactccgtctcaaaaaaaaaaaaaaaaaagattaaaaaaaaaaaaagatttactgtgtgctaagtattgtcttagggtttatgctgattatttaatttaatcccctctataaccctatgaggtagatattgtcattatcctcatttcaccaaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgttggcgacagaactggcttatcgttgtcatggttgaggaaactgatcaagtgcacttagtacttaaaattgggggagctcagctgtgtgtgcagtgagagtgctggatacacaggggctgttaagcaaaaaatagctgcaaatatgatgcatttggtgcatgcagactcagttccaagtgctccatagtttatcaccttataacaaccccgcaaggtagattatctcagcctgatactagctgtgtgaccttagcaaattcctcaccctctctgtgcctcagtcttctcatctgtaaaatggagatggtaatgttgtctggctccataggttgggagtgaggaggtgtgaggctatattatgtaaagctcttacttagcaaagcacctggcaggtagcagggtagcagacactcaagaatcgttggctggccgggcacagtggctcatgcttataagcctagcactttgggaggccaaggtaggaggatcgcttgaggccaggacttcaagaccggcctgagtaacatagcaagacctcgtctctccaaaaatattttttaaaatagcagggcatggtggtgcacacctgtagtcccagccgcttgggaggctgaggcaggaggatcacttgagcccaggagtttaaagctgctgcattccatcctgggtgatagagtgacaccctgtctctaaaaaagcaaaataaggagaggacttgctggctgttattatctttatcagttgagtcacacaaaaagttaaataacgttaaggcacacaaaaagttaaaaaagactcacaaaaagttaaataaggtactctgtaagtaaataaggttaaggcacacaaaacgttaaataaggtactctgcaagtacagagctggttgagggaaccttctgggggatggaagtgttccgcacgctgatctgggcacaccggtgtatgtgtctgtacaaatgtgtgcaactgtatacctaagatttgtgcactctaccgtatacaaatgatacctcggctgctaagctgcagggtttctgtattagggcccatcttgggtcggcaagcggcttggctcagagcacagtctctggaaccagcctcctgtgttcaaatcctgtcactccttactggctgcttgttcttgggcgccgtacttcgcccctctgtgcctgttttcccacctgcagcaagcatagggttatgatgagtgagggagtatcagcaaaatgtttacatggtcttggcacgtggttagcgagctgggggtgcttgttaattgccccgtgggccgtgccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggtgcgcccgagctgggggtgcggagggcctgggggcgctggagccgggggccgccgctgccgcctcatcgtgggcgctttgtgcccccaggacgaacagagcaccctgcagctgctcaagaaacacctgcagctggagcaaggcgtggagaactacgaggaaagcatcgcgcagctgtcgcgccagtgccgggcgctgctggagatggggcacccggacaggtgggcgggcgcgtggccagttcacaggaatggtccagcaggacctgaagcttcgctgttgggagttggcgcagcgctggaattggacgttgggtgggagaggtcctccttgctgtgtgctggagccctcgaatttggcaagtgggcgggccggaatggggggacacggctcagggatggttgagagggtggggccaggagcacctggatttgagtgtagtagtggggaccttgtcgggggagaaaagagtaggcgatgtctaggactggggtagagaagaatttactcaggacaggcaaggggctctttctactcagtgtctgggaggacagaaaagcctgtgctgagattggctatggcggtggggctggagacctcctggtgcagtggggtgatgttgcctcgtgtaggcggatgctgagctccaggcctggaccagggatggaatctgtaaggaggtacagagagagacctctgtccaagtgggctcagagattggggctagaggtgggatgcattggctggggacccaacctgggagtccagagtcccaccgaggttcctggataggaggggcgtgagactgagatagaaaccgggtgaggctgccgaggtgggcggatcacttgaggtcaggagttggagaccagcttggccaacatggtgaaaccctgtctctactaaaaataaaaaattagctgggcatggtggcacgtgcctgtagtcctagctactggggaggctgaggcaggagaatggcttgaacctgggtggcagaggttgcagtgagccgagatcgcgccactgcactccagcctggtgacagagcaagactccgtctcaaaaaaaaaaaaaaaaaagaaaagaaaaaaaaagaaaggaaactgggtgaggctggatagaggtgagcttatccatttagggaagcagagctttccctgcatgctgaaatgcagggctttctgaacccaagacttgcagaaaacagagtcctggccaggtgtagtggctcacacctgtaatctcaacactgggaggctgaggcaggaggatcgtttgagcccaggagtttgagaacagagggaacatagtgagacctcatctctacaaagaaatcaaaaagttagccaggtgtagagtcacgtgcctgtggtcccacttgggaggctgcaatgggaggattgcttgagcatgggaggtggaggctgcagtgagttgtgatcacaccactgcactccagcctgagcaacagagcaagaccctgtctccaaaaaaaaagaaaaaagaaaagaaaacagagctctacctggggacacagccgtgtctgaagattccaaggaaacacagccctgtcctggggagggggtttaggggggtcacgctctgccccagaagtctcaggggtccatccctgcccctccatgtcccccttcagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgagcatcattagtaataagtgataccaggagctaccactaaggttctctgggccttagtttcctcatctgtagtatgaggataataacagcacccgcctcatggctctgctgtgagacaaatgagttaatataacgtaaagcactgaggaccctgcttggcacacatgctgcctcacacagtgttggttattattatcagcttattattttattgttacttattgttatttttattgttactgttttgttactattcttgccaggtgttcagtaagtgttagatattattttttatgatgatgatgatgatgatgatgattatcattactcttacctgccacaaaatggtagcctctgccaggtgtggtggctcatgcctgtaatcccaacactttgggaggccaaggcaggtggatcacttgaggtcaggagtatgagaccagcctggccaacatagtgaaactccgtctctactaaaaacacaaaaaaatcagctgggtgtggtggcacatgcctgtagtcctagctgtttgggaggctgaggcaggagaattgcttgaactggggaggtgaaggttgctgtaagtggctattgaaccactgcacgccaacctgggcgacagagcaagactctgtatcaaaaagaaaaaaaaacattgtaggctggagggggctggtgtatgctgcccctttgctcactttgctgtacccccccccccacttcctgatggcaggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtggggcgccggtggccatcagggcaggtgggagggcctggacagctgtgggcagcagagtgggcaaaaatcaggctgtggagcaggtcgaaattaggcagtggcacagacagaaagtggactacagaacaggaagaaattagataatggagcagatagaaaatggactgatggaatgatatatagaaatcaggtattggcagggaaaagtggtaccttagaaggtctcacagatattaaacagcttctggctgggcgtggtggctccctttgggaggccaacgcaggcggatcatctgaggtcaggagtttaagaccagcctggtcaacgtggtgaaaccccatctctactaaaaatacgaaaattagccaggtctggtggcgggcacctgtaatcccagctacttgggaggctgaggcaggagaatcacttgaacccgggaggaggaggttgcagtgagcccagatctcgccattgcactccagcctatgtgacaagagtgatactctgtctcaaaaaaaaaaaaaaaaaaaaaagcttccaatagatattgggcagtggttctcctaaaactgtgagttttgcctaaatccagatcaagggtctaaagggaattttgagaagtctgagaggaatttggctgtggtgtagatagaaattagacgacagacaaggccaggtgcggtggctcacgcctgtaatcccaacactttgggaggtcgaggcgggcagatcatgaggtcaggagttcaagaccagtctgaccaacatgatgaaaccccgtctctactaaaaatacaaaaattagcaggaatggtggcgggcacctgtaatcccagctacacaggagactgaggcaggagaatcgcttgaacccgggaggcggaggttgcagtgagccgagatcgcgccactgcactccagcctgggcgacagagtgagactccatctcaaaaaaaaaaaagacttagataacaggtctctgatggaaatcatatgacttttctgaaattaatttgatgggggcgaatttaatgaaaaaggcaacagagatattagaaattaggcagaggttctggccagaattcggatgtggatctgagcagtcagatggaaatgaagctgcaggcccaatacaactcaggcagcaggaaatgggttgcagttctaatggaaggtagaagtgggcaattttgtttgtttgtttgtttatttttgagacagggtctcactctgtcacccaggctggagtgcagtggcgcgatctcagctcactgcaccctctgcctcccaggcttaagcgattctcctgcctcagccttccaaatagctgggattacatgcacgcgccaccacacctggctaatttttatatttttagtagagacgggatttcaccatgttggccaggctggcctcgaaatcctgacctcaggtgatctacccgtctcggcctcccaaagtgctgggattacaggcatgagctactatgcccagctggcaattattattattattattattattattattattattattatgaggcagagtctctctttgtcacccaggctggagtgtagtggtctaatctcggctcactgcaacctctgcttcccgggttcaagcaattctcccacttcagcctcgagtagctgggactacaggtgcaagccaccacacccagctaatttttgtatttttagtagagatggggtttcaccatgttggccaggctgatcttgaactcctgacctcaagtgatctgcccgccttggcctcccaaagtgctggggttataggcatgagccaccgcgcccagcccagttattttttataaatcctacaaatgacttagaaatcaggctgagagattcatagtaataagtggtggatctgttagagatggggaggtcacaccaaaataaatcaggagattgaaccaacagagtgagcagcaggctgagcacagtggcttatgcctataatctcagcactttgggaggccaacctgggaggattgcttgagcccaggagttcaagatgagcctgggcaacatagtaagactccatctctattacaacatatatgtatatatcctgatacagtggcatgcacctgtagttcagctattagtaggctgaggcaggaggatcacttgagcccgggatgtcaaggctgcagtgaattgtgtttgtgccactgcactgcagcctgggcaacagagcaagaccctgtctcagaaaaacaaacaaaaaacccaaaacccaaaagatagagtgagcagagctcatacagcagaatgaatggaaattgggcaggggagtaatggcaattgaacagccgtcgtgtaggaaactgggctactatgaaggagtgggtttgaaataaactgagttaaaaaaaaattagcacatctaaaagacatcaaagtggaaaggggtttcctgaaagacccaaggtaggggtgggcctgcctgaaaacacaggtggcagacccaatagaaataaagctctcagaccaaaagaaatcaggcagtgggttgaaagagatgtggtagtagatctaaaagaagtcagaatgcgggtaagtcaaagagaaatcaggcagcagatatgacaggagcctggctgtgggatcacagtgtgaggctccttatatcttgaggttctgcgctggagcagatggtgggagggagggcacagcctgggccccgtggagggctggcgcccgacctggcatgcccttcaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattccagcatctcagtggcttcattagtgggcatgggcttattgctcacatagtggttggatgtgagtgtccagcagaatcctgtcccctggtgattgggagccagggtccttccatcatgccaccctgggagtcacatgctggaccctctgcatcccgctgcagatgggaaaagatagcaggaggatcacacagaaggttttagggataaagccggcacccacacactgccagcccggtggcctaacctgtctgccagggaggctgcaaatttttttttctcttgagatggagtcttgctctgttgcccaggctggagtgcagtggcacaatatcacctcactgcaacctccgtctcccaggttcaagcgattctcctgcctcagcctcccaagtagctgggactacaggcgcccaccaccacgtctggctaattttgtatttttagtagagaaagggtttcaccgtgttggccactctggtctcaaactcctggcctcaagtggtccacctgcctcagccttccaaagtgctgggattacaggcataagccaccgtgcctgacctaggctggaaatttagtttcatggtgtggctaggaagaaaaggacctagggaatcagggacaccgggcattgcttctgggaatgcagatcctgcagcctgcattcatttactcagcaaatatgtattaaatgcatatggtgtgccatgtggtgagcaaggccaagcacttgccctgagacagattgcattctcatagcacttattactttctgaaatatagcatggggatggggcacagtggctcacgcctgtaatcccagcactttgggaggctgaggcaggcagatcacctgagctcaggagtttgagaccagcctagccaacatggcaaaactccgtctctactaaaaatacaaaaattagccaggcatagtggtggacacctgtaatcccagctacttgggaggctgaggcaggagaatcgcttgaacccgggaggtggaggtcacagtgagccaagatcgtgccactgcactccagcctgggtgacaagagcaaaactccgtctcaaaaaaaaaaaaaagaaaagaaaaaaaaatgaaatatagcgtgggtatatatacatacataggaagggaatgatagctggcaaagtctctctgaggatgtgcgtttgactggagacctgaatgaagtgatgggtgagtcaggtaaagttttgagggaagagttttctaggtggagggacccacaagtgcaagggcccagaagtgggctgtagttaggcatgtgtgaggaaaagctagagatcactgtggccagatggagggagggagtgagggagtgtagggtgagaggaagtgagtacagaggggcactggggccctggaaaccacacatggtgaggagcatgccttctctatgaggaacgtgggagccatgcgagagtttagagcagagtggagtgatgtgatgtgtacatttgagaaaaataggccgggcatggtggcttatacctgtcatcccagcactttgggaggccaaggcgggtggatcacttgaggacaggactttgagaccagcttggccaatgtggcgaaaccccgcctctactaaaaatacaaaaattagctgggtgttgtggcatgtgcctgtagtcccagctactggggaggctgaggcaggagaattgcttgaacctggaaggtggaggttgcagtgtgctgagatcgtaccactgcactccagcctgggcaacagagcgagactctgtgtcaaaaaaaaaaaaaaaaaaaaaaggctgggcacagtggctcacacctgtaatcccagcattttgggaggctgaggtgggtggatcacttgaggtcgggagttcgagagcagcctgaccaacatagagaaacctcatctctactaaaaatacaaacttagccgggtgtggtggcacatgcctgtaatcccagctacttgggaggctgaggcaggagaattgcttgaacccaggaggcggaggttgcggtgagccaagattgtgccattgcactccagcctgggcaacaagagcgaaattccatctcaaaaaaaaaaaaattaaatatacagggaagtaaaggtaacccacatgtgtatcgtgaacacttggcttgaacaaccatcaacatttggccaatctagccaaaagaggtggctcacgcctgtaatcccaacactgggaggccaaggcaagaggatcacttgaggccaggagtttgagactaccctacgcaacatagtgagaccccatctctacaaaaaagaaaaaaactagtcaagcatggtggtgtgcatgcctgttgtcccagctacttgggagtctgagggaggaggatcacttgagtccaggagggtcaggctgcagtgagccatgattatgccatttcactccagcctgggtgacagagcgagattctgtcttaaaaaaaaattttttttttttaattagctgggcattgtggtgcatgcctgtagtcccagctaccctggaggctaagccaggatgatcacttaagcccaggtggtagattcaaaccatagcatgaagctatgattgccaactgatggaaccttcagaaacttggaatttgttttggacataagatggcttagaatggtgctgtccaatagttatataacacgagccacaaatgcgagccacatatatactttaaaatcttcttgtggccatactaacaaagcaaagcaaatgaaacttaattttagtaatacatttttatttaacctgacatacccaaagtattatcacttcaacaggtagtcaatattaaactactcctgaggccagaagttcgagaccagcctggccaacatgccaaaaatccatctctactgaaaatacagaacaaaaaattagccaggcttggtggcgggcacctgtaatcccagctactcgggaggctgaggcaggagaattgcttgaacccagaaggtggaggctgcagtgagccaagatcacgccattgcactccagcctgggcaagaagagcaaatctctgtctcaaaaacaaacaaacaaacaaacaaaggctgggtgcggtggctcacgcctgtaatccctgcactttgggaggcctaggcaggcggatcaactgaggtcaggagtttgagaccagcctgacaaacatgttgaaaccctgtttctactaaaaatacaaaaaaattagccaggcatggtggcaggtgcctgtaatcccagctactcaggaagctgaggcaggggaatcgcttgaacctacctagaagggggaggttgcagtgagcggagatcgcaccactgcacaacaacaacaaaaaactattaatgagacattttacattcttttttacattaactccacaaaatctggtgtgcattttacactttacaccaaaattcagactggccacatttcaagtgctcacatgtctagtggctactgccttggagagcacagacttggaacgttaaaatcattggctagtggaaccttcagaagcatagctagaaaaagtttgaaaatttggatcttggctgggtgtggtggcttatgcccatagccttgaactttgggaggctgaggcaggtggattgcttgagcccaggggtttgagaccagcctgggcaacatagcaagaccctgtctctacagaaaatgaaaaattagttgggtgtgatggtgtgcacctgtggtccccgctactcaggaggctgaggcaggaggattgcatgagcccaggaggttgagactgaagtgagctgcaatcttgccactgcactccagtctgggcaacagagcaagaccctattaaaaaaaaaaaaaaggaaaatttggatcttgaaatcctagaaggttagaatcaccaaagtgtgaaattttagaaacttggaaaatttgaatcattgaattagtgaaccatggaccctcagaatttggtcatcgaaagtaggtgtctcagtctggtttggtgactcaacgcctgtaatcccagcactttgggagactgagatgggaggatcacctgaggtcaggagttcaagaccagcctggccaacatggagaaaccccatctctactaaaaatataaaaattatctgggcgtggtggcaggtgcctgtaatcccagctactcaggaggctgaggcaggagaatcgcctgaactcgggaggtggagtttgcagtgagccgagatcgccccactgcactccagcctgggccatagggtgagactttatctcaaaaaaaaaaagaaaagaaaagaaaagaaaagaaagtaagtgtcttgaggtggtatgggatgtcagcctcaaggatttggggtcaccaggagccacatgtatggggcaggctgaggaggctccctgtggctcagatccctgcctgccacccactgcagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgaggtggggagcagggagggggtccccctctgccacccgggcacattggggtggaagccattccacaccctgacttccctcccacccacctgccactcccagatccaggcacagctggacaagctgggaaccaggaaggaggaggtgtcggaaaagtgggaccgccattgggagtggctgcagcagagtgagtgggggcccaggcacacgtggttcaagggcacagggacatgctccagcctgtccagccaaggcccagagggtgacaggagcatgctttgcaccctacccatgggtctccagaagcaaacataagggcctggaagggtggacaagggggctgccttgccattgaatacccacccttgaaaaaaaagtcttaaagtcctgggtggggggacattaaggaaggaggaatgggagtcagaaaggaggaatgatgcccactgaaatagccccagcctctgccattcctgcagagcccaggatggtcagggctcgggtatggaaagccggaggggtgtggaaggccaggggaacagccattgcccccaggaagggccccagatgccccagaatccttaccctgcatgcccctcctcagtgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacggtcagctccccagatactgccccattacccccacccccaccaagacccccacacccatggctctatatgagacagacacaccgagacatggtgcttggtcctgtgttgtgtgagtgccaagacagactcttgctaggctcccagtggagcagagggacagacctgtcaccagtgacagcccagaatgtcagggatgtgataggggaagaacaagcagagggatagtgcctgggatgggggagtgggagggggaactggcctgggggattctattctgagacttgaataattaggtgaagagaatgtagtaataaaaaggattaggccaggtgtgacggctcatgcctgtagtcccagcattttgggagaccaagatgggtggatcacttgaggccaggagtttgagaccagcctggccaacgtggtgaaaccccatctctactaaaaatgcaaaaattagctgggcgtggtggtgcacgcctgtaatcccagctactcgggaggctgaggcaggataatcacttgaacttgggaggcagaggttgcagtgagccaagatcgtgccactgcctgggtaacagaacaagactccatctcaaaacaacaacaacaataaaaaaaaaaaaacaaaaaaaaaccgcttaaaggctgggtggggtggctcacacctgtactctctttggaagcctaggcgggaggatcacttgaacccaggagttcaagaccagccttggcaacatactgagaagccgtctctaccaaaaccaaaagcaaacaaagaaaaaacagccaggcgtgatggcacgtgcctgtagtcccagctactcagaggggtgactgagactcgaggatcacttgagcactggaggtcaaggctgcaatgagctatgatcttgctgcttgcactccagcctgggcgacagagcaagactgtctcaaaaataaataaataaataaataaataaataaataaataaataaataaagtcttaaagtcctgggtggggggacattaaggaaggagaaatgggagtcagaaaggcacgcagagcaattgatttacccaatttttaaaaaagtgatttagccaattcttaaaagagcaataggtgtttgccggagagaataggctttaagttcttggcagagagcaaagcatcgcacaggcctggacaccttgctttttcaaggaactggtcaattgagtgatgaggcagaaaaacccaggccgcctccccggacctcccccttaccccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccagaaagtgaggggaggggaaagcggagagctcctagaacccctcaggcccagtgaaagggcttcagggctcagaacttcccaaagaaggagatatcgccgcggtacccattttgcagaggtgtaaactgaagctgcaagataatcgatgtgcccattgttacacagaaaggggagcccttcctgttgaaagaaaaggcagactgcctttctccagacgtaggttctcggcccctgggttgtgactcctgcatcaagtctcccgggtgccccgaggcagggattttgtcctctctgtgcctcagtttgcccactgggctaatggtggaaccctcacctccttgattggagaggagaccctttatcacaattctctcagcagccttatgaagtgggggctgttgtcttctccattgtatgactagggcaactgaggcacaaaaagggcaagtcactcagcttaaacgaaccaggactttcagaatccagagttggccagtgtgtgttgtgcagatctgtccagtcagctgagtgtgtctccagaaagaggcctttggtcaggagacaatgacttcttgattctttttaaattgcacatttcatgaacatttgctgagtgcccactctgcctggcatgtgctgagtcgagcggtgactgaaccagtcccatccctgactttagagactcacagtccattgggaaaaacaggcttgtcatcaatgatgacccagaattatctgggctggaatgggggcgattgggggactggagagtcaggggtgggtggagaaaggcaacgtttgcaagttgttctttgtgctgcttaaaattcaaaggggcatctgggcgcggtggctcacgcctgtaatctcagcactttgggaggttgaggcgggcagatcacttgaggtcagaagttcgagaccaacctggccaatatagcaaaaccctgtctctactaaaaatgcaaaaattagccggcatggtggcgcacgcctgtagtaccagctacttgggaggctgaggcaggggaatcgcttcaacacaggaggcagaggttgcagtgagccgagatcatgcaccactacactccagcctgggcaacagagaaagactccgtctcaaaaaaaaaaaaaaaaaattcaaaggggcgagaggtttggtcttccattcagcagacacgtcccaaacacctgtggtacctaaggcgagcatctgagagaaacagctgcagaagtgggcaggggcctggcacttccagctaagaagtggaggctcctctgcccagccagacaggtccatgggagaaggaaccctggtttcactgggtctttctgtcccccatcccccaggaaggccaccctggctgacattgtggaacagctgcaggagaaagaggcaggcccagggctgcctgctggggtaagttgagcctcggatgggtggggatacgaggacccctttttcagagcaggaggcaggatctcagaaacagccagtgcctagccctggcaggacccattccctacctggaccctgcagagacagcatggactctcagggtccccagaatctgaaaatgtcccccttagaaagacggggcacctacctaagagacccctactgcccctccacacacacacacacacacacacacacacacacacacagacacacacacacagacacacacacacagacacacagacacagatacacacacagacacacacacacagactcttcccacatctgtcctggactccgtatttcttcagcccagtggggtcccaaatttcttcatagcctcatacacacacacacagaaggaagccccaggttcctcctgcagacagtggggacacgccctgcttgcacccccacctccagagatctggctgcctctttccaccaccgagagagattccaaaccaatgagtcctaacagactcactcccaagacccatggggccctaagaattgggcctccaaccctgaggtcctcccatactcgcctccgagacaaatggccctgtagacagatgggaccccagacccatgactcccccaaacagatgacccccacaccctctccatggacagcacccctcttccccctcccttcacacagccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtgagcgtgtgggcggggctttggaaggcgggtctcaggctcagggtgaccattgcgtggagcggtgggactgaggagggggtgtggctcaacttcaggccctccagcaggtgggggtagtaggtggggccagagctggggggtggtggtggcttaaatcaagaaagccaaccaatgagcaggagggggtgtggtttaacgtcaggccctccaacccgtgggggtagtaggtggggccagatgaggggtggggctcaactttgatgattccaaccaatgaacaggaaggggcaggacctaaggttagtgcatctaatggatgatgggtagagcttaggtgggaacagaaggaaaatgttctgaaagtgagtaaattggaacctaacctcttagcaaccaacccaggagttgatcagctaaatagcaaagagggaggcatctagttgagaaggtttcaatggcttgtcgtggagcttggagaggtcactcaaccaatgagtggggtgggtctacccttgaagtttcaaattgggggagggtccgaaaacgggcagagcccaaactaatgagggtaggggttgggaagggggagtcatctcttacaggtttccaaatgagggtctagccatgatgtgcctgctcttggggagtccagctcctgcttgtccaccctctttttgtccaactgagaggcagaatctggggacaagtggagccaaaaaggggtatcaccggccagtaatggagtgagtcccaagatatgaagtgggcaggacagattcagattttgctagtggaatctgtaggtggtctttcttcctcgtacctaatgccaaggtaggaataaacaagggcacctagtatgtcttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcaggtgggctgggccccttccccagatctctgaagtcctgtgtcccttcctgcaggacccaggatggcagtgagtttttgctccaggcaaaagatgaggtgagatctggtcctttcctccctctgtgtggacctcagtaatgacctggctgtctggctcctgacccagagtgatggggctgtgagaagggacactcacaggccagagttatcagggctgtaatgggaaagcccacaggcactgagagcccaaaggaggttcctaacccagtggggagtgggaagggcttcagggagggctgcctgcagatcctgatgacaaagtccaacatctttgccgtggtcactcaggtgagactggaatggagggagttcgctttaaaaaggggtgatttggccaggcgcggtggctcacgcttgtaatcccagtactttgggaggccaagacgggcagatcacctgaggtcaggagtttgagaccagcctggccaacatggtgaaaccccgtctctactaaaaaatacaaaaattaactgggcatggtggcaggtgccttaatcccagctacttgggaggcagaggcaggagaatcgtttgaacctggaaggcggaggttgcagtgagctgagatggagccattgcactcaagcctgggggacaacagcgagacttccttcgaaaataaaataaaaataaaaagggtgattcagagggacagtgggggtctaaaaaaaggagtgattcaggttgggcaccatggctcaggcctgtaatcccagcactttgggaggccaaggcaggagactgcttgagcccaggacttcaagatcagcctgggcaacacggaaagatcccatctctatgggtaataataataataaattagccgggagtggtggcacatgcctgtggtcccagctactcaggaggccgagtggaaggatcacctgaaccagggaggtcaaggctacaatgagctgtgattgtactatggcactccaggctgggtgacagagtgagattctgtctcaaaaacaagagggggtgggtgatctaggtagagggaactgcaagtgcagaggaccagaggtgcagtattgcaaagggttaactgctggagggcagagttcatggaagaaggtcccagaaaggttcccaggagataggtgtctcaggacaggatgggccatttggaggagattggattttttacctaagggcactggagagctaggggggattacagtgatgtgtaaaaaagattcctggctgggcgcagtggcttacgcctgtaatcccagcacttcgggaggccgaggcgggtggatcacctgaggtcaggagtttgaggccagcctgaccaacatggagaaaccccatctcttatggtgcatgcctgtaatcccagctactcgggaggctgaggcaggaggattgcttgaacccggaaggcagaggttgcagtgagctgagacagcgccattgcactccagcctgggtaacaagagcaaaactccatctcaaaaacaaaataaacaggccgggcatggtggctcacgcctgtaatcccagcattttgggaggccgaggcgggcagatcacaaggtcaggagatcgagaccatcctggctgacacggtgaaaccccgtctctactaaaaatacaaaaaaattagctgggcatggtggcgggcgcctgtagtcccagctacttgggaggctgaggcagaagaatggcttgaacccgggaggtggagcttgcagtgagctgagattgcgccactgcactccagcctgagcgacagagcgagactccatctcaaaacaaaacaaacaaacaaaacaaaacaaaacaaaacaaaacaaaaaaagattcctttggctacctgggtgggtagcccaggccgcggccagggcagggacccaagtgggagagcgcatggctgggccacacaggcctgtggggagaggaggaagaggagtctgagagaggcaagcataaaggtggtttgaagagatgttgagagtaataactaacacttgttatctcattcaatcttcacaagatgcaatgaagaagtgggctttttttttttttgagacagagtttctctcttgtcacccaggctggagtgccatggcgcaatctcagctcactgcaacctccacttcccgggttcaagcgactctcctgcctcagctacctgggtgactgggattacaggcttgcgccaccatgcccggctaatttatgtatttttagtagagacggggtttctccatgttggtcaggctggtctcaaactcctgacctcaggtgatccacccgcctcagcctcccaaagtgctgggattacaggcatgagccaccacacccggccagaagtaggcctttacccactacatgccttcttttacttatctgcacaatgaagattaaaaatagtttcttggcctggcatggtgcctcacacctgtaattccagcactttgggaggctgaggtgggcagatcatttgaggtcagaagttcaagaccagtgtggccaacgtggcgaaaccccatctctactaaaaatacaaaaagtagccaggcatggtggcacgtgcctgtagtcccagacactcaggagactgaggcacaagaatctcttgaacctgggagatggaggttgcagtgagctgacatcgagccattgcactccagcctgggggacagagcaagactctgtctcaaaaaaaaaaaaaaaaaagtctcttatcatagggttactgtgagaattaaattgctccatgtttaattgatacatgataaactgatacttagcacagggcctagtaaatatcagtgctctagtagtgcctgcccatattattatcattgtttgtgtcatttatctctgtagtaggaagtatatacaatcctattgcataggtttaagggaattaatccactaaagtgtttggaacagagcctggcacatattgctatgtaactgcatcatcatcatcatccctttttaatagatgagaaaactgaatttcagagagggtagtctgatctgaaattcacctattattccagcttctctcttccaaatacggcctctgtgccctgtttcttcccccaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggaccccccctcccctcccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttgacggtctatggtcctttgtttgggttttctgggctgcgcccgggaggattgaaaggagggctgtggtggctgtaggggtgggtgcggggtggggagaggggcacgggggtaccgtggctgcggagaacatccagatgtacccttttatgtggacttaatttcggggtctaaacacacgccccttgacgagaacctagagggatggagaatatttcgttatgcttcgtaataaacttccccaaaggagactccgggtccgccccgtcaagttcaggaaaggcggacccctttaaggaggcggaaaagttaaccgcgatgggcaggcgctctgtccaatcgctagtgactcctggagtctctggcccaatgagcagcctatggaggcggggtccgggtgcacacccggaagtgggtgcgggccagccggctcgcccgggggccatggcagcagcggctactgcagccgagggggtccccagtcgggggcctcccggggaagtcattcatctgaatgtgggaggcaagaggtgagtgtgggagactcctgaggtcccatcctcgggggcgggaagcggggtgggagtatccgcctctcctgggggaatccctgtccatcaagggttgctccgccccccccccctttggaggcgcgagattctggaaaaacgccgggggagggggaaggggagggaaccctggatcctgcgggagggggacgcattcctcacccgctcctcttcatctcttgcgtccgtttaccttccccgcccagattcagtacctctcgccagactctcacctggatcccagactccttcttctccaggtgatcgggagagcgagtttggggcgagggtaggagggatggagagggcgtgggagacctaatatccactcccccggcccgtgacgcctgctcggtgtcccttccctgcagtcttctgagcggacgcatctcgacgctgaaagatgagaccggagcagtgagtcggacaagaactgaaatgggatgggggggaggggttggtaggaagaggggcaggaccccactcagtcctgccttttaccccatccatcctctgcccccctttcccgcagatcttcatcgacagggaccctacagtcttcgcccccatcctcaacttcctgcgcaccaaagagttggatcccaggttggcatggaaaaaggggagggagtccctcactgtcttcagtccctgaggagttctttcacctcctctgaatgtccacgtgagctccattctattagaattctcattcagaaccttgatcacaggccgggcgcgccgggattgctcacgcctgtaatcccaacactttgggaggccgaggtgggaggatcacttgagcccaggatttggagactagcctgggcaacatagcgagaccccttctctaaaaaagcaaacaggcaaaacttcatgagaatcttgatcatgttaaaattttatgtccttcgatttctccctacacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatggggagggggaaatggggtggcctcagcatctccctaagtcccagcctttaagtcctcctgttgcagtt

SEQ ID NO: 13181 - DNA, 16062 bp, Human
atatgcctatgtatactttttaagtaaacttataaacatgtggtaactagggcatattttattctgtctacggcagcttcttggtttatccaactaagtattactaattctattttcttagaatgagaagttctcagaacaatgatctatcacctaaatttcaaatgaatgtgtaactggtagacaaacttaaagcagactttctaaaactattaacagtgctcaagaatgcatctatttacatcttaaaaatttctcagttactatatgctactctaatgaaagctatattcaaattataattttttcccacagcatgccaacagattaggaattataaacagacagatctggatttgaatcctgtctattctttagcagctggttatctctgacaaattactgtaaacctcgttaggcttctcggttttgtattatcaatcatcattggtaactgatagtactgagagatcctcattatgtaaggattgaaagaaaaatggttgtagcactgagaaaagtatcaaacattattctgcaatttccttaacttgggttttacttttaagttgtaaattttcccttggcaatgttcacaggatatctttgctaaaatattatttttcagttagttttaagctgactctttaaatatcaaatgatttgctctagagatggattttctttctttggaagaagccaagatcatttccatttaagggcatgtaagcagctgctgctacacattttagttacccataagaaagtgaagtgggctaagttcactctgtcataagcatttaaaaaattaaaaattacaagtacctcctctaaaattaaagaagagatttaagaattaatattttcgagtgtggtgacttaagtaaatctaacatctaagacaacaaattagataaacagagaagaggagaatgatgcccggctttacaaaaaaattatttccccagttctactgtaagataaactgttctaggaagttcaaaatatcatctcacttactagcatctcatttttatagtaattttcaggaaagcaactgctagattaaatgaggcacatcctttcaaaaacattacaaaacttaaatttcaacacatcaaacctataaagcctcattaactgagatgtaactgatttggaatctgtaattatttcttttttgccataaagttgcccttaatactgcatcagtttattaaaaatttggtaagattgtgtaataatttaatgcaattgtttttaaaaaatcttaaatacttaaagtagcatattgctattttgggggtgttgtatgtatcagtttaaatataagtattactattcacaaatatattgttaaactgctaattgaagaaaacacaaatgaattaaatacatttattagttctttaactgtaagataaaaataattttttaaaacaaaaagcaattagcctgattttctcatactccttctcccatacacacaagaacaagaacaaaataagaaaacaggtataaaattttattgtgtaaaaatatttcactttcactaaaagctaacattatgaagacacgtattaaagcaacagcagcaagaattcaatgaaagttgttttgcttatacctgtgtttatttttctcataattaaaattcctgcagtaactattttagctcttcaacatcttcaccattaatattcaattatctctaagcctgaagatgcatgaatctttaacaaaagctttccaccacctcaagtttacttatttttttcatttatctaccatatactgttttaaattaaaaacaaaagatgaagcacaaagtgttaatgacttttccatacctaaagtaagaagttctaaagtttggttgtgataagactgagactgtggctaaccaatcgaaacttcagaattcctatgtgacatcataagacctccctagaacactttttctcctccacctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtaacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgttccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaaatgttttgttataatgtggtttgggaaaagtctggtcttccagaaactatggaagacactgaggatactccaatacttgtagtaaattgggagaaaaaggcaaggagctaaagttactcctcctaacacaaatgagacggtcatggtgtgccccttcaaaaaaggagagaaagagagtcagacacatagaaacacgtgcacatacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactcagtggggctgctctataatacacttacaattgatactaacgataaaacgctctaattatagttttaattttataggggtttttttggtgactttccccaaataaaacaaaatcaagacgcccaagtccagacacacaagagggcagacgtatataagataacaaattgctactacatagcgattatttatcttttgattatttttgagacttctggcaaagtaggactataataaattttcagaaaagatctgctcttctgctaagtaacagcacacttcaaaatgtccagaaattttatgctaatattacatagaaaacttgacagatgaaaaaagtgaaacacattactaattttattcattaaaacaggtatataaaagtcctctttaactacctaatgaatgtgtcatatcctaatatagggagtgtcatagtgttcacatctttgaatatataaattatctcaaacagttaaaaaattaaagccagaacagggtacaaaaataagaataaaaataagaaaactttctgttcacaggacgtaacagaatactttaaacactctcaagttataaataaaactttttcattattatttcatgttagacaaaaaacaagtcattttactttaactcattttatcaattttttttttttaa

SEQ ID NO: 13182 - DNA, 37875 bp, Human
atggcaagggaggagcaggggggggttggagccgatccccctgccgcagatcacgcagtggccacaattacctgcatccagaccccttctgagcctaatcttgcctctgaccaacccaggaaggaaagattccttggaggttaagaacccagggagaaggaaattcttgcatcaaggaacacagaataatagcaatgatccattccaaagaaaggcaccctagttccaatgactttgggctctgaaattggacttgtcctgcgttctcatcccagtttctctctctcaagctgtgtgcccttgaagaagccaccctcaatgttcccaggcctccactttgtcatctgaaaacaaatttttcttaatgacatgagtagtaatactgtacaagggccaaggctgttttgttctctattgtatcgcagcatcagggacagtgcctggcacttagtaggtaggccctgagtgctgttgtttgaatggagagccagttgtgccccagggcaggtgctgcaggctgcaactccagctcagtgaattcaatcctctgagccctttcagcatcacggtgttgattcttcaaaggatggatgaaagatttgaaggggaatttcccagctgaaaggattgaaaaagagtgaagtgaaatttctttctctttctttctttctttttttttttttttttgagacaaggttttgctctgtctcccaggctcgaatctagttgcttgatcatggctgactgcagcctcaaactcctgtgctcaagagatcctcccacctcagactccagagtacctggggctacaagcatgtgctaccacgcctggctaattaaaaaaaaaattttttttttgtagagatggggtctcacaatattgttgcccagctcgtctcaaactcctgggctcaagtgattcttccgcctcggcctcccaaagtgctgggatgacaggcatgaaccaccgcgcctagtcgaaatttcttgtcttgaccaagtgaagtcaaagtaagctcctaaggctgtttcctcatctgtaaaatagggataataagcgtaactcacagagctggtcgctctggggagtaaatgcgataacgtctgtgacgtgcttgcttggaaccggacctggcacacagtaagtgctcaataaacgttcattcaaggtgaggagtggggacggcttggaggagcccggggtcctcccagcagcctgggggagtcgggtccagctctctgccgccgggaggggcgtggccaacccagagggacgtggtccaggcttcaaggctggaccaatgggggcgccgaagggcgtggccctacccggcatgggcgtgacctcgttgggtgggaggggccaggcgctgtgggagcctccgggaagaagatgctcgggccagcagccaccgccagccccgtcgccgccgccgcccgcgcccgccgccccccgggcccccactagcggccgcctccgcctcccactccggccacgctcctccggccccccaccccgagcagggtctggggggctcggccctcttgccccagggagccaagaagaagcggggagtcccgtccccccagtggcgcgtccagtccccagcctctgtggtcccaggagagaccccacctctcagttctttcccggccctatcggagacccccctcggccctgccatcctgctcacggccgctctccaggctctgtcagccccccgagaaccggctcccccctacccccgccttccctctccggggctccccctcccccatccctccaccgccccctccccctcccacctcccctcccctccccctcccccgccccccgccccccgcccccccccaccatgaggatgatggccgccggcgcggtgcacggcctcttcacggcctccgcggccccgcagccgccgccgcccccgccgccgccgccgccgcaaccccagcctccccagcagccgtcgccgccgccacagcagccgccgccgccgccgccgcagccgccgcagcagcagcagccgccgccccaggccccccccatggagcccgaggccccggattcccgcaagaggcccctcgaaacgccccccgaggtggtctgcaccaagcgcagcaacacgggaggtgagaaagggctgcggctcggggcgggggagcgggcagggggcctcgcctttctccatcctttccccccctcccgtggcaggtgcaagggctctggggaggggagagacacccctccccgaggcgggggacagagcggggagttgaggagggggctggaccccctcctcctctcgctgaggcccggggctgggagctttgtctgcgaggagaggggtgggggggagggggtgataagtgtccttggggggcgcagaagatggggggcgtgggagcctcagggcaggtgtctgtgtgtccttgaggggtgtgtgatgtgaccctttcggagcaggggtgttccccgagctcgcgtgtcctggctgggggaggggaaggagtagaggcctgtggaccgggagcttcccagcctccctccctggggatgtcctgaacaagggttgtcccagatggaggcttgtgtggccctggccggatcgtgcgtggggacaggctgggtaggtgtgtggggtgaaatggaggaaatggtgggtgtgtaaagctaggtgggagaatgtgaggctaggacaggtgtgtatgtgtgtgcgtgtgtgtgtatgtgtgccctctacagcctggatgtgtgacattagggatcaggaatatgacagcataggggggtgtatgagaaagacaggggacaggggctgggctccatgtttgagaccctccagcgggtacgtgtgacaaggaaaggtgtgtgcttgtcacccccaagggggctgtggcagagtgtgacacatgagagggtgtgtgtgacatgcaaggaggtgtgtgggggacaccgaatgggctggctctgggtgtcagccagaagaggccgtgtagatcagaggaaaggggtccagtgtgtgtgacacaggcgtggctggtgaggggatgtgacaagaaaagggtgtgggtgtgactccagagaggctgtggctgggtgtgacacatggaggtgtgcaacagtgacatcagagggggtgtgtgcaacagggaaggtgggtgtatgacgagggagaggctggggcttgtgggtgaaacgcacgagggtgtgtaaaaaggagaaggaaggatgggtccccatgtgacagggcacgtgtgcatatgacacccagctgtgtgtatgggtgtaacaaggagaggtgtgtgtgtgaaatggctgagtgtgtgacaccagagatatggggatgattctgcatgtgtttgacaagggaggctgtgtgtgtgtccgtgtgtattggagattgccgaatgtttgacaccacggaaggcagtgtgagggaagagaggggctctccctgggtgtgtgacccaaggaggtgtgtgtaccagagaagaaaagccgagctgggaactctaggtgcatgccctgccgtggggggctcagggaagaggtggggttttttggggtcctcagagccctgtcctctagctccctggtaggagggagaccccgcagcggacaagcccctccccgcggtcaccttgccaaaatctccacttcctctggccttttcctccggatgggagagggatggcttcaggcagagtgcaccctttcctctccgccaggcctggcagtgggtggggtgggggcctcctacctcctccctacagatgaatacaagccgactttcttcctcccatcctagccctcccccacctccatccaggtgggacaggaatcagggaccccctggatgcctgtgagggtgtccagcagaaattggaggaaagggaagttgggggaggggatgggagggagtttcctgtccttcttcctgctcccccacccccagcacacacatgaatatgtccccgacttccttccctccttcctgccccactgctgttcccagtcctggagaggtcagggacccaggaggtccctgagcccagccagactgtctagccctccaccaccgtcctccagagggtagggggttcccacctttctctacagggactgagatgcttagaatctgatcacttctcagcacaacttaacactgatgccactgctgctaataacagtcacatctgcctacttggcacctactactctgagatatgggttaatatctcagtacaacccctgggagacatgatttgagcatctttttacagatgaggaaaactgaggctcagcaaaatgaaaccgcttgcccaaggtcacacggtttctaagtgatggagctagaatttacccaaccctaggctgcctggttccggagctcctggacgtaacctctgtgctatcctgcctccctccacagcggggaaactaggatgagcctttagggaccatctcctccagactgtctcccaccccgcttctgtttactcatggggaaactgaggccgggagatgcagagggacaggcctccattgacagaaacacactcaggggcagggctgggcaagggtccaggactttgatcccaaaattgagggcttctttcaataatatacattcatagctgggggatgctgggccaacccatccccttttctgagcctcagtgtcctcatctgccaagtgggcacataaaaatgaccataaggggctgggcacagtagctcatgcctgtaatcccagcactttgataggctgaggcgggtggatcatttgaggtcaggagttcaagaacagcttggccaacatggtgagaccccatctctactaaaaatacacaaattatcggggcatggtggtgggcgcctatagtccgagctactcaggaggttgaggcaggagaatcgcttgaatccaggaggtggaggttttagtgagccgagatcgcaccaccacactccagcctgggcaacagagcgaaacgccatctcaaaaaaaaaaaaaccaacaaaaaacacaaggataatactaacaatagctacctatattattgtttaatgtcttacgtgcaatttcatatcactctcccaacatgctatgatggaataataataatcagttataataatggctagacttacgatactgcagtatgccaggaactatcatgggaagtgcttgacatggatcaattccttaatccttacaacaattctatcatgttaacccatgttacagatgaaaaactgaggcacagagaggttaagtcacttgcccaacgtcactcagctgataagcagcagaaccatgatgtgaacttaggcggctggctccattgtgtggggagacactagaatggaccctatttttagatggggaaactgaggctcagagggcttttcctgggtgtcccagcaagcagtggcctactggacagatgagattcttgccccactcctgcccgcttctgggagcagatgggagaagtggaggagatggtggcagttcacacttgcttctgggcactgtgagtggctggcagatgccgctgggaggaaaacaaggcactaagggcaggaagacttgggtgaagaggttggacggaaactctagtcagggactccttgcagaaataaatgaccccagtctggcaggacaataacaaacagtggcccccttgatacagatcgtaactcttaagctgcaacaataatgacccctgtactcctgactatattcccacctctgtcaacccccccaaaataaaaacccatatacagacatacatacatatctcacaccctcaacgtagcttacaccagccagatcttgctcctaacatccctcttttttttttttttttttttttttttttctgagacagggtctcactctgtcacccaggcttggagtgtagtggtgcagtcatggctcactgcaaccttgacctctcaggatcaggtgatgctcccatctcagtttccccagtagctggaactacaggtgtgcaccaccaagcctgactaattctttgaatttttttgtagagacagggtcttgctatgttgcccaggctggtctcaaattcttgatctcaggtgatccacccacttcatcctctcaaggtgctgggattacaggtgtgagccaccattcccagccacatccctcattctttgttttttgttgttgttgtttattttgttttgttttgttctgtttttctgagacagagtctcgctgtatcgcccgggctggagtgcagtggtgccatctcagctcactgcaacctccacctcctgagttcaagcaattctcgtacctcagcctcccaagtagctgggattacaggcatgtgccaccacgcctggctaacttctgtatttttagtagagatggggtttcatcatgttgaccaggctgatctcgaacccctgacctcaggtgatctacccacctaggcctcctaaagtgctgggattacaggcgtgagccagcacgcccggccacattctttatcacgaagtcaacatcaccaggttaagagcccctcctagaatgagctctttcaggattcatatcttgccaccgtcatgtgcttggtgtggaatcctcaggcgagttatttcactactctgagcctcagcctgcttgtctgaaacatggaggcaggaagatctacctctctgggttttgtgcattagatgagattgcatatgtgaagcacatagcgtaaggctggtagatggtaagtgctcagtaaacagtcgctatcatcatcatcatcatcattattattatataagtgtatgtcattttcccttttcaccatccaccatccaatggtgattcactccaagaaaaccgtggcccatctgcctttctttcacttagagaccgtcacaactcaaggcagcatcacacctttcagcatctcatccctacataagcacactctagttgtattgcatttcacaccaaataggcaacaccgccattcacagaaacacatcacatgcctgaagtcccacccctcctcggcagtactgctcccaccccacaccctctctgccagcagcatccccacaggctcccgatgacaacaccgatgtcaaaccccagcctcctcgtaccctcatagaacatgccagctctcccttccccagcccccaaacaaaaccatgaggtgccatgaggacaacacccaacattgatgttgcatctggacacactaacaccaaaaacaacacctcaacaacccacaccccttcagctttacctttgtcattcatgacccccaagatcaaagccaccttagagggtgaactctctgacactaaaataggccactcttactacaacaccccaaatctcttgggtaggcaattgttatttatggaagggggaagggagtattggctgattttttttttttcttttttgagatggagccctgctgtgtgaccccggctggagtgcagtggcgcaatctcggctcattgcaacctccgcctcccaggttcaagtgattctcctgcctcagcctcccaagtagctgagattaaaggcgtgccacaaccatgcccggctaacttttgtatttttagtagagacagggtttcaccttgtcggccaggctggtctcaaactcctaacctcaggtgacctgcccacctcggcctcccaaagtgctgggatttttgaaagccgtcagaagcatccctgagggggtggatacaaaaggagcaagagcagagactcagtgactagaaggggaaagacggcacctttccaaggtggaaatgtttgaaattgcagcaggaaattagtcaggagacctgaacttgctatcttcagttcttcagactcttacatcgggtagagggagctgcctggactcaagggaagagtgaagagtgggatgggaatgggtgggtgcggagttctggcatgtagattctgcctcactacaagggagaactttctcacaagcagtgccttggttgttcaaacagggtgggcgtgcgtaatggctgagggctccgagttcagctgaggtcacgtgtctgcccttgctgtgaggaaggctggtcaatagagacctggtttctttctggggaggtaggactcacatggtgggaaacttccccaaacagaaaagatgtgcataaaattctgggaaggaccagcacagactgatgctcacaacggggactcctgggaattcaagtgctgagtctctacaggtgggaggtcttagccaatcactgttcataggagactcactagaagagggggctccaggcgtcagatttgcactagtctgatacagggaccgtcaagccacccacaagatgatttaaggtggtccatggacaaacttttttttcatttttgaacattgtatgtttatattaatgtatgttagggagaacaaaaacaaccagcccttcaagctccaattgttagcaacgatttttaaatttcttcttaatttttttttatttgagacggagtttcgctcttgttgcccaggctggagtgcagtggcaccatctcagctcactgcaacctccgcctcccgggttcaagcaattcttctgcttcagcctcccaagtagctgggattacaggcatgtgcctccacgtctggctaattttttgtatttagtagagacggggttttaccatgttggtcaggctggtctcgaacttctgacctcaggtgatccatctgcttcggcctcccaaagtgctagaattacaggtgtgagccaccacacccggcctaatttcttctttaaatggatgcatttaggccaggcgcggtggctcatgcctgtaatcccagaactttggaaggctaaggtgagcagatcccttgagcccaggagttcaagaccagcctgggcaacatggtgaaaccccgtctctactaaaaatacaataaataaataagtaaataaatgcatttaaaatttaaaaggaatttaaaggaaagggaccttgtctgttccctgctgcatccccagcacctgaaccaaggactggaaggtcatgggtgctcaggaaggatttgttggaggaagggaaggaagaaggagagaaaaagagaagaaagaacaattccagtacagaaggacataaaaggggcaaaattctagaaggtggcatgagaaagacaggaattagagagaggctgagtgcagagaatggagacaaggtctggcttgtatcagtgagaggacattcctcctccaagaaggagggaaaagtttgggacagccccctagggaaatgggtgattaacaaagtaggatcacccctcctcctacctctcaacccaacccccaaaccccacgtatagggtgcttgctctgtgtctgatgctgtgataagcactgaacttgtgttcatggtgtaggcaatgctgataatgatgatatctaacatttctcaaatcttctatgtgcctgggaccatccgaagtacctttccttacatttcctcatttcattaatcacagtaaccccatgaagtagcactatcatgattcccattgtatagatgaggaaagctgaggcccaaagaggtgaggagacttgcccaagggcatagagcccatcagtggcaaaatgcacttttttttttttttgagacacagtctcactctgtcacccaggctggagtgcagtgacgcgatctcagctcactgcaacctctgcctcctgggttcaaacgactctcctgccccagcctcccgagtagctgggagtacaggaatgtgccactaggcctgactaatttttgtagttttagtggagacgggagtttcaccatgttggccaggctggtctcgaactcatgaccttaagtgatccacccgccttggcctcccaaaacactaggattacaggcgtgagccactgcgctcgaccacaaacgtcactcttagtctagagttgcttctgctgtttcatacaaaaattctcagggacagtttaaagaagtacaagagagagggggcagaagatggggaagagggtgaccccagttttcttcagagaaaatgaataccttccaccctcagagggaagcagggaagatgctctggctgggagagaagatggggagtgaaattgaagaagcagagagaggacggagtcctagggattagtgagaattccctccccatctttctgagccttctggagataaaggaccccttatctgtgacaagtttagggtgagggtggggaagaggacatatccgtgagtccatggaagagaatgaattcagtaggggtcaggatgattggtaggaaggcaccagagaggggttaattacctaataggcttaatggtctgattaagcaagtttaagaggattgccttggtgtcaggaaactccttaattctggacccttccccatgcctgcaaagccacatctagcccctcttaccacacccccatcttacacacataagggaacacagaactttcatcttaagaggccaggcagaggccaggcatggtgactcacgcctgtaatcccaacacttttggaggcccaggcagttggatcccttgagctcaggagttcgagaccagcctgagcaacatggcaaaactccatctctacaaaaaattttaaaattacctaggagtggtggcatgtgcctgtagtcccagctacttgggaggccgaggcaggaggatcacttgagcccaggaggtcgaggcagcagtgagctgtgatggcaccactgtattccagcctgggcaacagagaaagagaaagagagagagagagagagagagagagagagagagatcagagagtgttagagcagtttctcttttatctgttctgtatgttgaggttttacgtgagacattgaaaataggcttcctggctgggctctgtggctcacccctgtaatctcagcacatgttagcctggctaacatggtgaaaccccatctctactaaaaatacacacacacacacacacacacacacacacacacacacacacacacacacaaattagccgggcatggttgtgggcacctgtaatcccagctactccgcaggctgaggcagaagaatcgcttgaacccgggaggcggaggttgcagtgagccgagattgcgccattgcactgcagcctgggtgacaagagcgagattgtctcaaaaaaaaaaaaaaaaagaaaaagaaaaagaaaaaaagaaaataggcttcctttgcttaaaagttgaaaaaccattgggggatggtttaagaccttaaaatttggaagcaggatggcctaactcctccctttcttttcccagtgcttattgcaaacctagtatgtgctgttcaagttttggggacactgttcaagtccctaggacatgggtgagctctatggatgtgatccacagtggacctctgtgatcagttactctgaaggcatgaaacggggattcatcctatctttggggttcaaggaaagcttccaagaagaagaaacatttgagtgagaacctaaaggacaaaagatattgactgagggggcccgggcgcggtggctcacgcttgtaatcccagcactttgggaggccgaggagggcagatcacgaggccaggtgacccagaccatcctggccaaaatggtgaaaccccgtctctactaaaaatacaaaaattagctgggcgtggtggtgggcacctgtagtcccagctactcgggaggctgaggcaggagaatggcgtgaatcggagaggcggagcgtgcagtgagccgagatcgcgccactgcactccagcctgggcgacagagcgagactctgtctcaaaagaaaaaaaaaaagaaactgactgaggggaagagaagctgccaggcacagagcatgcacaaaagccctaaggtgggaaggagcagggcacgtttaaggaacaaaatatgcactgagcctgaggctcacggaggaagatgaggaagtgaagctggaaaggtgggtggggccaagtcacaaagggtcgccaggctggagtggagtgcagtggcgcgatctcggctcactgcaagttctgcctcctgggttcaagcgattctcctgcctcagcctcccgagtagctgggactacaggcacgcgccaccacacccggcgaatttttgtacttttagtagagacggagtttcactatgttggccaggatggtatccgtctcttgacctcgtgatctgcccgcctccgcctccgccttccacagtgctgggattacaggcgtgagctaccgctcccggccgcaaagggtcttcttatactgagaagtgtccagaatttccatcctggaggcacgtaggggcaacgggcaggggaggctagatgcttgccttgagactacattaacaaaatgcttttcacatggtcaaaaaaactggtttataataagcaaggtgcggtggctcacgcctgtaatcccagcactttgggaggccgaggtgggcggatcacttgaaatcaggagtttgagaccagcctgaccaacatggcgaaaccccgtctctacgaaaaatacaaaaaattagccacgtgtggtggcgggcgcctgtagtcccagctactcggaagtctgaggcaggggaaccccttacacccgggaggtggaggttgcagtgaaccgagactgcaccactgcactccagcctgggcaatagagcaaggccgtatctcaggaaaaacaaaaaaagaaaaagaaagaaagaaaaggaaaagaaaaattggcctataacaaagaatggccaaaactccacaagctgccgctggcactgcatctaggtcttcgaggctgtccttcatcgtgttggtccccccaggagtggagggtgttaagcaatgatgggaggagactgaatcagaattggatttgaatctgagcccagtagctgtgttcgtgtccttgggctggtgatgaccgtgggctggtaccttcacttctctgtgcccctctgtgcctcagtttcctcttgtgtaaaaatggagctcattccacccgcctcaccgggaggttgtgaggaacggacgagatcaagctcacaaagcactcagcacagcgcctgatcaaaagtgagtgttcggagcatccccagcgtccggccttcctctgcctccccgctcaccgcttccacctgtcagaccgccgtcacctcctgcctggaccattgcagtcgccacctcactgggcccccacctctcccaccgttgcttctcacggtctgctcccctcatgggcatcagaggaatcctcctaaaacctaagtcaggccacatccctcccatggctccatctcacttggggtaaaagttaaggacctcactgtggcctgcgagccccatcacccctcaccaccagcacccctctctgtcctcatctcctcccattcttcccctctctcattcagccccaggcacaggggcctccttagtccctctggaagagcacaggcacagtcccacttcagggcctttgcactcactcgtccttcacatagccatgtggttccgttccttcctccatatcctgatgatcataatagttcagagcatggactccaaatctcagctctgccacctacaagtgtccttgggtgatttcttcacctttgtttcctcatctgtatgatgggttccttcataggataagtgtgaaaattcaaaggactggtatttggaaagtacttagaacagtatagcacctatcaggtgctgcaaaagtgtgtgatgatgaataaagcctgccacattcttaggaagagcttccctggcctccctctctgacactgcagcctcccaccctccctgacccccttttcctgccttttttgtgtcatcaggagtcccaccatctgacatgaaatatactgtctgtcttccccacctagaagaatgtagctagctgtgcgagctcttggctgaatcactaaaactctttcggccttatttgcctcatttgcccacaaatcggggagctttgtctattttcttcttggctgtttccctagaccagtgccaggcacgtagcaggtgctcaataactatttgttgaatgaatgagtgaatgaagatcattatttgtattattctccatactgctactgtgacccctggggtttcctctgctcaccccctccaaaggtgaagacccctcccccgctgactcccctccaccctgtgtgcccccgcagaggaaggcgaatacttcctgaaggtgctgatccccagctacgcggcgggctccatcattggcaagggcgggcagaccatcgtgcagctgcagaaggagaccggagccaccatcaagctctccaagtccaaagacttctaccccggtgagccccggcccaggtctctgccctaggccccccgcccttcctccctttctccctcccacctgggccctagatgagggggaaggtctgccctaaggacagtgacagtggtggggagggggcctccccttcccctaaggggacagagctgcccccagcccgaggggcctggccgagcagatgggggtgggggcagggcaagacaacgggcctgctgcatattcatgagctcatttgcatgatgcgctggcagatgtgtcttttcccacacacctgccccctctggtcagttggaggagcgagggtggggagggaggcaggtgtcagggcgtccctccgggcttgggggccagccagccatgttccacacacttgctcccccctttggaattctgtcaccccctcttgcccagtctcactggttttctctgtctcggtgtcattctttatgtgtctccctctcattctgtttctgacttctcgtctcttgctcccctctgcctccctctgtctcttgcccctctgtctgcctctctgtccatctctctggttctgtttggataccccccatctcttgtcctcttcatctgtcctctgctttccctgtccctcccctcatctttccttctccttttgtcttcctgtctctctccccatcctttccttccctccacctctcatagtctcacgtttttcctttcctcctctctctctctgaactctgttcaatcatccattcaaccagtatctactagccccctctcactgaggtcctcctctgcgggcgtcacacatttctttctgcctctcccttcctgtgtctcttttttcctaagtctcagctccctcctggttttttcttcccttcctccaaacccagtcccttttctgcctctccccctgctccatccttctcccccaaccatacattttccaaggcccctccactctctctattccctccaaagtctctcacctctccctatctccctcccaagaccaatgcccgacaagcatcgacatctaggactccagggaaggcctcctgaattgcatctttggtccagtgctggttctagttcatccttaatccccttggattttttaggtcaaacaccagagctggagcccagggtcagtacgcactcattttctctctctctctttctctctctctctctctctctccctctctgtctctctctctctccccaccccgtctctcctctctcctatctttccctctctcctccctctttctctctcattctctctctgctctatcttctctcctcttctctctctctctctctccaccatccaccccgcccccagcctcccatctcactaagcagctttggcaagaggtttagagaaaaatcgagtgaaccaggcacacctcctccttttctcttccaccctggcccagttttccccactcccctgtagcccacaagatatggataagacctctgttcggaatgttcctccgaggacacttggttccttgctcctggatcacattctgtgccacgagacatgtcgtcccctcccagcccattgacacaccccacaggccaggcagctgggaaacccagaaggcgggacagacattggtcctaccaggtcaaacagtattcagacaagcaacaggagccagcgtctctcctcagcccctggacatgtggtcagcccccatccccactcctggcgtgcaacttccagatcatacagcatgagccggctgctgactcagagaagcaggacacagccccctacatcctagtcctacatcccacaggaatgtaggaaaatggaaaagctactgcaggagacaaaaaacacttccctccactcctggcgtgacaccctgtcattcattcattcactcattcattcaacacacattctctgagcacttcctctatgccagcccggtgccagacagaaatggggacaatagcagtggctgaaatgtcccagccttgcttccttggttctcacatcccagtcagggaagcagacgtcacaccagtgatgacccagagtggtcagggctgggacaggaagtccagaggttggtagttggagcccaagtggcacaaaggacccagcccagggaggtcaggaagagcttcctggaagagacgaccagagcagtagggaaggatgagcgaggtaaagtgcagggaagtgtgcccaggaagacaaaatggcatactcggaggctgctgagcagtttggtcaatgtagccaaagcagacagaacatgtgagaaatgacagtggagaaactgaaagggcactctgggcctagtaggttagcatgcacacacactcacactctcacatgcacactcacacacagtctcacacgctcacactcacacacgctgacacgcacactgtcatgctcacacacactcattcacactcacaccctcacacccacacacacgcttacacacagtcacacacactgtcacacattgtcacacatgcttacacacactcacactcattcacacacatcccactcacacacacgcttacacacacattgtcacacgtgctctcacactcattcacactcacacacaccccactcacacacatgctcccacacacacacactctcacacacacacacacacacagcacttgggtgtctactacatgaaataaaaacctacctggcacttaactccaagagaagggcagaacacacaacctcccctcctttgtggtggatcccaaagccctagattcaatccatccaggtcatacatggagcaactgaaatgcagaaaaaggcaagcacctgcgcaagggccacacagactcccttgcgtcagcccagatccaccctgaggattctattttttttttttttttttttttgagacggagtcttgctctgtcaccaggctggagtgcagtggcgtgatctcggctcactgcaacccctgcctcctgggtccaagcgagtcccctgcctcagcctcccgagtagctgggactacaggcatgtgccactatgcccaactaatttttttatttttatgtttttgtattttagtagagacagggtttcaccatattggccaggatggtcttgatctcctgacctcgcgatccacccgcctcggcctcccaaagtgctaggcttgagccaccgcgaccggccaccctagggattctaaaacaccgtctgatgttgaacatctgcttgaagctttataccctaactgctgaagaaaagcacagacacacacacactttttattttgtatttatttatttatattgaggcagggtcttcctctgttacccaggctggagtgcagtggcacgatcgtggctcgctgcaacctcaacctcctgggctcaggtgattctcccacctcagcctcctgagtaactggaactacaggtgtgcaccaccaggcccagctacttttttttttttttttagacagagattcgctgttgttgcccaggctggagtgcagtggtgagatctcggctcactgcaacctccgcctcccaggttcaagcgattctcctgtctcagcctcccgagtagctgggatcacaggcgtccattaccatgcccagctaattttttgtattttcagtagagacagggtttcaccatgttagcaggctggtctcggactccagacctcaggtgatccacccgcctcggcctcccaaagtgctgggattacaggcgtgagccactgcacctggcctgtatatttttttttgtagagatggggtctcgctatattgcccaggctgaactcctgagctcaagccctccatccaccttggcctcctaaagtgatgggattgcaggcatgagccactgtgtcccaccacacacacttcaaaaaacatttttatagttttataacatacctctatcaacgtgcatactcttgaatgactacttaatacattcatattctttttaatatcaaaaatacaaaaataaaactgtcatcattttatgcctccctccaagatacacacatagagctgatcactccatgcaccccaaatttagcagaatgcacagactctgaagccagacacctgggttcaaatctctgaacatccactaccatctaagagaacttgaacacatcttgagccctctctgtgcctcggcgtccttagcagggaatcagggacaataataatattgcctacttcatatattaagtgaacacgtatgtataaagtgctttggtcaggtgcgatggctcacatctgtaatcccagcactttgggagaccgaggcgggtggatcacttgaggccagactggccagcatggtgaaatcccatctctacaaaaaatgcaaaacttagacgggcgtggtggcacacgcctgtaatcccagctactcaggaggcttaggcatgagaatcacttgaactgggaggcagaggttgccgtgatctgagatcgcaccgctgcactccagcctgggcgacagaatgagactcttgtctcagggaaaaaaaaaaaagtgcttagaatggtgcctgaggcttgggttgtataagggtcagctattattagacactcttgtggggcttaaccaacctccccaaaagcccctgtgggcccccttgtaaaaactacaaggggatggaaggtcaaagacttcctgagttggaaggaagcttcacagagaggcaaaccctcggccagctcttcctggggcatccacctccccctaccccgccccccagttcccaccccaacccacaccctttcctatttacaccagacggaggcagactgcaggctgactcacccttggctcagaccaagccattgttctggggtggggaagggggggtagtaagagtgaggaacatggcccaaagcgggtgggggatgtcagctacacaagtgacccacagacagtgacgcccagacacatggcgaggctggcctgccagactgggaaatggcaattgaggagtcagggtcgtgtcaccagcgtgctgcactgaagtgcttgctggacactgacacacaccccaggtatcccagacacacaggtacacagccacacggtgcctggtgcacactcaagacactttttgttttttttcttttttttgttttttttttgagacggagtcccgctctgccgccaggctggagtgcagtagcatgatctcggctcactgcaacctccgcctcccaggttcaagcgattctcctgtctcagcctcccgtgtagctgggactacaggtgcgtgccaccacgcccagctaattcttgtatttttagtagaaacagggtttcaccatgttgcccaggatggtctcgatctcttgacctcatgatctgcccacctcggcctcccaaagtgctggggtttcaagcgtgagccaccgcacccggccacactcaagaccttttacattctcaggggcagaatccccttcaaagagagagagacacactcacactccacgcatcacacacatcccggctcacccaggcacgcacattctcacactgaccagtcaagttttctttgtctcgctgtaattcacatgttcagacacacacatacacaaacacaccagtcatccaaaaagtcctacaaactgacacctgagtctacctgtctgtctctccttctcaggttcacacacactggtcatagggtctttcctgtctcctgtacatatgtgtatattcacactggtcatccaaatagtctcagaaacatccagaagtgtgtctctctttcactttcacaaacacacgtacacacacaaatgcagacacatacactgccatccagtctcaaagtggtatatattcattgtgtagcctctatcccactttgtgagattcttttgtttctttctctcaaactctcacatacactcagctctgtctcacaaagagtctacataaccttcatcatcaaagcgacaccaaagtctgtcccacacacaagggcacgcacgaacatcttcaccggaatcactgtgtcacatagtctgttcataaggcagtctctgcactttatcttctacaaacacagattaggatcatctagctagtcctgctcaagtacacacacacacacacacacacacacacacacacaccactcaccagcctcgcagacacacacactggtcacagtgtcacccagaatctctttcacacacatatcccaataccccccagtttctctctcccccgtgcccccactccctaacactctcatgcagaaatgagaaggatgcccaggacagagccacagccagtatctggagaatctccaggaaagaccctccctccccagttccttggtcctcactcctccatgagcagtctttgacccaccctgctctcccctgtccacacccctgccctcccccacccctcagccctccatctggtgggttcagacaggcactcaggcctctcctctgcctcccccatcccccagctcttcccccatcctctccaaaaagcccagaggccaacgctgcaggctttcaggggttgccatgacaacagggcctcgtccctcgtccccctgggggtgggctgaggacccggccagccagaccgataagggggttccagttactgtggcaaccgttgcaggcctgagctctctgcttccagaaggggaggggggcggagtgagtgaatggttgccaaagcaaccagggaaccgcaagaactgagaagaggcagctgagccctgtctcccctgcccagggctgctgtgggcatcgcaaaacatttaagcatcattcttccatccctagaggttgttttaggggagggagatgaagtgcagattataaaacaggatggcactcattctcccagctgcccatcatggcctgccagcccatgcccgctcccccaggctcaccgtgtgatcagtcaggtccactctctggacctcagcttgcctcttccattaaatggggcctgtctctcaggaatgttcccattcctgtctcatgagtgtgccctctctctcccttgctcaacaggaaccacagagcgggtatgcctagtacagggcacggcagaggccttgaatgctgtgcacagctttattgccgagaaggtccgagaaatcccacaagcgatgaccaagcctgaggtggtcaacatccttcaaccccaaaccacgatgaaccccgacagagccaagcaggtcagctggggcagagactgggttgctgtaaagctgttgacattcacaaagaaacattcctcccacatcactgcttactgtgaggttcaatgggacaaagctgataaaaatctcatcagtcaaagaccacatggtagtggttagtattatttttagggagtcagctctaatagaatagaaaggactccagaacatttagagtgggcttgattcagagagggagtgaaggtctgggagaatgtggcatgattccctattgttcgatcctttcttcctaggattctctagttcctcttctctcttccacctcatcccattgtctctctgaacgacctgcctcccacttcctgctatcaccggaagtgacctcagtgacagttcagccacatccagaagagtttacaaatggcctctcatcctccttccctccataattaacgtatgggggtagaggtggtgtttcattagcgagagaagaggtgggtccctctcctacacagccctctccaggaaggaatggaagggggaaggcagcgcccctccgttgcctcagttacggggaagcagtggcataggggcgtggcagggagtggccaatcgcttcccgggcctgtccggttgccatgacgacggcgctcacggggcaggtgggctcccctcaaagctgcaggcagcgctgtccggacccggaagtgcgtaagggaacggaaacgcggggctggctcccgttttctctcccgtccccactcccctatgcatgcgtactccgtgcaatggggcgagaacccctgggctgacgggagggccccttgcgagggctcgttaacgtctacctagaggcaaagacaggagagagggagtccgtaaaatctggaattcttgggtcctgtcgttgccctgaggtggggcagagcacaggcctgagttcccctaagctcatggggaaatggtgggcggagaagcctggaggagagctgcagggtggagcgctcccaaaaaagaccgcagggcttggggcgtgtagcgcggacgctgtccttggtgctgaagctcctcgctccccgccaggtttctcccgaatcccttcccaccagcagcgcacaagttattcacagtttacagggaggcgagggcattgcctcttccctccgccttggtcgtggccacaagggactcagggttcatcaggagtttgtgaatgttgcaaggaaaatggggtcagcaccatctgtgcctgagccttctaccccctccccctaatccacaggagctctgagacagtggagtcgaaaggttatagaaccaggatttattccctgccttattactcgagtgttccaaagactgagggagatcatagctgaaaactcaggctctgggctctgttgtttagttgaatccttctccgtacagtacttacgtcctatgtgaccttgagcaagtgactttgatttctccaatcctcatttttctcacctgtaaaatgagattcattatgatgcctccttaagggtgatggttagtgttcgttgatgtttgaaaagcacatagcttatgtgtataatgcatagaaagttagccccaaaaatgttctctgttgttattatgggatttttgagtcaggaaacaggtctacttcttttctgccttggacttgcagtgttactcagagcccctttccttctgtagacctcagtttctcttttattacagtgcagcagctgggccaaaccagggattataaattaaataactaaagtattgaaaaaggtaacaaaagccttgagggttgttgctctctggagagggtatgccatctttaaagggagaagctgccactcaaatccaccgaattattgcactttgggaacatgaacatagtgctaccacatcttccaaatttttcaaaagaagccataaattttttagatcaactgactttaaaatgctttattattattattatttaatatatattagtctgaggcagagtcacactctgtcacccaggctggagtgcagtggtatgatctaggctcactggagcctcgacatcccaggctcaagcgatcctcccacctcagcccactgaatagctgggactacaggtgaacacgaccacgcctggctaatttttttttcttttctttttttttttttgaaacggagttttgctcttgttgcccaggatggagtacaatggcctggtctcagctcactgcaacctacaactcccgggttcaagtgattctcctgccttggcctcccaagtagctgggattacaggcacctgttaccatgcctggctaattttttgtatttttagtagagatggggtttcaccatgttggccaggccagtctcgaattcctgacctcaggtgatctgccttccttggcctcccaaagtgctgggattacaggcatgagacactgcgcccggcccctggctaatttttgtattttttgtagagacaggatttcaccatgttgcgggctgttctctaactcctggactcaagcaatccacccgcctcagctccccaaagtgctgggattacaggcgtgagccattgcgccaggccaactctgcttttaaaacactatgaaggtcaaaaaaacatgtatggctgtaggctgactggggcctgaggatcaccagattgccacttctgggttataccagtggctctcacccctagctgatatctgagtcatctgggtagcttaaaatgcagattcatgggtcctgtccagaaccactgaatcaatatttctggtaaggcttaggaatctgagcataaactctggcccgggatcagatcctgactctactgctcattacctgtgaaagaacttgtgcaagttctttctttgtgcctccatttcccaatctagaaaatggggtaataataacacctatcttagggttgtggtggaacctagataagttactctattaaactgttagctgttgatgctgcttttgttgttattgttggtggtggtagtagtagtatttgcaaatttccatgggcttgcaaatcactggggcagatggtctctggtccttctggctctaaaacttcaacagttctatggctctgtgattccaagattctaagcatgtattatctaagattctactgttctaatgtcctgggattccaagattctatgagtctgcatctgcagatctttctaagatgctgtagttctacaattcagggtctatcatgaaggcagctgccattggcttagcgcttcccatgtgccaggcactgggcatcactttagtcattgaatgtttcccataacaggccgggagcagtggctcatgcctgtaattccaacactttgaaaggccgaggtgggtggatcacctgaggtcaggagttcgagaccagcgtggccaacatggcaaaaccccatctctactaaaaatacaaaaaaattagccgggcatggtggtgcacacctgtagtctcagctattcaggaggctgaggcagaagaatcgcttgaacctgggaggcggaggctgcagtgagccgagatcgcgccactgcactccaacctgggtgacagagcaagactgtaaaaaaaaaaaaaaaaagaatgtttccaataataatatagggtaggtgtggttatgctaatactggagatgagaaaggtaaggcacagagaggtgaaggcatttgcctaaggtcacacagttactaaagaataaactaggaggctggacgtagtggctcatgcctgtaatctcagcaccttgggaagccgaggtgggcggattacttgaggccaggagttcaagaccagcctggccaacatggtgaaaccccatctctactaaaaatacaaaaatcagccagacatggtggcaggcgcctgtaatcccagctaccccagcggctgaggcaggagaatcacttgaacctgagaggcagaggttgcagtgaggcaagatcgcaccactgcactccagcctggctgacagagcaagactttgtctcaaaaaaaaaaaaaaaaaaacaacctacgatttggaccttgctgtgttgtagaaacagcaaccctgctgactgagtgactccagagagcaggcttccagtgtctcactgaatatttgcacaaatcgtatggatcgggaatagtatgcccattttacagatgtggaaaaagaggctctgagaagtaaagggactttcacaggccaccagctaggaggtggaagaggtagaaattttcttaaaacctaactttatttttcccacatgattaaccccttgtcctcaaaccttttcttggccaatctatccttccttcactgctctaaaatactgcatcacagactaaataccactcctggttgtggttgtgaacatgctgttccatcttcttgatttgtcaggctgtttgtttttcctggtgtttttttttttttttttttgaaataacagctctgttgagctataattcacatactgtaagctttactgtttagaagtgtacagtttagtagttttgttgtatgttcacagagtcgtacatcagttaccatctaattccagaacattttcatcatgccaaaaagaaaccttgtgcccatgagcagtcactcaccattcccccagatcccagtctcaacgtcttccagccactaatctacttttggtctctgtggacttgcctattctggatcttttatataaacagaatcatataatatatggtcttttgtgtctagcttttttcacttgatgtaatactttcgaggtttatctatagtttagcatgtgtcaaaactttactcctttttatagacaaataatgtttcattgtatgcatagaccacattttgcttgtctgttcatcagttgatagacatttgggttgtttctcctttttagctatgatgagtaatgcttctgaacattcatgtacaagtctttttgtagatatatatttccagctctcgggtagatacctagggtggaattgttgggacatatgataaatctatgttcaactttttgaagaactgccagactggtttccataatagctgtaccgcagatgtgggatttaaatccagctccatccatggggataacaatgacaataatcatttctttttcttttcttttcttttttctttttttttttttttttgagacagagtctccctccgtcccccaggctggagtgcaatggcgcaatctcggctcactgcaagctccccctcccgggttcacgccattctcctgcctcagcctcccgagtagctgggactacaggcacccgccaccacacctggctaatttttttgtatttttagtagagacggggtttcaccgtgttagccagaatggtcttgatctcctgaccccgtgatccgcccaccttggcctcccaaagttctgggattacaggcatgagcccccacgcccggctgacaataatcatttcttgagtgcttctatggcttatattaattgcacacatacatgatgccctatgcttggcacatagtaggtgctcagcacatgtcacttatttgaatgaataggtgatgacttcacccacagggccaagcagaaacatagggactgaggtgtaatctgccaatggtagcagttgtgagtcacctgaagggcactcactctcagttccagctacttgtggtcatgcttggatttcaagctcaccattacatgcataagctcaattaagcttcatcatagtcctatgaggaggtctgaatatccttgttttacagatgagaaaactgagtctcaaagaggttaggtcccttgcccagcatcagacagggagccaggatttaaacccaagcaggtgactccagagtccaaggcagcttttcagggatttgtatgcacagactgcaaatgggtagcctggctagtacattgcattgtttctactacacaaatcttagacatttttaagagattgccaacatttaaaaactaggatgctggccaggtgtggtggctcaggcctgtaatcccagtactttgggaggctgagacaggcggatcacgaggtcaggagttcaaaacgagcctggctaacatgttaaaaccccatcgctactaaaaatacaaaaattagccgggcgtggtggtgggtgcctgtaatcctagctactcgggaggctgaggcaggagaatcgcttgaaactggaagacggaggttgcagtgagctgagattgcgccactgcactctagcctgggcaaaagagcgaaactccgtctcaaaaaaaagaaaaaaaaaaaactagggtgcttcacattttacaaatcagcatttccaactcatctggaaaatgtccatcaggcttagtttggctgcccaattgcatagtactctaccactccccacccccaccaggtaagatacacctgctgcctccacccattcgccttcctgcttgggcctgtgggcgtgtcatccttcagtcttcatccgtctatttattcgctcaccctttgctgagtatctactgtgttccaggcacttttctaggcgctgagaacccagcagtaataatacaggcaaaaatctctaacctcgtggatttgaaattcttttacagagaaacacaaaataaacaaggagataagtaaaatatagaggatgttagagagtgaaaaatactatgaagaaaaataaagcggagaagaggaaaagggaatgttagggcatagatttttttcctttttattttgaaaatgtttaaggaatagtccccatacactgcacttagattcaccagttgttaacatttgtgcatgcatgaacacatgtgcatgcatgtgtgtacatgcgcgtgcgcacacacaatttttgttgtgatttttttttttttttttttagacggagtcttgctcactcaccaggctggaatgcagtggtgcgatgatctcggctcgctgcaacctccgcctcccaggttcaagcaattctcctgtctcagcctcccaagtagctggaactacaggcgtgtgccaccacgcctggctaatttttgtatttttcatagaaatggggtttcaccatgttagccaggatggtctcgatctcctgacctcgtgatccgcccgccttggcctcccaaagcgctgggattacaggcgtgagccaccgtgcctggctgacctcatgactctttactcctaagtactttaacatgtatcttccaaggacaatctcctacattattgtattactgtcaacacacctaaaaacaaaaacaaacaaacaaaaatgctaattctatactattgtctcattggaaagtccatattcaaattgccctaaaatatcttttatagctatagaggatttttcaatctgagattcagtcaacattcgtgctttgcatttgattgttacacctcattagtctcttttactctagaataaatgaagattcctttttcttgttcacaaggtctggctcgatcacccagactggagtgtagtgatgccattttggctcacttcaacctccacctcttgggctcaagccatcctcccttctcagactcccaagtagctgggactacaggcatgcaccaccacactcagttaatttttgtactttttgtagaaatgaggttttgccatgttgtccaggctgtacaacttgtgagctcaagcgatctgcccacctcagcgtcccaaagtgctgggattacaggcatgagccaccatgcctggcctttttttttttttttttttagatggagtctcactctgtcattcaggctggagggcagtggcatgatctcggctcacttgagaatcacttgaacccaggaggtggaggttgcattgagctgagatgatgccactgcaccatagcctgggtgacagagcaagactgtgtctcaaaaaaaaaaaaaataataataataataataaagtcagggagaccaacagggaatagagcatggggagctctgtcacagcaacaccccctttctcctacaaatattttgtcatgttcacttgactctctgaaatactattcatattcatatatacacatatagacatatctacacccgtaagactttttgacagctttattgagatataattcacatacaactcacccttttaaggtacacggctctaggcccagtatgggggctcatgcctgtaatcccagcactttaggaggccgaggccggaggatcacttgagcccagaagtacaaggctgcagtgagctctgatcacaccactgcactccagcctgggtatcagagcaagaccctatttaaaaaaagagaaacataaaatacatgataaataaagtgtacagttcattggcttttattatagtcacatagttgtacacctattgccacaatccattttcaaacatttgcactgccttcaaaataaatccttttttttttctttctttctttttttagaggcagggtcttgcactgtcacccaggctggagtgtagtggcacctgttatagctcactgcagcctcaaactcctgggctcaagtgatcccttagactcctgagtagctgagacgacaggtgcacaccactgcatccagctaatttatttttattttttgtagagatgaggtttcaccatcttgcccaggttgatctctaattcctgggctcaagcagtctctggcctctgcctcccaaagtgctggattacaggcataagccaccgagcctggcctccaaaagaaatcttgatcatcttagctatgacccctcgatctcccacctcagctcaccctctccctaaccccaagccaccacaaatctactttctgtgtctatagatttgcctattctggacatttctgtaaaaggaatcacacagtatatggtcaaccatcaacactttctaattccagaaagtatctattacccaaaagaaatcctatgcctgtaggcagttacccccaatccccttcctcccattccctggcaaccactaatctacctttttggctctgtggatctgcatattctggacatttatgtaaatgaactcagctgtggtcttttgtaactggcttctttcacttagcataattttttctagattcatccacgctatagcatgtatcagtactttgttcattcaacgtattgccaagtaatattccattgtatggatataccatgttttatttatcccacgagacttttttaaataaagaagaaataaaaggaaggtgatttgttataaaacaagatgaattttattttttgcttctttgttgttgtttttgttttttgttttgttttgtttttgaaacagggtctgctctgttgcccaggctggagtacagtggcacaatcacagctcactgcagcctcaacctcctgggctcaagtgatcctcccacctcagcctcccaagtagctgggaccacaggcagatgccaccacacctggctattttttgtatttttactagagacaggttttcatcatgatgcccaggctggtcttgaactcctgggctcaagtgattcaccctgcctcagcttcccaaagtgccgggattacaggtgtgagtcactgcacccagccaaggtgaattttaatatgtaaataaatagtcaggaccacaatagaaggaataatgaattaggcagctgctcacacctaagcatagctaagtgagacaactacatatgtaaagtgatccagagtataatactggagacttaaataatacaaatgctgttgctactgacgccaggttttctaaaatgatgaaaacttttagtgaagtgcagagcaaaacaaagcacaatctgctcttgatttactggtagttgcgttcctggaaatttcagtagctcttaaaaccatgcaaacaatacttggtacttacatgtgtcatggggttgggctctgagctcagagattttttttattttgttatttttatttacttatttattttgggggggatagggtctcactgtgtcagttgggttctgggctcagagacttttttttttttttgagtcagggtttcactgtgttgcccaggttgaagtgcagtggcacaattacagctcactgtagcctatacctcccaggctcaagtgatcctcccaccttagcctcctgagtagctgggactacaggcatgtgccaccaggccagctaatgtttttaattttttttttgtagagatggggtcatgccatgttacccaggcaggtctacaactcctgggctcaagtgatcctcccaccttggcctcccgaggtgctgggattacaggcgtgagccaccgtgcccagacgtgggctcagagatttaaaaacaggctcttcatcagcatgaatgtccaacaggacattcaaaagtagtcatatagtgtctgggtgcggtggctcacacctgtaatcccagcactttgggaggctgaggtggctggatcacttgaggccaggagttcgagactggcctggccaacatggtgaaaccctgtctctactaaaaatacaaaaaaattagctgggcatggtggtgggcgcctgtaatcccagctactagggaggctgaggtggcagaatcccttgaacccaggaggtggagattgcagtgagccgagatcgcaccactgtgtaccagcctgggtgacacagtgagactccgtctcaaaaaaaaaaaaaaaaagtagacatatagggcctgggacagctctttcttgtgagggactgactctccattgtggggtacagacacctatggtcctccccactgacagtccacatcttcccccagtccttgcaacaaccaaaaccaccacccccacaaatttctcagacacccccagggtttaaggggacatgggaaggatttttgagagggaggaatttatgtgtagaaatgctctcggaggtgcaaaaggacatgactggttttgaaatgtctccacaggaattaagattgatcagacttgcagatgcttggacaaatgggtggttgaaggatggctgctctgcaactgagaaaggagaggtcaccagattcaaatgaccaacttcttcatcctggagagttcccgtcccaggaattagaaggagattgaaatctagattcttgggttcccgatccattgtgtgacatccaagacatccacttacgtctgccttctcagacaaaagccttcatgttatcttcattttacagacaggacaactagattagtctgctagggctgccataacaaagtgccagagactgggtggtctaaacaacaggtatttatatctcatgattctggaggccagaagtccaagatcaaggtgtcagcagggttggtttcttctgaggcctctctcctagaccttcttctccctgtgtcttcacacagtcttccctctgtgtgcatctgtgtcctaatctcctctgcttataaggacaccagtcagtaaattagggcccgccctaatgaccccattttaccttaattatctctttaaagaccctctctccaaatatagtcaaattctaaagtactggaagttacgccttcaacatatgaatttgaaggggacacagtgtcagcccataacaacagagagttcaacgagaagaccatgtctaggggagcacaatggatcaggaacccaagagcctagatttcagctccgtcactaactggggaaccttaggacaagtcctttcacctcttgggcctcaagaggctcatctgtaaagtaaggcttaatgaaggcttttccagggctggaagtcagagtacgtaacactagaaggcatgggtgggccattgtgcaagcttggagtgagatcctggagggccccattggattagccattaagcttttagatgctggacgcagaggaagtactaagagtcccaggtacatgggacagggtggttgaggggctactgaggggacctcaaatactggctattcattaaccaaccattgtggatatatttcaatttttttaaaaaaaattttaatgttagaggcaagatctcgctatgttgcccaggctggtctcaaactcctgggctcaagttatcctcccacctcagcctgtcaaagtgctgggattacaggcctgagccattgcacctgacctgaaatatttcaatatttttaacaaccagttggaccatactggtgcatatcaaaaggccatgctgggcctgattttggatgctggagaggaggggtagggaatgacctggggcgtctcagtctccagccaccgtaaagaccctcccttcgccagtttggtggctcaaatctgtaattccaacactttaggaggctaaggcaggagatcccttgaggccaagagttcaagaccagcctgggcaacatcgcaaggccccatctctactaatatagatagacaaaattatatatatatatatatatattattttattttattttgagacagggtctccctctgtcactcaggctggagtgcaatttggcacgagctcagctcactgcatcctccctctcctgggttcaagcgattctcctgcctcagcctcctgagtagctgggattacaggcatgtgccaacacacagctggctaatttttggatttttactagagacggagtttcaccatgttggccaggctagtctggaactcctgacctcaagtaatctgcctgcctcagccccccaaagtgctgggattacaggcgacagccaccgtgcccagcctaatttaatttaattttttaaaaaaataaaattaaagaccctcccttttgctccccacgcaggccaagctgatcgtccccaacagcacggcgggcctgatcatcggcaagggaggcgccacggtgaaagccgtgatggaacagtcaggagcatgggtgcagctgtcccagaagccggagggcatcaacctgcaggagcgcgtggtgacggtcagcggcgagcccgagcaggtgcacaaggccgtgagcgccatcgtgcagaaggtacaagaagacccccagagcagcagctgcctcaacatcagctacgccaacgtggcaggccccgtggccaactccaaccccaccggctctccgtacgccagccccgcggatgtgctgccagccgcggccgcagcgtcggccgccgccgcctccggcctgctgggccccgccgggctggctggcgtgggggcctttcccgccgcgctgcccgccttctcaggcaccgacctgctggccatcagcacggcgcttaacacgctggcaagttacggctacaacaccaactccctgggcctgggcctcaactcggccgcagcttccggcgtcctggccgccgtggccgccggggccaacccagcagccgccgccgccgccaacctcctggcatcctacgcgggcgaggccggggccgggccagccggaggggccgccccgccgccgcccccgcctcccggagccctggggtcctttgcgttggccgcagccgccaacggctacctcggggccggggcgggcggcggggcgggcggagggggcggcccgctggtggccgctgcagccgcggccggggcggccgggggcttcctgacggcggagaagctggcggctgagagtgccaaggagctggtggagattgcggtgcctgagaacctggtgggagccatcctggggaaggggggcaagacgttggtggagtaccaggagctgacgggcgctcgcatccagatctccaagaagggcgagttcctgccaggcacgcggaaccggcgggtcaccatcacgggcagccccgcggccacgcaagccgctcaatacctcatcagtcagcgggtcacctacgagcagggagtgagggcctcaaacccccagaaagtgggatgaggcctgtggtgtgtgctcccacccttttctctcctcccatctcctcctcttccctctcctcctcccccccaactcctgacctcagcttggtgtagtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgttattttctctttctttccctccttttttttttttttttttttttggtaaggattttttccccctttataagtttttgtttccatatgggaggaggggagggagcctctgggtcacccagaatgaggggccttcccaaaacacaacaccccacctctctgctttcagttctagatctgagggaagccatgggagtagaggtagcagaggcgtctgagctgaaatggggcatttggagcaaggaccccagagttcccagatcttctcagctactctcctcccactggagctgtccctcctaggtgggaatgttcactcttttgttgtcaggttgtatgggggggcagggacagtgctgctgggaaggatgccagctctgggattgggccagtcctgtgggcaagacttgcaagaggctggatcaacttggtgtggtatctctgatggcttagagtaatggcaatgagggtctctgttgtgatgtcactgagtactttctggggtgcttctgggcaccccttatgatgtcacaggaagcagttcctcagaggttacttcctgtgaacataagggagcaggtacttcctgtgatgtctcaatgagttcttccttgaaggtcactttggtgatatcatgggaaggtgtacttccggtgatgcctagaggtcacgtcctgtgatgtcattaggctgaagcatgtacttcctgtattggacagtgaccagtctctgacctgccttctccctccacacccttctttggtgggtgttggcctgggggtcttcctaggaagagaataaggcacgggacttggatccaatctggaggactctaacggaaaaaaaccaatattgtcagggtcatctccattcaaacacgtcaagtctgcgaactcgccctggagggaggggtgggagatggacctagtgcaaactactgttaaagacctcccttcccacccctgccttttgtgtgcatgcctgtgtctgcgtggctttgtttcattgaatcgggtgagccaagtgtgtggtggctctgtcaggccagtatggccaggtgtagagttcagtgagccatagtagggtcccttgggccagaatgcttcgtgtggtctgataggttagattggtttggtggcttccagcaagctggcatacttcggtgatgtctgatggatcagaatgttttggtgtgctcaccaggggctctggagaactagaatgttctgatggagtctgacaagccaggcggccttgagagttggtttaggagtggctccctgagtgctgtggctgtggtcagctctaaggacctgttggcagactgagatttcagggcctgacaaccatgtagactaggatagctgagacctccctctacccccacccatctccctctcttccttggagaccacctccactttctccaacccaaagcagggcgcccagtgccctggttccatcatcagcatctctgggggaggggcgccccatgcccaccctctcccccatttgtccgcctcctaggtcttccaaacccttttcttctctatgactttgggggaaatccagcctccttgtctctctcctaaaaaaggagggaagaaaagccacagagacaattcctgcccctaaagcctaggagatccctctcccttgctagagagccacccccaaatcaaaatgtgaaaatccctagaaagcaatagccttcgaggtaccttgcactgaatttcccaccccagcccttccacccgatgggaggctgtaacttgggcactggggtgactttttccatgcccttgtcatctccagggtgggaggcaggccccacttcccctcccctatcccccacttcccattgttgttgccccacccctaatctccagactgaacccagatggagatctgagtgccaaaacaattcttgatgtaactttgtacatatcttctactaccgttgggggctcttggggttagaggtgggggcggctct

SEQ ID NO: 13183 - DNA, 7883 bp, Human
gccaaaggagctgtcactttatacttataaatttaagaagtgataacactggccaggcaaggtggctcatgcctgtaatcccagcactttgggaggctgaggtgggtggatcacctgagctcaggagttcgagatcagcttggccaacatggcgaaaccccatctctactacaaatacaaaaattagccaggtgtggtggcacatgcctgtaatcccagctacctgggaggctgaggcaggagaatggcttgaacccaggaggtggaggtttacagtgagacaagatcgtgccactgcattccagcctgagtgacagagcgagactctgactcaaaaaaaaaaaaaaaaaaagtgataacacccacttctggggtcggggtgaggaggctccaaaacattactggtgaaaaatatgaattattaatggctttttggggaaaatgatctggtaatattaattaaatatgtatactcattgacctaataactctgtgtttataatttacttataaatgcaccagtgcatagggatatatgtctgaaaatattttgcgtagtgtggagaaaatactggaaaaccttcaaaaactaaaagatccacaatgctgaactgatactatagcatattgtgcaactattataaagaataaattagaattagatgtactgccctggtgagatgcccatgaaatattaggtgacaaaaggtaaattgatgcacatggttttgattttttttttaatgtccttatataagtttgtagggaggagaatacggtttataactctgcaggcagaaagcctgtagccaaaccctggcttcatcacctcctgtatgtgatcatccccccgggcctcagttccgtcaactgtaagaggggttaataataacatggatctggcaagcttgtcgttgagtatatgataatttctgaaaagtgctacagatgcctggtgcacaattcagtaacagcatgagtacaatgtatatgagaaggcagaacacagaagatgaaaacacaccacacaggtcaggcacggtggctcatgcctatagtaatcccagcactctggaacactggcaggtggctcacctgaggtcaggagttcgacaccagccaggccaacatggcaaaaccccgtctctaccaaaaatataaaaattagctgggcgtggtggtgtgcacttgtaatcccagctactcaggaggctgaggcaggagaatcacttgaagccaggaggcggaggttgcagtggcccaagatcgcaccattgcactccagcctgggtgacaagagcaaaactccatctcaaaaaaaaaaaaaaaaaaaaaggaaaatattatttataaaatagaaaattaaaaaaaaaattttaaatacacatttttaaaaaccacttgcaggctctcacacactgcatatccaggattcacatgcaggcagcctggctctagacgcggggctccagtgcctccggtgtctcagcccgtgacttccctgctctcaacctcagtttactccactgtgaaatggacttccagatactcacctcttgagtttgctgcaagcgtaaatggcatcaggcttggacctgggggaaggaagtgtttttaaaatgggtagctttgttacctcagtccttgcggggagaagatgtgccaatgccccgggcctctgcgatgtaagttcctgttgagttgttcaatgttccactgagaggagagacaagcaggaccgggatcccggccccgggtcttccagaaacggcggggcgaagcgcccaggggcctgtgcgtccctccctgctgagcgagggggcctgtcattgccgtgggcgtgacccagaccccaaccacagtgcatcccgccctggcccagccagagaaggaagctgagtctggggtctgctgggccagcaggaagtcccagcagggtgtgaagcaagactttccgggccactcctggaatcccccagcagataaaggcggcccctccaccgggcgctcctagcggtctcccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaagtgagtgtggcaggggggcacgggctggactggggatcccagaggcaaaggtgtgcaagtgcccgccagcgggaccatttctaggcctggtgctgaggccacctggctgacaccctgagcagcttactgaacctcacaaggtcatttcttcctcgggtcaccacgtgggccggggcaggtgctcacagcacaaagatgcgtgagaaggggggatgggctgaaatccaagccccgctcccgctcccgggaagaaggggcaggctttgcctaacacacaccaaggtgtccgcgacgccttatgaaggcgccccttcctgatgcctggtgcctttgttaggaggcggaaaaccaggctgactcagtgcggagctgggttccagggtcagctcatcttattgctggctgaggcctggggcgggtcctcccggcttcagcttcctcctcggcaaagtcaatggaatcgcggcccatctgctccttatatgagccaatacaggcaaagcacctaggaactgcctggcacacgggggcccgcaaagccacgggctattaccattaggcacctactatgtgccaggcagtgtgccagatgtggcatggagaacggtgccactctagcctcctggggttgaaagaccagcagggagaaacaagccaaggccacaggtgaattcagacggtgatagaggcgatggataaaaggaaagaggtgagggagggtgacctcaggctgggaccagacccacacaggctccttggaagggtggggcaagggaaagcctccctgagagtggctgccttggctctgggatgggggagcagacagaggcctgcaggtggcagggggtgctgggggcaaagccaacggggttgagtgggcgggtcctgtgggaaggacagggtggctgaacacagccgggcgagcggaatgaaatgaggaaagggcaggaccaggcagggctttgtggaccacagtgaggactgtagcttttactccgagatgggagccatgggaggcttccccccgcagagcagggaccagggctagtgtaggtacaagagactccctctggctgctgtggggagaacagactgtaaggggtgccggctgaagcaggctgaagcaggtccggggccacgcctaccagctacctcctccttagaatgggctgcagtccagcctgacggtttccacagggagggaactttcaatcctgcaggctctcagacccaggtaagcatcagaatctcctgcagagcttattggaggaacatgcaggtccccagagaccacttcaatagaccccacccaggggacacatgttctcaggacctcctaaggctgtgtctcacacacacacacacacaaaacccacccagagaagtctagaagtgtccaaaggtattcccagcccttccagttcaagattttatcaaagactccaacttcaacattttgtttccaagactcaggcgctctgatcctaagtgttcccatgaggtcacgaaggcccgagcctcgggtccacatcaccacatacagaagcagccgctgtctggccctcagcttttaggattccgaatctggttctaacgttctgaatcccctttccatgtcacgtcaccttctctctctgagcctcgtttcttcacctgtaaatggggcttctgactgtacccgcttggcgatggtggctgaggtttcaatgagatgcattcatgcaacaaatgaccagggagaaccaaccacccccgaccccagcaccatcatgccaggctccgggaatatggcagggccataaccagccagtcccagcagccagcatcaccagcagggccataaccagccagtcccagcagccagcatcactggggccagattctgggagctggcttcctaagcagcagattcgggactcaagattcggaagttccgacattctgtgcgtcattaatgacactgtgagcgcgggggctgagttggcacatactgcagctccaaggcactgatcttctagttcattcccatttgccaagtcagacacgctcaatcagatgtgctgaatgaatcagccttaaggatctgctgccaggcttgggaacctcaaagaggcaggtgctggggctccagggtcggtatctggttacgaccccaactttgagtctgtgatcctgtcccccagtggaccccgagggcaggaagcaagctggggcaaaggcagagttctgagaggcagggggctctgagtagcttgtacaaattatgtcgctttctgagtctctgctctctctgcttaagatgaggatgataagagtccctgccttggctgggcacggtgactcatgcttgtaatcccagcactttgggaggccaaaggcgggcagatcacctgaggtcgggagttcgagaccagcctggccaacatggtgaaaccccatctctactaataatacaaaaattagccgggtgtggtggctcatgcttgtaatcccaggtactcaggaggctgaggcacgagaatcacttgaacccaggaggcagaggttgcggtgagctgagatcacgccactgcactccagcctgagcaacaagagtgaaaccccgtcttaaaaaaaaaaaaaaaaaaaagtctctgcctcagagggctgtcctgcaaggattcagtaaaacaggacttccacaaatcctctagggaggcaggagagagcaacgcacaagatcacatgggtggggaccatggaggcctggttaaaaaccccagctgtgccccagacaggctgtgtgaccccggggcaggtgattctaccgctctgattctgtctatataaaacgggggtgatagtgactcacagggttgctgtgaggatggaaaaaggtgtatgcagagctgtgcttggcacatggcaggggcccaataaatgaccacagtcattgttactatcgtgggaaattaacgggtgagaaggatgctggggaagttgtgtgcaccacggcagtaacggaggcagggtgagtggaggaaggaggaggagtcctcctcgggaaaccctccctcactcatcaagcccccccacctccccatgcagcttcctgattggagaagacgggctcgtatacgagggccgtggctggaacttcacgggtgcccactcaggtcacttatggaaccccatgtccattggcatcagcttcatgggcaactacatgggtgagtgactgtccagccagttgggatgggggctgacacggggccctacgctatcacttccccttcggggaagcccctgcctgactcctacctctgcctcctccagatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctcaaaatgtgttcctcagcaggtcccaccacacacctcccctccttctctccctcccacaagaccaaagccctcccaccccttcccctcccagcactctcctcactggtgcttggaacccagaggccccggccctgaaccaagaccccggagatcccagctcgagagcaacatcacagctcagaacccagaggtctcaggtcagagcccaggaatcagcaccaaggcggccgggatgtcaccaacagtgggtcctgggggtcctcctgggcagtgaaccacgctgcaagacacctccttcccaccacacagccaaaggcatcctgcgcagaaactttgcttggactcctttagggacgggctgctcactactcctcccaggtctgcccttgcactgtttagagagtgtacaagcttttcctaggcctgagtcccaatctgcctccgaggcacagacacacaggtcccaattataccccccaatttctcttcctccacatttctccccactccaccctcaccctttagtcataagctgaggggtccccagggcaaatatgtttatttacaaaatgcacacatcctccctcccagcatgcactgcctggggagagggcagggtcagggcctcacacacctgagaccccaggggcagcaggagggacggggccagggcagggactgggcagggctggaggccaccctggccccaccccccacaccatacccagcaagtgggtgggggatggaggggtagtaccccttctccacgttatgaccgcatgtccagtcggttcatgtactcctgcaaggccttcaggcgtgcgtctatttcggccatgtcagccgcctggtgctccgagctgtactctgtgagagcaggtgtgggtatgggggctgtgaggggcctgaagccccagggagttcctgggcccaatataccactgcccgcactaccattccaacgggtcctggggctgggagaggggatgtggagtcccaggctcacctttgatggggacccagcccccggagttggccagagatttctgatggtggctgcgttccacggggggagacttctggtgatggggaaggtaggaaagggggtcacccaccgtccctctatttctgtccccctaaatcccactggaaatcctgagcctaaggaccttggggaaaaataaggcctgacacctactggccattcattatctgcaaaataacctcctaatgtcctcacagagccctcacctcacatgtgaggtgatgccattaccaaccctggttaactgataaacaaaaactaaggtacagagaggctaaagaactgccttgaaccatatagctgggaagaggaggagacaggtttcaagacctgacagtcagaagccaaagccctaaagagcatcacgtgcccctcattattccttctccaatctaatgctctcaaaacgtgctgttcccaggcctggtgcgctggcccagcctgtaactccagcgctgtaggaggctgaggatggcttgaggccaggagttccagaccagcctgggcaacataaagagacaataccacccccttatcctgtctcaaccccaccctgcccccccaaaaaagcctagtcccagctactccataggccgaggtgggagggtctcttgagtccaggagttgaaagctgccgtgagctacaattgccccactgcaccccagcctgaaagagcgagacgcactcttaaaaaagccctattgccaaaggcattcagagtcgcctctgcacctgatccccaggaaggaatcacaggaaatgggggcagctgtgttccagtggtttatgttgccccttctactcaccatattggacccactccagggcgttgggctgggaggcttcccacggcggcggtgacccctgagaaaaaggagtaaccaaggaccagtggtggggaggctctggtacttcccacctccccgac

SEQ ID NO: 13184 - DNA, 51928 bp, Human
  misc_feature (1)...(51928): n = A,T,C or G
acgaagcttcatctctgagcacccccatctctgacccctgagcaccaatccctatgtctgaccctaccttagattaccagctgatccttagccccgaaccccggttctttaacactgtgtgctggccctgagctcccacctcagtcttccccttaatggtgactcctcctccatcttttagtctttctttccctccaactttgaacctcacatcctgaaaccccctagtctgtcccctaccctggaactctgattcctatctttggtttgtacatataaatcccttgctttttggggctccaacacccggctcccaagtttaaggtgtgacccgacccttggctaaattttcctgacttccatttttaagccctggccgcggcgaggctgcccaaacagcgctcccatccatgcctcgtccccggtccccgacttccacacctggtctccgtgttcccagttcctcggctgcccaagtagacgcctttgcctccatttgaacccacaaccagtccctgctccatgtgagcccacaccccgatacctgcccccaacttcccgctccgccatccccgaggacacacctcgcccgcctccgggtagtagctccactcggccaggtcatgggcctccatcttcactgagcccagcatcccccgggcttacgcccccacccgcccccgctccggccccgggggaacggagcgctctggatctctcagcgggcacggcccgagctcccaccggcgcccgcccgtccgaccgcccggggtacggctgtcccgagcgccgcgggaggcggccacgctttatagccgggacacccccgccctcgcccgccccgggctcccctcccgcctccccgagggcggcgcgctcggactggggcgccccctgcgggatcgccaggagacagacctcaggcgccgggggccgcagccccaggacgcgacagctgggggtgattcaggagtgagggagctgcccgcagcgacgctgcagataccaagggccccgaggtcagaactctggagcctttctacctcagggggcttcatcatctcggcaggagaggacgaagagccagagccctgcatgaccgtggcggaagaaaggggaatcagaacgctagggccactatgcgactacaaggacccgtaaaaggtccccgaaatcacatccccattggacagacaggaagactgaggcttccgacggctagaaatgcttaacttggccgggcgcggtggctcacgcctgtaattccagcactgcaggaggccgaggcgggcggacgaatcacttgaggtcaggagtttgagaccagcctggccaacagggtgaaaccccatctctattaaaaatacaacaactagctaggcgtgatggtgcgtgcctgttatcccagctattcgggaggctgaggcaggagaatcgtttgaacctaggaagcggaggttgcagtgagccgagatcgcgccactgcagtccagcctgggagagagagcgggactccgtttccaaaaaaaaagaaagaaagaaaagaaaagaaaaagaaatgcttcagactgttgaaagggtcaagaacaaagatggaggggatcggggcctctccgcagaccccactagggcaacagaccacctcccctccaagacccaggagcttcgctgcccgaactccgcactctccaagaccagccagccgtccagggactcagcaccactgagaactccatttcccagaatgctctagctccctttccgcccggtgcctccgaagggactacatttcccagaaggcctagccggacccagagccggaaatgaagggtctgctcgccgtagtatggaggcgggcagaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcggtgagcgggaggcggcgtttgggcccggagacgaaaggaggaggctcctaaagaagcaggggctcgggcggggagggcatcgccgtggggagaggggaacagtggctttcgcgacccatgtttcttcccttgctcaggacccttccttggctccctagtgccctcgaggcaaagttccaacgtggccccccgggcgccaccgccccgcagacctcgcttgcttcgactcggcctctttgctttttcccccacctctaacagccgccctggcctttcggttccttaaacttgccatgcgctttcccgcttcggggattttgcacaggctgtcccttctgcctgcaacatccttttacccattcggcttggctaactcccatttcatccttcgggtctcggcaccaacgtcacttcctctgcgaagccctccttccctgccctccatccagaaatccgcctgttaaatgcttttgtcggtccgtgttccttcatgtcacgtgtggtctaatttgttatccgactcttatctgtgtgctgttttatgatgtctatgaccgtgtgttccatgaaggtagggactaggtttgtctctgtcgccactgtgttctcagcacagcgccaatcacgccggagacgcccagctaatgttcgttgaaggaataaaagatactcctagagccagtttggggaaacagggtagtcatcagattcctaggtagcagtggggcagggtaccacttcttaacgagtacatcgagagggaaggggaaacagtgatactgttcatcatagcaaaaggctacacgcatcccaaatgttcttaaataagaagattggctgaaagaaactataatacatccacataaaaaatactatgcaactctaaaaaggaatgaggtagataaaaggaaatgatgaaaatctctatacactgatatagtggcctccaacatatattaagggaaaacaagtgaagtggaggttggtgtttattgtatatgctttttctttttttttttttttgagacagggtctcactctgtcgcccaggctggcacgatcccagttcactgcaacctccacctccctggttcaagtgattctcccaccccagcctctcgagtagctgggattacaaacgtgccccaccacacccaggtaatttttatatttttagtagagacggggtttctctgtgttggccaggctggtcttgaactcctgacctcaagtgatctgcccacctcagccttccaaagtgcagggattacaggcctgagccaccaaactcggcctgtgtaggctccttttttttttttttgagacagagtctcactctgtcacccaggctggagtgcagtggcgtgatctcggctcactgcaacctctgccttccaggttcaagcaattcgcctgcctcagcctcccaggtagctgggattacaggcacaccaccacgcctggctaatttttgtatttttagtagagatggggtttcaccatgttggtcaggctggtcttgaactcctgacctcgtgatccacctgcctccgcctcccgaagtgctgggattacaggcgtgagtcaccgctcccggccctgtgtatgctctttttgtaaatgaaagggaaatatgtatatatgggtttttttattttcattttttttcctttttttgcataaaatctagctcctgcaggagaattttgtgtatgtgtgtttaaaaaagaacaaaacaaaactgaaagcataaaccaaaaagcagaagaagaatgaaacagggtaaaatattttggttgatctgaatgtattatcatgaaaaaagtggaaatgtttattatggggttttattttattttattttattttttgaggcagagtctcattctgtcgcccaggctggagtgcagtggtgttgggattacaggtgtgagccaccatgcccggcctgttttttttatgttttgactggggacggcatgccatgccggttgtctggtggccaggatccttggcttacgtaaacagacctgggggtaaaaaacaattcctttcagataaacagtactgtagcatagtggtaaggaagatatgcagccatgctgctgactctgcctcttacaagctatatgcctttggtcaggtcactttacctccctggtcttcagtttcctcatctgtaaaatgaaaattaaaaatactaactcccagcctgggcaacatggcgaaacccttctctacagaaagtacaaaaattaaatggggattcgcctgtagtctcagctacttgggaaaatgaggtaggaggatcgcctgagcccgggaggcagagattgcggtgagctgagattgcggcactgcactccagcttgggcaacagagtgacaccctgtctcaaaaaaacaaaaaatgtaaacctaactcatgtatattaattctaatatatacatattaattcatttaaaccttggtgtctgaggtttaaatgagttaatatgtatatcttagaattgtgcttagcacatattaagtgttctctctctctctttctctttctctctctatgtgtgtgtgtgggttttttttctttttttttttaatttgaaacgcagtttcactcttgttgcccacgctggagtgcaatgatgtgacctcggctcactgcaacctcctcctcccaaattcaagcgattctcctgcctcagcctcccgagtagctaggattacatgtgcctgccaccatgcctggctaatttttttgtatttttagtagagatgaggtttcaccatgttggccagactggtctcaaactgctaacctcgggtgatccacccgccttggcctcccaaagtgctggcattataggcttgagccaccgtgcccggccgtgttcaatatatattaactgattattttttcttttttttttttggaaacaggttcatcaggttcatgctctgttgcccaggttggactacggtggcccaatcatacttcactacaaccaggctcaaacaatcctcccaccttagcctccagagtagctgggactaaaggttcatggcaccatgcctggctaattttttttttttttttttttttttttagatggagtcttaccgtgtctcccaggctggagagcagtggcatgatatcgatgcccagctaattgtgcatatgtctagagatggtgtgtcgctgtgttgcccaggctggtttcaaactcctggcctcaagtactcttcctgcttcagcctcccaaaatgttgggattataggcatgaacccctgcacctggccttcttttttagtttttaggcctaggctagtcctgaactcctggcctcaagccatcctcccacctagacctaccaaaatgctgggtttacaattgtgagccactatacccgtcctatttttgttttctttcctttctttgtttttgttttgttttatttttgagacagagtcttgctctgtcatccaggctggagtgcagtggcgcaatctcggctcgctgcaacgtctgcctcccaggctcaggtaattctcatgcctcagcctcccaagtagctgggattacaggcatccatctccatgcccaagtaatttttttgtatttttagcagagactgggttttgccatgttggccaggctggtcttgaactcctggcctcaagtgatctgtccactttggcctcccaaagtgctgggattacaggagtgagccaccacaccatgcccttttttttttttttttttaaagacttgtcaagtgcagtagtgagaaagggggaaaaagtagaacaagtatagctattaggattcaagagtgaaagggcaggaatactgaacccagtgattggggaggccgtttggcagtagtgttcactcattcagcagatgtttattgagctcctgctaggtgccaagcactcttccgtgctgggaatataaaaagtgaaggaacaaaatccctgttctaggccgggggcgatggctgagacttgtgatcccaagcactttgggaggccaaggagggtggattgcttgagtgcaggagttcaagaccagcctgggcaacatggcgaaactctgcttctaccaaaaaatgatttcaaataaataaatcactgtcctcgtggaacttataaatatgtagtgtgtgatgatgataaatgctatggagaaaaagcaacacagatggggatcgagaggaagttaaaatttgaaatatggtcgtcggccgggcgcggtggctcatgcctgtaatcccagcactttgggaggccaaggcgggcgaatcacctgaggtcgggagttcgagatcagcctgaccaacatggagaaaccccgtctctactaaaaatacaaaattagccaggcgtggtggcacatgcctgtaatcccagctactagggaggctgaggcaggagaatcgcttgaacttgggaggcagaggttgctgtgagctgagatcacgccattgcactccagcctgggcaataagagggaaactccgtctcaaaaaaaaaagaaacatagtcgtcagggaagaccttactgcagagacatgtgagtggagacctgaaggaaatgaagagggaaggagttgtgctgatatctaggaggaggaatattccaggcagacggaagagaggcacaaagtctttgaggaaggggcatgttgggcatgttcacaggacagcgaggaggccagagtgggtggagcaaagagcccagggggagaggcagtcagaggaagaacaggccagatgccataaaatcttgtaggccttgatggggacattggccctgaccctgagcaagatagggggtgacaggcagcagggaaactagggaggaggctgtggctcgtcattcattgaggagacccctatcatgtgatactactgtgaatagctattgggtagttccttttaaaaaacgtgtcattttcggctgggcgctgtggctcacacctgtaatcccagcaatttgggaggccaaggtgggcagatcacctgaggtcaggagttcgagaccagcctgaccaacatggtaaaacttcgtctctactaaaaatacaaaaattagctggatgtggtggcacatacctgtaatcccagctacttgggagatgaggcaggagaattgcttgaacctgggagggtggaggttgcggtgagctgagattgtgccattacactccagcctgggaaacaagagtgaaattccatctaaaaaaaaaaaaaaaaaagtattttcggctggttgcggtggctcacgcctgtaatcccagcactttgggaggccaaggcgggcggatcacgaggtcaggagatcgagaccatcctggctaacatggtgaaaccccgtctctactaaaaatacaaaaaattagccgggcgtggtggcaggcgcctgtagtcccagctactggggaggctgaggcaggagaatggtgtgaacccaggaggcggagcttgcagtgagccacgatcacgccactgcactccagcctgggcgacagtgcaagactccatctcaaaaaaagaaaaaagtatcattttcaccgtcctcagattattgtttttttggcatgtttgtttgtttagtgtgtgtttttttttttttttttttttttttgagacagagtctcactctgtcgcccaggctcgagtacagtgttgtgatctcagctcactgcaagttccgcttcccgggttcatgccattctcctgcctcagcctcccgagtagctgggaatacaggcgcccgccaccatgcccggcatatttttttgtatttttagaagagacggggtttcaccttgttagccaggatggtctcgatctcctgacctccgtgatccgtccgccttggcctcccaaagtgctgggattacacgtgtgagccaccgcacccagccttgttttgtttttaagacagtctcattctcgtccaggctggagtgcagtggcgtgatctcagctcactgcagcctctgcctcccaggttcaagtgattctcccacctcagcctcccaagtaggtgggattataggtatgcgccaccatgcctgtctaatttgtatgtttttagtagggaacagtgtttctccatgttggccagtctggtctcgaactcctgacctcaggtgttctgcctacctcagcctcccaaggtgctgggattacagatgtgagccactgcacctggcctgtttgtttctgagacagggtgttgctctgtccgcaggctggaatgcagtggtagggatcacagctcactgcatcctccacctcctgagctcaattgatcctcccaccttagcctcccaaaatcctgggattacaggcgtgagctggccaaattattattaattatcataattgttgttagcagtttatgcagtagccttcagatcttttcccatgtacataaaaataatagtatacttagccaatgtttactgtatatactaactcatttaatcctcaaaatagtcttgggaggtaagccctgttactatccctgtttcctagaagaggaaactgagagccagagaagttaaatgtcttgcctcaggtcattctgcgtatacataaacacatacttgacaaaaatggcttgaactgcatgtattgtcctctgatgcaacaggctgtcagggacctcttttcaggataatatactgagattcaccttttttttttgagatggagtctgtctttatgtcccagactggagtgcagtggcatgatctcggctcactgcaacctccgcctcctgggttcaagcgattcttctgcctcagcctcctgagtagctgggattataggctcagctaactgttgtatttttactagagatggggtttcaccatgttggccaggctggtctcaaactcctaacctcagacgatccacccgtttcggcctcccaaagtgttgggattacaggcgtgagccaccgcgcccggcttcaccaattttttttaccctgtttcctctgctggtttttggtttatcctttcagatttttttccttttttaacatatatattttttcccctttcttttttttgagtcaagttctcactctgctgcccaggctggagggcagtggcccgatcttggctcactacagcctctgccttcacctccctgagtagctgggactaccaggcacgccaccatgcccagctaatttttatattttctgtagagatagggttacaccatgttgcccaggctgctctccgactcctaggctcaagcgatctgcctgcctcagcctcccaaagtgttgggagtacaggcatgagccactgcacctggcctcatttttcttttttttttgtaaaacagaaacatacagtcaacactgtcttcagctttgcttgttttcacttaatgtatgcactctctatcagtgtctagagattgttctcatttttttgtttttttcttcctttcttgttacagttccatagtctttttcctttatttatatttatatgtttttcacttactttcacaggtgttgaagccccatggcctttgattatgtatgaactttttttcagccagtctccctatttgagaacacttgagttgcttctagtcttttgctattatgaatagttgtgtaattgacatatactgctacgttaatcattccataattttgcctgtgtgactgtgatggatgcctgaaagcccccttcctcccttttaaaaacagcttcatgatattccagagagtggctgaaacataattattgaagcaggccttttgtgatgtattgagtgcctactatgtgccggactctgtgcctgatattcctcagagctgtgtttttaaaagtttactctgggccaggcactgtggttcacgcctgtaatccctgcactttgggaggccgaggcaggtggaacacctgaggtcaggagtttgacaccagcctggccaacatggtgaaaccctgtctctactgaaaatacaaaaattagctgggcatggtggcatgtgcctgtaatcccagttacttgggaggctgaggcaggagaatcacttgaacctgggaggcagaggttgcagtgagctgagatcgcaccaccacactccaacctgggtgacagagcaagacttcatctcaaaaaaaaaaaaaaaaagaaagtttgctgtggtgcccagtccaaagcatatcccagatggagagaggggacacacggagacctgcaaggtggctgttgcacgttcatgtggcccatcgttcagcagctgtttgtggttggcccacttgaggctgagacttctggctctgccttgggagatgtcagtctcccccaagttacaggccccgtgcacatatccataagccagagacagaccctggaggggagagggacttgagaaggcctgactggggaggaacagcctgggaaggaggcttgggccctttgtaggtgttcgggtgacaatccagcccagcccatccgctggttccctgagcttgatccatcctcttctttcctggggacaagctgacagcagccatggcgagcggcagtggagacagcgtcacccgtcggagcgtggcatcacagtttttcactcaagaggaggggccgggcatcgatggcatgaccacctcagagagggtgagcgtggcgggtagggcttggagtgaggaagcatagcccctggctttggcaatccctgtttaggtggcagagccctgggagtgccgagggggctgcactgggctggactgggctggcactatcccctgccactccccctccttccaggtggtggatcttctgaaccaggcggcgctgatcaccaatgactcaaagatcacagtgctcaaacaggtgagggcccggggggcatcctgggctgagcaggtgaaagggaggaggctgggaacctgagaaagacacttgcagtaacaccagtgtccacatttacacactcagtgtgtgccggccacagtgctcagtgcaggcctctgctcttctagttctcatgaaagctctgtaaggcagggtagtttcatccctgttttatacagaaagaagcagaccccggggcttaaattattagcccagggtcactctgctgggagctggctgaactagtaattgaatcctggattccagctccaaatcctacactcttcatcattgcatttcttctctgccagtgtccagtccagtggggcagacattcctgtcaccaggcaatgatgacccagtgtgggcagggctgggatggagaagggagcccaggggggctctgggagcccagagggagctcctgacccagcctagggatggggagtcagggaggacttttgaaccaagccatggaggataaaaggagagaagtgtaccaaatgagagaggcagagcatctcttttttttttttttttgaggcagagtcttgctctgttgcccaggctggagtgccatggcacgatcctggctctcactgcaactcctgcctcagcctcttgagtagctgagattacaggcacctgccaccatgcctggctaatttttgtatttttagtagagacgcgtttcaccatgttgaccaggctggtctcaaactcgtgagctcaagtggtccaccctccttggcccccgcaaactgctgggattacaggcacgagccaccgtgcccagccaagagagggagagcatgtcaagctgagggcacagaagtgtgtgcaaaggcagaagacgacatggggcacttgggctgggcatggttcagagcaggaggcagttggagttcagagactggcagggttagcattcctgtgtgagaacccgttcggctccttcatcagcctgtagccttgtggagtagccccacctccgaggtggagtggatgcacctggtgcctcccccatgggtggtcatgaggccgtttagcaatagtagcttgagttgtagcagccaggtcctgtgccagctctttgcttattggaggatgtccatgggaagggcttactccaaagagcctggcaggcacaagggcttcaggaattgggttctcactgtgaagatgtttgctgaatcatggcaatgtgaagtagggagcagaagcagaaggagagtggggagaactgatggacaggtgaatggaggccaaacctcaggaaggcctgagccttggggcactttcctctttttttcagccccctcctgtgtcatgtcctcactatctaccaggacctgtgccttgtaggatctcattgtagcctcctaacatcccttttgagttgatgtttaagagtctcattttatagaagagcaaactgaggttcagagaccatgcccagagcatagcacccttggtagggagaagcagagccaggcattgaaatgagtgtatctgctgcctagccctctgctgtcttcccctctactctcctgtctgcattgattggcccctcgttttatatgggtattcctcctccccacccccaatctccttccaggtccaggagctgatcatcaacaaagaccccacactactggacaacttcctggatgtgagtgactgacagaagagaaaggggtgtggtgtaggggaaaggggatgtggatccttgtgtagccctgatccactttctctctaacattggcaggagatcatcgcattccaagcagacaagtcaatcgaagtgcgaaaatttgtcatcggcttcatcgaggaggcatggtatggggcgaggcacggagccccgggagcattctcactggtggcagccttcagctcgtggcctggcctggaggccaccactgagaggcctgccctctgcttcccagaccctttctctctctcatacacactgattccccagcaaatacttaataagatggaaaccctggggtcatctgtgattcctctgcttcttccacacttcacatctacattatcactaaggactgtgggctccactttgagaatatctgtagcatctgaccgtttgtcaatcacttcctctgccactatgcaggcccaagccaccctttcctcctacctgatgacttcagtggtctctctctggctcccttctttttctttttagttaaattgaaattcatataacaaaattagcttttttttttaatcttttgtttgtttgtttgttttgagacggagtctcgctcaactgttgtccaggcttgagtgcagtggcgcaatctcggctcactgcaacctccgacttccgggttcaagctattctcctgcctcagcctcccaagtagctgggattacaggcatgcgccaccacatccggcttatttttgtatttttagtagagaaggggttttgcaatgttggccaggctggtctcaaactcctgacctcaggtgatctgcccgccttggcctcccaaagtgttgggattacaggtgtgagtcactgtgcctggccttttttttttttttgagactgagttttgctctgttgtccaggctggagtacagtggtgcaatcttggctcattacaacctccacctcccaggctcaagagattcttgtgcctcagcctccttgaatagctgggattacaggtgcgtgccaccatgcctggctaatttttgtatttttagtagagatggggtttctgccatgttggccaggccagtcttgaactcctgacctcaagtgattggcccaccttggcctcccaaagtgcggggattacaggcatgagccacgacgcccagcaaaaatcagctattttaaagtgaacaagtgagtggcatttagcacgttcacaatctcgttccagggcatttcatcccccaaagaggaatcaccgcactcatttcccgcttccactcttgcactcagcagccagagtgacgctgttaaatgtaaatcagtcttggcacacccctgctctcagaccccagctggctcatcagcttacttaggtggaaacccaaactctcacttcggcttcatctcacttctgatcctctctgtctcccctgctcctcagaagtcacagttggatttcgcagcctgtctgcttgctgttcctgctaggggccctcgtccccaggttgccacctggctctcccctcccttccctcaggtctcttcctcagaaattccttcctgcccgctcccatgcagccccatgtctcaggcaccccaccttcactgttctttacagtgttcctcactcattgaaataaccttgattcttcccgcaaaatatcagctctgtgaggacggggcttgactttttctgtcttgctggccactttgtccccagtacctgcctggagcagtgttgtcacctagtaggggctgactacgtatttgttgcacacgtgaatgagttgaacataacagtcaccacatggaacacgtactgtgccctgcgctgtgtcaggtcctttcccgtgttatctccgtaattatggcagcctcgatggatactgtagttatcctctttttacagaaagggaaacaggctcagaatggtcaagtgacttgttcaagctggtcacttgctcatttgtttattaaagctttactggatgctttgtgactgggaggaagtagactagctactgtgtattaaatatttgtttgtaaggcactgtattaaatgcttgagcagcttcattattcgtaatactatggatcagttgtttgaccctttaactgaagagaaaacagtctcagagaggtgaagtgaattttcttaaggtcacacagccagaatgtggcaaggctgggattttatttatttattatttttttgagatggaatctcactctgtcggccagactggggtgcagtggtgcaatctcggctgactacaacctctgcctcctgagtcaagtgattgtcctccctcagcccccccgagtatctgggattacaggtgcctgccaccacacccagctaattttgttttctgttgttgtttttttttgtttttgtttttgtttttgttttgagatggagtttcgctcttgttgcccaggctggagtgcaatggtgcgatctcggctaactgcaacctccaccacacaggttcaagtgattctcctgcctcagcctcccaagtagctggagttacaggtgcccgccaccatgcccggccaattttgtatttttagtagagatggggtttcaccacgttggtcaagctggtctcaaactcctgacctcaggtgacccacctgcctcagcctcccaaagtgctgggattacaggcgtgagccactgcgcctggccaaggctgggattttaactcatgtctgcaatgccagaacccaaatatcctatctccccatttactgggagaatttgtggtaaattttctgaatttgtaaaaagtccattcagcaaatacataccatgtgactgctgtcgtaccaggcatccatgttaggctgtagtatagcagtgagcaaaaacgtattattcctgccttcatgtagctgacagctaagtttcatattttttgactgatttaattaatatttcagattgtaatgtatgctgtgaaaattctgtgctgagctcctatttattcattgaacatttgttggaggcccttcatttttttcttcaatgaaaatgaccctgctggggttattgccaagctaggaaagggtccctactttttgagccctcagactgaggcaagcaaaactagtgattacagaaaacaaagtgctttaaagtagcaatggctggtgtttaccgaatgctttttggtgtttactgaatgctttctgcatgtcaggcactcttctaagcactttacaagtattgttgcaattttcccaaaaaattgcataaacaattggatagatactattattctaaatgaggtgaagtcgcttgtccaaattcacacagttgtctgcccctactgtcccttatgtgaacagcagggccctgagagagcaaaggagttggtgttacaggaccagtctagatagagggttcaggggcggctcagtctggaggcaccaagcactgttcccagcttctggatgtgccattccggtcccctgagacaggtccctgatttcccttccctcctggacctcaggctcctcctacttgctctaagaccacaccttgacctcgccccttttttctccatccctcagcaagcgagacattgagttgctgctgaaactcattgcaaacctcaacatgctcttgagggacgagaatgtgaacgtggtgaagaaggctatcctcaccatgacccagctctacaaggtggccctgcaggtgagagcgccctccccacccagggccatcctgcctgatatgtctcgttgacaaactaatatgttggggttcaaaaccagcatccgagcatactctttatgggcaagatgtgccactggtctgtgggaacagataacatggagagctaacgttgtctcctaggtcaggaagttgcacttaaccttcattccttccattgaccatccgtttattcactcaacagacattccctgagtatgtcctctgtgcttagccctgggctaggtgatgctggggacacagcagtgaccaagacagcttactgccttcacagtgctcataacccaaggagggaggtagaccttaattaatgaatcacataaatattgattatggagtgtgataggaaaagaacactctatggtgtgatgtacattagcattaataaaacgaatgaatccatttaatcaccaccaccttgtgaagtcagcactgttagtcctttaccctgaagatgtgtgccttcatcacactgagtggtcactctctgcatccccatgagggcagggcgaggcctggccactactcagtcctgtctccagcatcaccgagcactgggctggggcagagttggaactcagtaactgttaaccaaatgaatgtattcatcattcatggttctctgggtattggcagagggtgttggtgattgatgcgttgtcttcacctctttgtgtgtctcttccattccttcctggcctgctggcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacagtgagtactgccttcagctgccacccctgacagccctgcaccagtttcctctccttcacgcccctccctctctcccccttgtcttttttggttttaaatttctggaacagtgtgtgcagtagttaagatccctggtgctaggttcagatcccagctgcactgcttactcatcatgaacttgggcaagttacctgtctctgtacttcattttcttttttgtaaattggagacgataacatagtaccactctcacaggtttgtagtgaagttccatgagtgtgagccagtcgatgctagctagttttatggttttcttttttttttttttgagatggagtcttcctctgtcgcccaggctggagtgcaatggcacaatctcagctcactgcaacctccgccttccgggttcaagagattcttctgcctcagcctccaaagtagctggggctacaggctcccgccaccatacctggccaatttttttaaaaattatttttagtagaagcagggtttcaccatattggccaagctggtatcgaactcctgaccttgtgatccgcccgccttggcctcccaaagtgctgggattacgggcttgagccaccgcgccgggcagttttacagttttcttaactgcaaattataaaagtaggacataggccaggtgtggtggctcatgcttatagtcccagcattttgagaggccaaggcaggcagatcacttggggtcaggagttcgagaccaccctggccaacatggtgaaaccccttatctactgaaaatacaaaaattagccgggcatggtggcgggcacctgtaatcccagctacttgggaggctgaggcacgagaatcgcttgaacccaggaggcagaggttgcagtgagctgagactgtgccactgcactccagcctgggtgacagaatgagactgtctcaaaaaaaaaaaaagtactatatatacacttggtgtcaagcaatatgggtgaatcaaaaggaataatgtcccctccctcagtcctgctttccagagataaacactgttaagagtattatgtttcctttcagatctttcctgtgcacatgtaggtatttgtatgtgtatatgcatagtgtctgcatttgtttgcttttctgtttgcaaaaatgaggccatgctttgtgttttcatctcagagacattatagtagcttgtgtctgacacacagcctattttcccttgtctctgagcctgattcctcattggtaaattggggatcgttattatggcatctaatttaggatgtaggtatgagcatttggtgtattaatatggctggaatagtaaacattccataaatattaactattcttatgtattgtttgacagcctttttgacttaatagtatcagtgacgtccttccctgtgagaatcatatagttgctataccatattccatagtatagttacattacattctattaagcaatgctctgttgatggtcatttagatttttaattcacttttattttttgagacggagtctcgctctttcacccaggctggagtgcagtagcgctatctcggctcactgcatgctccgcctcccgtgttcacgccattctcctgcctcagcctcccgagtagctgggaccacaggtgcccgccaccacgcccggctaattttttgtatttttagtagagacagggtttcaccgtgttagccaggatggtcttgatctcctgacctcgtgatctgcccacctcggcctcccaaagtgctgggattacaggcgtgagccaccgcgcccggcctaattcactattttaaataatgtggcgttcaagtcaaaactacaatgaaatgtctcaccccagttaaagtgacttttatcaaaaagacaacaaatgctggcgaggatgtggagaaagggaaacacttgtacactgttggtgagaatgtcacttactacagcctaaaaattgtttggagttttgaggttcctcaaaaaattaaaaattgagctaccatatgattcagcaatcccactgctggatatgtaaccgaaataaaggaaatcactgtatcaaaaagataacccgcacttccatattcattgcagcactagtcagaatagccaagacttcggagcaaactaagtattcatcaacagagtaatagataaagaaaatgtggtactcatacacaattgaatactattcagccataaaaaagaaggagatcctgtcatttgcaacaacatggatggaagtggaagtcattaagtgaaataagccaggcaccgaaagacaactttgcatgttctcacttatttgtgagagctagaaatgaaaacaattgaactcatggagacagacggtagaatgatggttaccagaggctgaaaagggtaatgggcggttggggaggaagtgggaatggttaatgggtacaaaaaaatagttagaacaaataagatctagtatttgatagccaagcatggtggcatgtgcctgtggtctcagcagctcaggaggctgagttgagaggatcacctgagtctgggtggtggaggttgcagtgagccgagatcacgccactgctttccactctgggtgacagagtgagaccccatctcagggaaaaaaaaaaagatccagtatttgatagcacagcagggtaactatactaaaaaataatcatacattttaaaataattgaaatagtataattggattgtgtgtaacaaaacggataaatgcttgtgatggagaccccatttaccctgatggtgataattatgcattgcatgcctgtatcaaaatctcatgtaccccataattatttacacctactatatacccattaaaattttttaagttaaaaacatatatatggcattcgttatgtttctgtataggaaaggtctggaaagatatccaccaaagttttaagcattaattttggggactgtattgaggggagtggtgtcacaagggactttgagttgtgtgtatatacacatgtattctagtctttcactattgcaagcccatgctttgaacatctttataactaaattttttttttttttaatatggagtccaactctgtcacccaggctggagtgcagtggcgcgatctcggctcactgcaacctctgcctcctgggttcaagcgattctcctgcctcagcctcccaagtagctgggattacaggcacaggccttcacacctgggctaatttcttgtatttttagtagagacggggttttaccatgttggccaggctggtcttgaactcctgacctcaagtgatctgcctgccttggcctcccaaagtgctgggattacaggcatgagccactgcgtctagccccttataactaaatttttatactcattaatagtctcatagaactaatcaaccaccacattttctgtttttcccgccattcatagacatctaggtaccaggatctgtccttccttttagtcccaaaagctgctgtctccagaggcctgggaaaacggatcccactgactggttctcctctctgtctcttagacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatggtaggtcattgtcctcccccctccccctgccttctcttcactggccagtctgctctttcttttttttttttttttttttttttttttgagacagagtctcgctctgtcaccaggctggagtgcagtggtgcaatcttggctcactgcaacctctgcctccccagttcaagtgattctcctgcctcagcctcccgagtagctgggattacaggacacaccaccacacccagctaatttgtttacttttagtagagacggggtttcaccgtgttggccaggatgatctctatctcttgaccttgtgattcgcctgcctcggcctcctaaagtgctgggattacaggtgtgagccactgcacccggcctcagcctgctcattcttaaagaaatgtagctccgtggtggaccccgagcgctagtcatccatctggcaggcctgagattctctacattagacaggaatcttttggcatgtgacagaaacttgattcaggactggctttaatattgaggtatgtgggggtgaaatgacatgatgtctgtgaaatactttcaaatattccagtcctctccccccaccaaaagggaggatagatgttccaagattagcgaaatgttgatgggtacacagagactcataccattttctctgttttgtgaaacgaaaaccgagaagtctggggttggggtatgaatgcgtacaggtcgtggatctgcatttctccatctctcagctctttgtttctccattttagtttcactctctggccctttccttagggtagcaaagatggccccccatagttcatggctcccattccgttcacttagcaacaccatgggaaagagagtgtctccttcccaaccattccagcagaagtccaagggctgacggtcattgtttctgattggctgagcagagattatgagccagtctctgagccaattacagtggccgagggaatgtggtattctcactggccccaggtctcatgcccactcggaaggagactggagaaggggggtctcccttaacggagagtgggttgtgttgttggctgaggaaggggcagtggatgctaggcaggcagaattacaggcatcctttttcactgtggaacaggggaggctcacttatcagggtgaccattagaaagtcatcctggcgtcagggagactagcagtgagctgttgcagcagttcagttgggggtttctggaggcaaaagtggtgattataaccctccccaagcgaagcatatgtgaatttccagaccagagatggaggaggacgaaattgtatgtatttactaaaagagagggtgagtttttctctttaagattgactgatactgatggagacccccagggtttgaagcatcagcttgtaaggcggaaagccacacgttagatctgagggtgaaggaacttttctagtagatgcctgcaagaccactgcccaagtttggggttgagaattaagactggcagcatgccatgagatcttccacaagacacagctcctgccactttcctcacagccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctgggtgagaggggctggtggggtggggcaggcagaccatgctgaaatgtttcattatttaccttaaactatgctgaatttgtatttactaagattatattatagattatgttatgtgggccaggcacagtggctcacacctgtattcccagcactttgggaagctgaggcgggcagatcacttgaggccggggttcaagaccaacctaggcaacatggcaaaaccctgtctctaattttaaaaaattataaaataattataaaaataaattacagtatttaatatgatatataaattacaatagaattatcaaaatatacgtttaataaattatgcattatttaaattttacagaaaggaataaaatgaaaatagtatccctcttatccctctcccaagaagtaaccactccccaggtgtgaacacttctttatgttttcctccagaagtgctttatgtagagtgtggagctcttctttcattcctttgttttagttatcagataattttctttctgaagtaattttctagtggttgtattatttatcaatagtgtcaactatggcttttcttaactttaagatttttttcttaaatcacactttttttctagagcatttacgaaagatttattttttcattttaaaaaataaggaattaggctgggcgcagtggctcacgcctgtaatcccagcactttgggaggccaaggcatgtgaatcacctgaggttaggagtttgacaccagcctggccaacatggaaaaaccccgtctctactaataatacaaaaattagctgggtgtagtggtgcatgcctgtaatcccagatactctggaggctgaggcaggagaatcacttgaacccaggaggcagaagttgcagtaagccgagatcatgccattgcactccagtctgggtgacaagagtgaaactctgtctcaaaaaaaaaaaaggtggggggggaattgccaggcacagtggctcatgcctgtaatcccagcattttggaaggccaagttgagcggatcacctgaggtcaggagttcgaaattagcctggctaacatggtgaaaccctgtctctactaaaaatacaaaaattagccaggcgtggtggtgcacacctgtagttgctgctacttgggaggctgaggcagaagaattgcttgaactgggggcagtggttgcagtgagccaagattgcaccattgcactccatcctgggtgacagagcaagactccgtctcaaaaaaaaaaaaggaatttatctaaggagtgaggtagggatcttactatgttttttcataattaagtatactaagcagagtattctgtaccttgttttcatttagtttcatttactttcatcttggagttctttatagaactctacctcatccttttttttttgagacagtcttgctctgttgcccagattggagtgcagtggtgtaatctgggctcactgcagcctctgtctcccgggttcaagcaattctcatacctctgcttcctgagtaactggaattacaggcgaatgccaccacaccgggctaatttttgtatttgtttgtttttttttttttaaagatggagtttcactcttgttgcccaggctggagtgcagtggtgggatcttggctcactacaacctctgcctcccagattcaggcaattctcctgcctcagcctcccaagtagctgggattacaggcatgtgccaccatgcccagctaattttgtctttttagtagagacggggcttcaccatgttggtcaggctggtcttgaactcctgacctcaagtgatctgcctgccttcgcctcctaaagtgttgagattacaggcgtgagccactgcacctggccagggtttgtatatttaaagttatattttacccaccaaatttgtctttttttttttttttttttttttttgagacagtctcgctctgtcacccaggctggagtacagtggcctgatcttggctcactgcaacctccgcctcccaggtttaagagattctccctcctcagcctcccgagtagctggggctactggtgcgcgccatcatatctgaccaatttttttgcatttttagtagagccagggtttcaccatgttggccaggctggtctcaaactcctgacctcaggtaatccacccgcctcaggtgatcccctggttgcctcagtacatgggatcaggaggcacatggtgtcccattgttggagatattaacttttgaacgcttggttaacacagtttcaaccagctttctctagtgtcaagtgccatttttatctttgtcagtaataagctgggggagatatttgaaactatgtaaaatacatgtttctctttaaacgttcacccagtggtttttttgtgtttttttgttttgttttgttttgttttgagacagagtctcgctctgttgcccaggctggagtgcagtggtgcaatcttggctcactgcaagctccgcctcctgggttcacaccattctcctgcctcagcctcccgagtagctgggactacaggtgcccgccatctgcccggctaattttttgtattttttttagtagagacggggtttcaccgtgttagccagtatggtctcgatctcctgacctcatgatcccaaagtgctgggattacaggtgtgagccactgcgcccagcctcacccagtggttttaacatccagtgatgattgttgcctgagtctattattctatactggctccaaagagattttccttctacatttatcagttgacattctgctgtaaggaagaactttctcttcttcttcccacttactatcaggaatttgttttgagcatttcacttacttactagcatgacaagatgttctagactcctcttgtactgtccttgccccagccctggaatcagtctttctttttaaggaaccctggtttcctttaagtggggaatagtttcagaaatcaaggtctgagcccaggtgtgcccttaggtaccgagtgtacattcttgatagccattaccaaagtgccttctaaaaaactgcaccaggctgggcgtggtggctcatgcctgtaatcctagcactttgggaggctgagacaggtggatcacctgaggtcagaaatttgagaccagcctggccaacatggtgaaaccccatctctactaaaaatacaaaaaaattagctgggcctggtggcgcatgcctataatcccagttacttgggaggctgaggcaggagaatcacttgaacctgggaggcggaggttacagtgagccgaaatcatgccattgtactgcagcctcggtgacgagcaagactgtctcaaaaaatagtaataataataatctcttcttagagcttatgataagctgcaggggtgtggcttactcccatttcccagatcaggagatctgaggttcagaacgagtcaggtagttgcccagggtcataaagtggtttggcaccagaggcagagctgcagcctggatcttcatccgctgtttgctcctgtttgctgaggctgactagaggcagggaccacccgggcaccccggaaggatggagggcctgcagctctctctatagccagcatcttgttcttttccctcatcccagagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtgaggatgggtggggagcgttttccccctgggcaggaaggaaggatctcctcggtctttcacctgcctccacttcacaccatccacctcctccagagtaccctcctaattaataaagaaaaggggtttaattggcttacagttctgcaggctgtataggaagcgtggtgctggcatctgcttagcttctggggaaacctcaggaagcttccaatcatagtgaaaggtgaagggggagcaggcatctcgtgtggcagagcaggagcaggagaaagggagtgttggggagcagggaggtgccacacacttttaaatgaccagatcttgtgacaactcgctatcctgaagacagcaccaagccatgagggatctgcccccatgatccaaacacccccgaccaggccccacctcccacatcggggattgtaattcaacatgagattcgggaaggaacaaatatccagactacatcagtgagcctcaggcctgggtatgcaacccgcttctgatcatcctccttttggacgtcccaggagcacctcagactcatgtggcagaactacacttttccactttctccccacgctcctctccaggcccctcccagttcccaaaccagaaacctgggagtgaacctcttttccttctctccctaatccttgccctcttttccacccctgtagcacttaccctgggccaggcccacccttttcacctgaagcccaaccctcacttgctacctggctccaacttccttcaagtaaaatttaagttccacttgccttagtcagccatctttgatctggcttctgttaacttgtctttttttttttttttttttttttgaggcagagtctcgctttgttacccagactggagtgcagtggcgcgatctcagctcactgtaatctccgcctcccgggttcaagtgattctcttgcctcagcctcccgaatagctgggattaccagcgcccaccactgcacccagctaatttttgtgtttttagcagagacagggtttcaccatgttggtcatgctggtctgaactcctgacctctggtgatccgcccaccatggcctcccaaagtgctgggattacaggcatgagccaccatgcccggccattctaccttttgtcttatcacacactaggaattgaccttttcagttttgccatgaagttgctcatcaacatttataaaaatgcctgctattcatagtataaaataccatatgtttgtaatgtgccccttttctgttgctactactatgtccaatcttgcaaaatatttgcttgttttcagtcatctcaaataactagctctttgttttgttcatattcttttggcactttttctgttttatttctgttgcctttatttctttcctgctactttctttgaatgtttgttcccacggttttaagtgattggctcattaatctttagttatcttttccaatgtaagcaagcatttaaggatttgattttccatctgagtactattttagctgtattccacaattttaatttatagcagtttcattatctttctgttctaattagttattacttagtgtgtgcatttaaagttcactgtgtagccttggcaacatagcgagaccctgtctctacaaaaagaaaaataaaaaaattagccgggcatggtggcatgtacctgtgatcccagccactggagaggctgaagcaggaggattgcttaagcccaggaatttgaggctgtagtgaactctgatggcgccactgcactccagcctggacaatagagtaagaccctgtctctaagaaaaataatacattttttttttgagacagagtcttgctctgttgcccaggctggagtgtagtggcgcagtctcagctcactgtaagctccgcctcccgggttcacgccattctcctgcctcagcctcccgagtagctgggactacaggtgcctgccaccacgcccagctaagttttttgtatttttagtagagatgaggtttcgctgtgttagccaagatggtcttgatctcctgacctcgtgatccgcccgcctcagcctcccaaagtgctatgattacaggcatgagccaccgtgcccagtataaattttttttaaagcttcaaatgtataggaagtttgaaattatccttttccagcctgggcaagatggtgaaaccccatctctactaaacatacaaaaattagccaggtgcggtggcaggcacctgtaatccccgctacttgggaggctgaggcaggagaattgcttgaacccaggcggcagaggttgcagtgagctgagatcgtgccactgcactccagcctgggggacagagtgagattccgtcccaaaaaataaataaataaataaaaaggaaattatcttttgttactaattcctgacatccatggatgttctctgttaggattctggggggtttcttgtttgcttgttatttgaagtcaattcccagtcctaacactcttcactgaacctctttttgctttctttctttctttctttctttctttatgaatgagatggagtcttgctctgtcacccaggctggagtgcagtagcgcgatctcggctcactgcaactgctgccgcctggattcaagcaattatcctgcctcagcctcccgagtagctgggattacaggcacatgctgctgcgccaggctaatttttgtatttttagtagagacagggtttcaccatgttggccaggctggtcttgggctcctgacctcaagtgatctacctgccttagcctctcaaagtgctgggattgcaggcatgacccactgcacctggcctcttttgttctctggacagggtgccagctctgctgcttcttagccttctcccatggtgtttctctacggggaatacacacccctcccacctcaaaaccttgtcctgtattatgctgactcctgccctcccctcagttctcagcctaggtgcttcttgcgcagggagcccttgccttgcctggctcctgctgtggctcacagtgcccttcatgttaccctctcaagcactacactatataattatttgttttctctgtgacttccagaagaggctgggccccaggagagcaggcccaagtcggtcttaggcactgccatttccccagtattggcatgggcatggaaagaatgcttcttgagttaatgattaaggagaggctctcttcctgggcatcccacaggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgagtgtgtcctggccctaacctgggccagggattggcacttgtggcttctgggttctccttactggaagagcaacttctcgtggtgcagttgaaaatcatgtgggagctaaggtgtagataatgacaggtaccacagatagatggctcagtgtttttaagtcctgggctttggaatccaacagacctgggtttgaagtttgagttgaatcagatctcatccacttaatatctgtatgactttggtcaagttagttaacctctctgagcttcatagttttaccctgttttaacagtactattaatgtgtgatacacataagtgaaatgcagaactcttaattatagaccttagtgaattttcacaaagtgaacacaccagtgtaaccatcacccagatcaagatacaggttaaatatcccttatccaaaatgcttgggaccagaagtgtttcagatttcagacctttggatttggagtatttgcatatacataatgaggtatcttagggatgggatccaagtctaaacatgaaattcatttatgtttagctcataatgagctaaacatagctcaaaggtaattatatacgatatttctttttctttttttttttttttgagacaaagtctcgctctgttgcccaggctggagtgcagtggtgcaatctcggcttactgcaacctctgcctcccaagttcaaatgattctcctgcctcagcctcccgagtagctgggactacaggcacatgccaccacgcctggctagcttttgttttgttttgttttttgagacacagtcttgcagtgtcacccaggttggagtgcaatagcatgatctcggctcactgcaagctccgcttctcgggttcacgccattctcctgcctcagcctcccgagtagctgggactacaggcgcctgccaccacgcccggctaattttttgtatttttagtagagacgggggtttcaccgtcttagccaggatggtctccacctcctgatcttgtgatccacccgccttggcctcccaaagtgctgggattacaggtgtgagccagtgcacccggccctagttttttgtatttttagtagagacggggtttcaccgtgttagcaaggatggtctcaatctcctgaccttgtgatccgcccaccttggcttcccaaagtgctgggattacaggcgtgagccaccgcactggacctgtaatatttcttaataattttgttcatgaaatgatgttttgactgccatctatccacacgaggtcaggtgtggaattttacccttgtgttttgttgagactcagaaagtttcggatttatagaccattgccactgtagaaatttcctccttgttcttccagagatgcctcagggcattgaactccagagaaaaccagtgttctgatttctgcctccatagactagttttacctattctttatttttttattttttattttttgagacagattctcactctgttgcccaggctggagtgcagtgcaatggcacgatctcagctcactgcaagctccacctcctgggttcacgccattctcatgcctcagcctcctgagtagctggaattacaggtgcccggcaccatgcccagctaattttattgtatttttagtagagacggggtttcaccgtgttagccaggttggtcttgatctcctgaccttgtgatctgtccgtcttggcctccgaaagtcctgggatttcgggtgtgagccaccgcgcccggccctagttttacctattcttgaacaaaactaaataggatcacaaagtctggtttctctggcttgccatatggttttttgtgtttttttgtttgtttatttttatttatttatttttttgagatggagttttgctcttgtggcccaggctggagtgcagcagaactttcttggcttactgcaacctctgtctcctggattcaagcgattctcctgcatcagcctcccgagtagttgagattacaggcacccgctgccaccattcccagctaattttttgtttttcacggtttttttttttttttgagatggagtcctactctgtcgcccaggctggagtgcaatggcatgatctcggctcaccgcaacttctgcctcctgggttcaagtgattctcctgccttccaagtagctgggattataggcatgtgccaccatgcctggctgattttttttttttttttttttgtatttttagtagagatggggtttcaccatgttggccaggctggtctcgaactcctgacctcaggtgatccactctcctcggcctgttaaagtgctgggattacaggtgtgagccaccacgcccagcctgctgtacatttttgagattcttcattgttgtcgtgtgaggtactagttggttttttattgctcagtagtattctgtcatatgaatatacaatcatttgtttatccacaccggtattgatggacctgtggcttctttccagtttttggccattgggaataaagctgctgtgaatatttgtgtccaactctcttcatgtacacatgctgtcatctgtcttgagcatataccaaggagtggaaccgttgggtcatagggtgtgatcagtgctattaaaaactgctacaggctgggtgtggtggctcacacctgtagtcccagcactttgggaggctgaggcgggtggatcacctgaggtcagcagttcaagaccagcctggccaatgtggtgaaaccccgtctctactgaaaacaaaaaaattagctgggtgtggcagtgggtgtctataatcccagctactccagaagctgaggtgggaaaatggcttggacccaggaggtggaggctgcagcgagtcaggatcaagccactgcactccagccttggtgatggagtgagactccgtctccaaaaaaaacagctgagggctgggcacagtggctcatacctgtaatcccagcactttggaagtccaaggcgggaggatcgcttgagcccaggagttcaagactaagctgggcaacatatggagacctcatctctacaaaaaaatacaaaaattagctaggtatgttggcatgcgcctgtagtcccagctagttgggaggctgagaggctgaggcaggaggattgcttgagcccaggaggtcaagactgcagtgagccctgattgcaccaccgttactccagcctgggtgacagagtgacacccagtctaaaaaacaaaaactgctcatcatgtttccaaagtggctgtagcatttgctgctccccccagcaatgaatggcatttctagtttgagcctcagttgtattgaaaagtggggataaaaagagtacccactccaggacagtgttgtgtggatttaaacaaggttttgtgtgtacagggctcagaacagagccaggcacacaggaggtcctcgggttggagcaggtgggtctgacgcactgggtgtctgtttgctgcctccccctcaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggtgagtcctcttctgggtgctagggcaggacaggagccctaccctgaaggtctggttctcagctcgtgtgcgtgtgcgtgtgcgtgtgtgtgtgtgtgtgtaactgagatgcagacagaaggaagtctggaataggttctctctgactcccgagtcagtgccataaccactaagcctttgctgttctctttcctgtaaaaaaaaaaaaaaaaaatccttttttatgtctaaaattaggataatgatagtatctttctcataaggatcaaagaagaattaaattagttcgtggtaatggtgatggttaggtaactagatactcgagtgaaaagtgattgtgattgtcaagcatttcgcgtggttcctgttgtgtagtaaatgctactggctgtcatcatcattgtccccattattacctcccttacacaccacaaaatccagccagtcccggccacccaagtctttttattatttatttatttattatttttttttgagtcggagtctcactctgtctcccaggctggagtgcagtggcgcgatctcagctcactgcaagctccgcctcccgagttcatgccattctcctgcctcagcctcccgattagctgggactacaggcgcccgccaccacgcctggctaattttttgtatttttagtagagacggggtttcaccgtgttagccaggatggtctcgatctcctgacctcgtgatccgcctgcctcagcctcccaaagtgttgggattacaggcgtgagccaccgtgcccagccccaagtcttactaacacagctgagcgggatctgctaccctccgagctctcttctgctaccctcacccctcctccactcatgcccacaagtctgttcccacctaagggcctttgcctggagagctggtcccccagacatttgtgtatcttgtccctgcctccgttcagatccccactcacagaagccttccgtaagacgccctctgcaaaaccaaaataacatcctcttccttcttcttacccaccgccacaccgtgcctcagagacacagaggaactggagaggcagcagggggatgggggccatctctgttgcctacctagtccttgaagttgggagagtcaccagacaggcctttgctgcagtctgggtcactgcatctctgtcactgctcttccacacaggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtgtgcgcctgccaccccccaccccatccttccagtccctctacccaaacgtctacctcacatccagcgaagagtctggccctggcgtcaaacctccctggctgcggaccccagctctgctgcccacagccgcttctccagatcactcccatcctccataaaacagagacagtagcagcagctcctcctgggtgacgaggaggaaatgtgcaatgagcacaggcactcaggtgcacagggcaggtgctgggaggcctctgcaagtgagggctgctcttgtggtcttggttcttcacggttgttaacgttcttactgttactatttagctttagaaatatacctggttctctgtcctgattctgccacttgctggcactgttaccttcaaagaatggggaaaagtgactttttccccattctgtgaagttaattgttgattagccagtagtataggaacatactccctgagctgaaaaatatttccggggaatccagatccagtactcttccgtggccatcacctgcaccccatccctctcttcaaaggtgacaaaggcacaaatgaggggaatctttgaggatctttttctgtgcacttaagtacatgggtgctgctcctagaaactcatttttattctgtgatgatcgatccccaccctggtacccccaccccccaacacacaaacgggaccttcctaggcataagggtcctcggctggccttcctcgcttcactccttgtctgctctgagagttcctgcgtctgggtgggagaagtcgcagggcacgattgcggagtccctggattgcccaccctacactgacatgctggctcaccctcccaccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggtgagggggctgaccctgcaccctcctgtccccaagaggcttcctctcctggtgctgccctccctttctgattgcgaccacctccctcttcgtcaccccccgagtcagtcctcctcgcacccatcccaagtctcctctcctcctccccctctggaggcacgttcaaggttgtagttttgcatgtgggctccaggtcgcactccctgagctgttcctcagctctgccacttgctctgagcttgctctgcgtggctttgtcactccctctctctgccattttcccatctgtaaataacagtgctcacccatgggcctggagatagacttctctacaccccattcactacctgagttggttctgtagcttcctccctatccgtggcctccagcttactcgtctatcctccacacagcagctccaggaacattttattatataaatccttttattacttccccacaaggaaccttccatggttctccattggtcttgggataaaacacagcctccttactgtgaccagtgaggccttatgtgacccaatctctttggctttaccccccgaacattagccacattggccttctgtctgttcctcgaacatgtcaaattcagggcgctggtgcttcctgttctgtccacctggaatgctcttccctcaactctatgtgtgggtggctccttctcatccaccagtgtactcaactgtaacttcaaagcggccttttgaggccaccatatctaaaatacccacacccttctccacccgccatcattccctcccgttcttatgttcagtgaataaagttaggaatccctgtttgacaaacggaagaaatgagtttcagagaggtgcagtctctgcccagatcatccagccgccagcttttgaaccctgttctgttcacctccaaagctttataaccaggggcttgaacaagcagcccctgagggagggcctgctggccctgagctcctacaattcagcagggcccgggagccaggcggcctcttcctctgcagccatggccctccctccatctctggcaggatcttcaccaaggttgtgctggaggcgccactcatcacagagagtgccctggaggtggtccgcaagtactgcgaggatgaggtgaggacaggccctggtcagtgcagcccggggcaggggacagggccctgccctgaggggtctgaagggcacacagtctaaaccttgtggccgggggttttgtgagggaccgggcccttttgtccaggtacctgatcagaggcaggcaggaaagacagagcccagaggcacactcaggtgggctgagctcgggtccctttccttttgctgcagagtcgcacctatctgggcatgtccacacttcgagacctgatcttcaagcgcccgtcccgccagttccagtacctgcatgtcctcctcgacctcagctcccatgagaaggacaaggtgatcccctcctccacttcctggctgccctcagcctgcagcttgcagaggccgcctctatcctgagtaaccagcccacgtcttccacactcccttgcaagtttctctgggcccattcccttctttcagtggttttttggctatttctgtctgtttgttttattttcattttcagtggcatcaagctgcctagaaaccagggttaccgtgcctgagtctgcctgcagtgtgtacacacacacacgtgcgcttgccctcctgggaagggcagtcccactctcgctcttagtccacccgtggtggccagcacaggctcctcgtgcagcccagtcctgtgccggggcctgagggcattgcccagcccagcaggggagccggtgtggcctcagccagcagtgaggacacagcgtgctcagcagctgagcagagcagtgtgtggctgccctggggagggaggggccgaccatctggttgtggggtgggcaggggaggtgtttcaaggaaggcttctttcaaggaggggacttgtacgctgagacctggaaaatcagtagctgggtgtgctctagacagaggggacagatgtgcacgtgctgtggttgagagcgcccttgacccatcgttgcctgcagccttttgccccagcccttgctgggtagcgttttcattcattcagcagaccttcatctcacacccctggccctggccctggccatggccatgtgctgctgctggggtcagagtgcccaggaccagacccttccctcacggctcctggcagatgatatctgagtgaaacagggtttagctggcagtagacgttctagggagacttggcagggagtggcacttttaaggaactgaggagctctccctctgcttggagcttagtgagcaaggcaagaagcagtgatgggcagatgggctggagaggcaggcagtgaggtggtgctgcgggtccggccctggccaggatatctgcctcctgcactggggaccagccctgggccctggtaacagctgggctgccccttctcagcctcgggcttgttttcacgtgagtgttgccatgctcgcaggaatagctgttcttcctcttacctcttccctgaccctgcccttctccatcttcctcctcaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacaggttgggcacaggtcatcagatgcatactgagcgctgctgtgtccgtgctctgggccctgcgagcagaggggatgagtggggaagccactcggacaccagtgacgggaatgggcaggactgggacagccacctgggggctgtgggagtcagggtagggggcatctggcccagcctggggggtcagggagagagatctggaggacgaggagagccagccatcggtggggcctgaggaaggaccaggcagggccatctcaggcaggttccctcagcagagccctggattacagacaggtagactcagaccccgagtaaatggaccattaaatgggaaggcttgggccatgatagggcagcacgggaggcctggcccaggtgccaggaagcattcccaggagatgcacagccttcgggaggcccagaagctgagcaggtgccgtggaccaggcaaagaggagggtggatgcaaaggcaaagagaccagggccctcgggactgttagaatgggtatgtgaccaacatggagggcagcagagcagcagcgggccggggccaccccatacaacacctggcagacagtgtgaggcagggagctgggggtttattctgaggccacagggcaggcatggctgggcttggagccagagagggacagggtcaggatcgcactttagaaagatccttctagttgccttgtgtgttggcagtcacgggaggctggaggtgggaagtcctggtccccgccatttccctgccctagaacaattagctccccagccccggctcccttctctgccctccccggctccactgcccaagaagggacattcctgagggtccgagggggttggagaagagtgtgggccaatctgatgcccgctcctgccctgtcagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccggtgaggcccctgagcccaccaggccctgcccacccacgggcaaggctgtgtccccagctccagctcttccccaacctgctccacctcagagtgtgccaagcccgaagggtggtcaccccgggccgacccaggctgtgtagcttgcaggcggtccgcatgtcactcctgaggaaacgtcaagtggcccggcagttaggagcttggagctgatagacctgggttcgcgttcacttctcgctttctcactgcgaccttgggcccgtcagtaaaaatggggaagacgttccagtccctccacgctgatgcaaggagtccatgaactcaggcacataaacctctgtgttactgtcactttatgagctggccttcctggtgttgctaacgggactctttagctgtcattacataaacataagtccttcctgcccctctctctagaggcacagggctgcccacatgagaagcagctcagtgacagactagcacctgagattagaaggtctgctcttccagtttgcagcaggatttgaaaccactttttttctttctgcccctgacatttttggattacagaacattttcgtgataaacgggagagagaagtgtatgttaatccccacctatctgccatttgggttcagtggggcccttacctggaaaatggggataacaggcttgtagtcgggaggaaacagatttttagccccattctcaaggtgctccagctgtggaaaagtgatctcactttgcagaaaagtgatctggcagggctgtgagcttctcgagggcagagacagtcggttttagtcaggagcgtaaacgttactgggcagaggtggagcctggccctggctcctgtttggcattcaccgcagggcaggctcaggaagcagcagcaggtggagcctggtctgggctcgcagccaagccagctgcgcctgagaaaccgagtcacgaagcaggtgggtggagccagaaacatcttcaccagtgaacgaagcacagggtgggcattcgaggtcaggtcaagtctgagccacagaggagtggcccgcaggagggcagcccagccagggctgggagctggagcaggcccatgtctggaggagctgcagggagatgccaaggttcctctgactctcctgcccttccccacctttcccccgccctccaaaccctgtcacctcagtctcaccctgggcgccagcatgccccgcagccaccctgccgggcaacacctgagcctcccctaagctctcactctgggtctggtcatccctgtctctgcctctagatccgaggaatgggcatgaactccccggagctgctcctgctggtggaaaattgtcccaagggagcagagacactggtcacgagatgtctgcacagcctcacagacaaaggtgaccctggagacccccacctttcatggctttcctccctctccttagccttccccgggccctggggatctgagctgctgggtccccagatggtcgtacctcttgcgggtctgtgcctgtcctagggcctcagtttctccatttggaacagtgtggtgctaattgcacgtgagcagccaagggtgaagttgccatcccttcctgcacacctgcctgcttctctttcctgggtgcccaccctttcccacgctcccctccgcctccaacttggtgcctcctgctgcttccatgcagtcccaccctccccagagctggtgaagcgggtccgggatctctaccacaagcgactgccagacgtccgcttcctcatcccggtgctcaatgggctggagaaggtatggagctggaggcctgtttgtccctgctacctgggacatgtgggactgggaggggcagggcagcacgttgcttcagcagcagttgagccagaggcacatagcagagggcagaaggcaccttgcctgtggtcagaagtcatggaagccgccgacacctgggtaccctggaaatgcggagcagctcctggcctcatttgcatgggcacccgggtgccaatggctctgctgcttcctcctctacctcaagcaggtcccttcccctctttgagactcgcttttctcctctgtcagacaaggatcaggatgcctcttgggggcacacacatgtgacatgcagggggctcagatggggtgagagctggggagaaagctccgccctgagggtgtggtgagggtaggaggggctcagtgagccagagcttgcccccagctccccagggcgagcagaaggggtggcttgtctagaagggaaatgagggtgtatgtgactcaactcccacccccaccaccttctccctgtagaaagaggtgatccaggccctgcctaaactcatcaaactcaaccccatcgtggtgaaggaagtcttcaaccgcctgctgggcacccagcatggtaggtgatgcagcctcatccccaccaagaggcccacccaccccaggtgctggggcagaaggcaaggtgcaggcacccccctcagggagagagggcacatcctgctccctgggacaccagctgtactggacatctccatgtgtcccggagctcccaggccaccctctgggatatttttatgatggtttcattcacagcaggggcaagaccgtggagctaggggcggaggctccagcagcatcttcccttttaggatctggccacacaccagcccctctcaggcccggctccagtctggcccctcctcagatcttgcccgaatccctcaagctgtgggccaggggcatttcgttttgacacagtcaaaaagaaacaaaacttgaggccaggcgggcggatcacaaggtcaggagatcgagaccatcctggctaacacagtgaaaccccgtctctactaaaaatacaaaaaattagccaggcgtggtggcgggcgcctgtagtcccagctactcgggaggctgaggcaggagaatggcatgaacccgggaggcggagcttgcagtgagcggagatcgcgccagtgcactccagcctggatgacagagtgagactccatctcaaaaaaaaaaaaaaaaaagaagcaaaactttcaacttagaaaaactagcaagggattgttcacccttaccccagtggttggtgctagagaaaaaatggaggatgtctgttccacgcagaccctggtggtttaaaacacacatatagatggctctgggaccatcaaaatagcagcagcaaagagccactccaccagcctcccctccactcccccaggccccacacagcagaaggctccagccactttttggaagcctgtagcctggctccatcttgccctgtgccacaaatgcccatgaccccctgtgccgcgttggagtctgtgttggggaccacacgaggaggtggtcctaccctgccctcgggggtgcacagcccaggggcagagagacccagccgtgccacacgctacccagggtgggagcccaggatggggaggagcacacagtggcaacctcacgctgcctgagggctgctgctgccttcggtgtcccctttttatgttgtcagtcacttcccctgttccagccctgaaagcagagggcacctcatctttgctcgcagctcccccgatctggggaactcagacccatctcttcacttatgcgtccgcactgtcttcccccacccttcctcccgcctgctgcaggtgagggaaactcagccttgtccccgctgaaccctggagagctcctgatcgcattacacaacattgactccgtgaagtgcgacatgaaatccatcatcaaaggtgaggcgcttcccccccactccagtggcctggcccctgcgacgccagggcaggacctcagtcacccacatgcccccactggaatctgccaagtgcaaagactgtcactcacagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttcctcccaggttttaccctttacaacccacctttttctgcctctgatgtacctgctgtgccctggcacagagtgggcctaaagcagttgggtagccccacccctagccccgaggaacagaaggaagcagggcacaccgtgagtggtagaggcgcagcagcagggcagacccagggctccagggcacttgtgggccagggtaggtgaggcaggagagcttgcctgcagggcggcagggttggtgacgaactggccgcctcacgatggcccccactcactgagcactctgcgctgggctctccctgaacgcctacaggcctgagcctgctggtccgccacttggtgggtatgttcacttccattgtgtagacaggaaatggaggctccagagaggttaggtgacttactcagggccacgcagaagctaagtggtgtggtagaagaaacagaatctgaagtgaaacggacctgggtgggaatcccagctctgccggttcagcgtctaaggaccacctcccctgagagcgcccacccctccatccctcctgagcaaggtttctgggccaggagccatcctgtcccacggagctggacaccctcactgtcgccctctatactcagaagactgctgtcctttgatttctcttctcaccctcagacgggaaggggcttcctctctgtgctgcttactttcgtgttctagcttgaaacagcttttcagtgacttacttcctaaccttcctctgcaagttctctgagaaacgtttaaggtcaagagagcagcttatggaaatgtcaaacccacattataaaacccaggaggcaccaaggcctctcgtgggagaccagcagggaggaaagatctccaggctcataggccagggctgtggtcttcacattccccgacccctttggtgatctgaggaaagttctagcccattcccaggacagtatgctcatattatttgcatacagtttgagggggttcacacatacacacacacaccccaaggccatttgtggacccagattagaagccctgaggatcctaggtccagaagaaagggccttgtcggaggccacacaggccaccaggagccaggcccctgaagatccttggcccaggagaaagggccttgccagaggccacacaggccaccaggagtgaggcccccagaggggtcagcagggcctaccctacaccaccccacccttcaacacgcccaggcgtgcacgctgcaggccagacaaccctccagctggtgtccccagcacccaacccaagtttttctcctgctcaggcaccagcagtcttcctggttgcactctaagctccagatcacaaagtcgagtccttttgttgtgcactgttcactcccccgtagaccaccctgttcctctggggagcttgtctataactagacccactcctggtagtccagcattaagaaaagtcagcacctctgctcacccatatccatcctgggtagtgctggggacacaggaaagacagccctagccctgtccttccagggcttacagtccagggagagacaagaagtccctggccagtaacaactgagaggggtggcctgggactgggcagcccagaggggccatgtaacccagcctgggtgtgggacatcagggaagacttcccgaaaaaggggacactcaggctgagaccaaggaaggatgagtaggcggcagcagcaggagactgcagggaccgagggaggtgcttgctggctggttctggacctaggggacgaaggagggggcctggtcaagggaggaggtcaggctgtcgccattgggaaaggtgcccctggggcctgcccacacaggagtctcgcaggccgaggtgggaatttgaccttgtttcttgagggtctctgggaggcaagtcaggtctgagctttccaaaacacccttcaggctgctatatggagaatggatcggaggctcgggggaggcccaggtggggggctggggcaaagccgacagggaaggaagaggggaggggtgattctggagccttggggtggctgagcaggcaggaccagtgaccacctggccctgacgaggagcaggggcttcctcggtttctggcaggtcctcacctccactgtctgctctgcccattcagcctcctccccacctgtctacgccccccccccttagagaccccacccctgttctccattagcctctcaaggatttggggggttggggtgctcttctggctcaataaagacttcctggttgacactcacatggcaagtggtgtttggggaagggcttcaaaggcagctcctggggcctcccattagcactgtggattggggcatggccacccactcggggaacagaccccagggcctgccttcatgggtgcttgtgctgtgccaaccctctgggtcctactggtactggcactgggtgttgagtcggggggtcattgtatgccccggccccagccttctcttgtccctcccttcgctattactctgattgtgcccatatgcccaacacagcccttagcctggcaccccccatcttcccagcaccagcgcaagccctgtatccttgtcaggactgggtgggcagtcccttggccctctgacaagctggtctgtggactgctgttctctctggaggggctggtagaaaccaatagctgccttccctccctagcaggggtggggggccctgccactcccccagggcttggcaacacatctttcccaaggtcgtccttaaagtgaggggccacgggttccctgttccacccattttggggcttcctggagttggatgtcttctcccttgaaccaagcctgcaggttttccaagggcggggcttgcagtgtgccttctgctgggtcgggggagtctcctgtctcccgcaggggctttagaagtcagggctttagaagtcttcccctcacatgggcagacagcagaggccgggactcccacctcccagggggcagctgggcagagaggacaggcccactctccgcctcctcgcagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtaacccatccccggccaccccgcctccaggctgcagacagcagcttctagcctgcttgccctccccttcccccgtctgaccccggagggagcccggtggaggacagcaggctctgctctgcctcctgccaagaaaatagcagtgctccagggtgtatgactgggccagctcccaggtgatgagggagggcagctgggtggtaggagctgtggtaaccctcaaggggtgtgcacccgggagaggcatggctgctcctcaccctccaccgctgtgtgcccggccaggatgcatcccagagctgaaaaatggcccagttttttaagaggtgctagaaatttgggctttagaaataccacgataaggccaggtgtgatggttcacacctgtaatgccaactctttgggaggccgagacaggaggactgcttgagcccaggagtttggggctgcagtgaggaagaaacgcgccactcactgcactctagcctgggcggcagagtaagaccatctctcaaaaaaaaaaaaaaaaaaaaagagagaacaaaaaaaccaaaccccgcaggactaatgtcgccccctggaggctgcggtgagaatgtacatgtgacccaggacaggtcccggcaccggcacggacctccgctgtttagcaggggtaatttcgccccctggaggctgccgtgagaatgtcatgagaggtgctcccgcagcacttagcctgggcctggcccagggggagctctggtaaaaggcggctgagttttcttccacccccttcccaagttgccctcgtggtccagccgcctggatcgggaagacaaaggcctctggagggaggtcggggctgcttgttgcccatccagaggaatcttggatggtgggatttgggcatggtcttggcaaggtctttctcccagtgtcaaggctcggggggatgcctgtgtgcctctcccgacggctccctccctccctggttcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccaggtaccccttccccccaccaggtaccctttccccccacccagggtgtgcggtgggcggccccctgggtccctctggttggtggggactggatggaggcggacacaagaaggccctgcactgctgggagttctggagggttagggcccccggacctgaggtgtgcaaatggggtctctgtgccagagctgcccccagcgcccccttcctgctctccacccagcaagctcacatccctaactccatcatgaccatcttggaggccagcggcaagcaggagccagaggccaaggaggcgcctgcggggcccttggaggaggtgagggccctgcagcccacccatctggatccccagactcccaccccctaccccaagccagcaaggctcaccatggcctcctcctgaccccgagagactcaggccacccctgcctctgggccacccgtctcccaggggatgctcctgctgggagttgggggtctgggggacaactgccccttcctccccatgctcttggtgaagaactcaaagaccacctcagggtggttccttctctttccggccgtcctctgagccacccacctctgagcttctgtgtggccctccctatccccaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggtagggagagcagcctccgctgcgaaggaagaagccggatctgggccggggtgaaggtgggggaggaggggccatcagggggcagggcctgaaggggagcgtggaggtgaccgcgccctccacccggctgccctttccttccccgttcaccaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaaggaaaaaaaaaaggatggcgggcctggggcgcgggtgccgtctcgagtctggcgcgacgtccaccgtggggctgcgcgggatcgggagtgcgcgcccagagcctgcgcggaacccaccctggcccgctccccgcgccctccacgggtaacggccccctctctcggtgctcagaaaccggcggtgtcgacaggtggctctcgcttggcctccttgtctgcaagcctttctcctagagatctgtgcctcctggcgaaccatgggagacctgccgccctaccctgagcgccctgcccagcagcctccgggccggaggacttctcaggcctcccagaggcggcacagtcgggaccaagctcaggccctggcagcggaccccgaggagaggcagcagatacctccagacgcccagcgaaacgcccctggttggtcacagaggggcagcctgtcccaacaggagaacttgctgatgccccaggtcttccaggctgaggaagcccggctgggtggcatggagtacccatctgtgaacacgggctttccctcagagttccagcctcagccttactctgatgaaagcaggatgcaggtcgccgagctcaccaccagcctaatgctgcagcggctccagcagggccaaagcagcctgttccagcaactggaccccaccttccaggagcccccagtcaaccccttgggccagttcaacctctaccagacagaccagttctctgaaggtgcccagcacgggccttacataagggatgaccctgcccttcagttcttgccctctgagctgggcttcccacactacagtgcccaggtgcctgagcccgagcctctggagctggccgtgcagaacgccaaggcctacctgctgcagaccagcatcaattgcgacctcagcctgtgagcaggggctaggagtggggcgggtgggggacccaggcagggaggggccccacccgaagtgcctgcctcagtcagtcagacaagggatcatccctcatggaaaaccagtgactctaattcagctgagtcggaatcaatgccaacaacagctagcattcacttcccagacatgtgctggcactgcacacactcacctaattctcaccggagatgagcacatcagctcatcctactttacagaggaggagaccgagacacagagaagttgggtcgcttacccaaaactacacagctaggatatggcagagtcaggattccagaacacgtgatttggctccccaagccctcttgctttttttttcccccagacatagtctcaccctgtcacccaggctggagcacagtggcgtggtcttggcttagggcaacctctccttcccaagttcaagtgattcttctgcttcagcctcccgagtagttggggttacaggcgcgctccacttaacccagctaatttttgtatttttagtagaggcaagatttcaccatgttgcccaggctagtctcaaactcgacctcaagtgatccgcccatctcagcctcccaaagtgctaggattgcaggcatgaaccaccgtgcccagccctcctgagaccctcttatcctgcaactaaacctccctgcctgaggaagatacttgccaaagccacttagctgcagtcacaaaacactgctctcagcctccattagatacccaggatgctctcattctaggagagtggacaagaaacagaaaaagtgataaactgaagctaaggactcaggtgaaaaataagggaggctaagagggctagggaacacatgaaatagtgggggtccaaccaggtgcggtggctcacgcctgttatcccagcacttgaggaggccaagacgggcggatcacctgaggtcaggagttcgagaccagccttgccaacatggcgaaaccctgtctctactaaaaaatacaaaaattatcagggcatggtagcatgggcctgtaatcccagctcctcgggagg

SEQ ID NO: 13185 - DNA, 251769 bp, Human
cccagaggaaaataagtcattatacaaaaaagaaacttgcacatacatgtttatagcagcacaatttacaatagcaaaaatatggcaccagtcaaaaggcccatcaatcaacgagtggataaagaaaatgtggcatatatataccatggaatactattcaggcataaaaaggaacaaaataatggcattcgcagcagcctggatggaaatggggactattattctaagtaaagtaactcaagaatgaaaaaccaaactttgcatgttctcactcatatgtgggagctaagctatgaggacacaaaggcataagaatgatacattggacttggggactcaggggaaagggtgggggatggtgagggataacagactacacattgggtacagtgtacactgctcgggtgatgggtacaccaaaatctcagaaatcaccactaaagaacttattcatgtaaacaaacacaacctgttccccaaaagcgattgaaatacaaaaataaataataaacactcggaaaaaaaaaatagcctcaagtaactactggctacagtatttgaaaggcacacctctaaatcttaatttttttcctttctaaaatgggagtaggcatgtgcagtggctcacatctgcaatcccagcactttgtgaggccaaggtggagcccaagagttcaagagcatcctgatcatcatggggagactcttgtctctacaaaaagtaataataataacaaaaaatagccaggtgtggtgtcacatgtctgtggtcccagctatttgggaggctgaggcaggaggatggcttgagcccaggagcttgagctgcagtgagccgtgttctcaccacttgcactccagttggggcgacagagcaagaccctatctcaaaaatacatacatacatacatacgtacatacataaatataaaatcagagtaatagttataatcaaattcttgaccaaaggatcagataatacatgtgaactttgaaaaactaaaaaatacaagtattactttatgtagataactattttattattgttttatactcaagaatttctatcattttgaatcagaggaaaatggaataagcagcctgagaaaactgagttccccatatctggtagagttttgaggctgtctggcaataaagaacaaaaatatcccgtagagttaagctaaatcatccctctattacctgcagagaccttccctgggaggtcctctttgactccctggactgaattaatggtcctctaggtataaccatgacacttttcacactgtattgtaaaaaaaagtggtctgtctgctcaactttacccaagaacaggtgcctctgatccccgtgtccttccggttgtcaaccgctgggtacatagtatatcctcaatctgtatttgttgaataattcactagcactgtattcgtgagggtatggttctccggataacttaagtaactactaatctgtggtaaacagaacagctctttaaggacgatgcagatgaatactggctgctgtaacggcccagttggtgcatctcggatgccaggaggcggtccagtgctgatctctttcttttgcccttccctcccgcccttccagtctgtgggatatagaggacctcacagtcacgaggtcgcgacggtccgtgccgtcgtggagacaagcgggacacggagagagaactacatttcccagctgactctcctgcgcgcgcccttgcctgcgcgcggggggcgagtgcaccgggcgctcgctccctgccgagctcttgtcgcccgcccgagcctttgccaggggatgaggtgggaggcgctagaaaccacttagctacagccaaccgcccaatgcagcactcgctcgctccccccgccagcggaagcgtccgcgaagcacaatgcagcactgagccgcggtggaggttgcagcgccacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggtaagttagccgtcctctgtgcctttgggccataccatttcccgggaatctttggagccctcaggcgtattgaaaagggggcatccccatttcccgagtgcgcggggagattttttttttttttttttttaattcgggagggtggtgagaagtggagcaaaaatatatgtgtggaggcgcgcagatgcactggaagccttcggtcaaagcctgtttttctccttctgaagaggaatggggagaatgggaaaggggtgccctgcttctgggccccgctcctggttgctctcggatgagctggtccaaggctctcgggctggtgtctctgcgtccttcccagttgggttccgagagggagggggcggtggggattttcgtaggggagacgtaggactgcaggatggaggagtgagggtcagggtcattattttcgccttttctctccactccctcctttcccggttcctgcctggaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcaggtgagaggctcggtccgggaggtggtcctccgcgcctcccggcccacccgagaccccacgattgcgctcggttgccctggagatcccatgtcttcttgggtgaaatgagttgggtcccgatgcgagtcatgcatggcgctccctgtgcaaaaaagaaggggaaaagggtacaaaaaagaaccaaaataaccacaggccgagggctttgcccgaggggagtttgtgcggggtgccttcagcagtgcggtgagctgagagaacaggcggagagccctctgacatctgtcaagcaaaagccaggcatgcacagcgagaagggaggtagtatttgggcagggtttgaatcatcattgttgttgttttactcctcaaagagacttcataagtgatttaacccaaggttgacactgtaagaaaaaattggaaaaaaacaaggctagacgttcttaagaaacccaactgtaaaaacaagctgaactttaaggttctattcgcacacatttgtggacaccagagatatgcccattcacccctaccttctagaaaaggtgtcctcctccgactttctttattggtagcagttctcttggtttaattagggctgtgctgtttgttgagcatttataaattatgtttttaaaaatctagtttttatcactgtatctgtatttaaatcaagatcacacattcacagatatgcctgaaaattactgtgaatttattgacaaatttaagtaaatacttctggggctgtgtatttttttatttctacacatcagctgatcaggcagttcacccacctgtaagtccatattaagataggacttgttcatgtacttgaaaatttttgtaaactttactgaagcaatggcaagccaaaccttttcacatgtataaatatattcatcagtgctttaagatatatcttgatgatgtgataattatactaacttatctgtatgtgtgaaatatgtaaaaatagaaaatattacttaaatctgtatttgtagccaagtagttggtactgttaacattttgttaatagaaggtgggaaattagcttaaagggctacataatatccatcaaagattattttagtagaaaatcccaatatgttaagcttttaatgatggattcttttatgtgaattaatggttggtaaatgcctattttccttttccattttgactcgtttcaatggtaaaactgaagaagcaggggccatagtttccctatgtcatcgtatttttcaattaattaagattatttctgtggaaggatattttcacaccatttgcaaccttttattataaaaaatttcaaacacaaaagagtaggataaattaatgaacccccagctccaacaattagcaactcatggccaatcttgttttgtctataccctacgtatttctttttctatttcctttccctctctatattgtattgaagcaaatcatatcatttcattcataaaaattataggaatttaccactaaacagtaaggattcttttaaaaatgcaaccatgttactgtattttcaaaaattaggagtaatttcttactactatcaaatatcctgtttttcaaatttccagttctcgtaaatatgtatgtatatatgtatatgtatgtgtgtgaatgtttatatgtgtgtgtatatatattatatatatatatatagagagagagagtatatttagagtatatatttaagtaagtttgtctggaccaggacccagataatgtctgtagattgcaattagtttatttatttattttttgtgacagggtctcactctgtcacccagacaggagtgcagtagcacgattatggctcacagcagccttgacctcttgggccccagtgatccttccacctcagcttcctgagtagcttggattacaggcatgtgccaccttatctggctaattaaaaatttgtttttgtaaagatgggatttcaccatgttgcgcaggctggccttgaactcctgggctcaaatcatctgctggcctcggcctcccaaaatgctgggattacaggtgtgagttgtgggggcctagcctgtttttctgttttctaaaaggtcttttaatgtgtggttctttcccctctatttcttttttttccccttgcaattttttcagtgaagacatggagtctttcatcttgtagagttgctcagagtcaagattttgctgttgtagccagtgctttaaaacaattcacaaagactttctaggagaggaagagagactgagggaagaagagatacagaaaaagaaaatgacaggattgaacctggaaactcacagaatctctgactcatgctggaaatgtctttgggtacctcttgccttttctgtgttggtgaaagaccaccacttttgaaaagtggaggaggtcagtcctccttttctccccatttatggagcaccacttgtgcagttttttgattcacaggagtcttgacttggggtggaaagctattttgggttcatagagcttctactccctatagcaataaacatcacaatagagaagaatgactggtttttggtgaagtatgaatgaattggtaggatttaggtttaaaagtatgaatagatgattaattcaagtcagaaatgaaagcaatgataccatcttatagtaattattacaaaacgttatcccagtgcctgggatatgtgtacatagtaaggtacacatagtacatgttgatgtctctatcacttgggagccactgcactttaccatgctgcttaaactacaggtggaaatcattgacaactaggaccaaatctgacaaaattttaaagacctgtttatcttaggccaacttttcctacagttaggaaacagaggagttttcttgcactattggcatttctagtttccctaagagcaatcattggattgaaaaacataagttgattttttatggcccttgttatttctctaatacttaaatagttctaatttatggcattttaattttagatacccatagatttttttttttttttttttttttttttgtgagatggagtcttgctctgtcacccaggctggagtgcaatggcgtgatctcagcttattgcaacctccacctcctgggttcaagcgatattcctgtctcagccacctgaataactgggattacaggcacccaccaccatgcccagctaatttttgtattcttagtagagacagggtttcaccattttggccaggctggtctagaactcctgacctcaagtgatcctcccacctcggccacccaaagtgctgggattacaaacatgagccaccatgcctggccacccatagatatgtttatcaacttcctttctacttcataaataaaatcagggtgattttctgtgaactcaaaaagcttatatagatttgttgatttgtttctttaaaaggcatttatttatttattttatttatttttttcttttgagatggagtctcactctcttgcccaggctggatggagtgcagcggcacaatctcaactcatggcaaggtccacctccctggttcaagcgattctcctgcctcagcctcccaagtagctgggactacaggcgcgtgccaccacacctggctaattttttgtatttttagtagagacagggtttcaccatgttagccaggatggtctcaatctcctgaccttgtgatccgcccaccttggcatcccaaagtgctgggattacaggcgtgaaccaccgcggctggcctaaaaggcatttatttatttgtgctcctactctgtaccaatttttatgcaagactgtgggcatttagagataaaagacacagttttcttttaaggaattcttaaagacgtggaagatgagtgggtgaataaacagttatactttgccttgtgattttctggaggtgatcacagaggccagcggaggcagagaaggctagtacttaacccaggtgagcagtcagggtgggatctctggggaagccgtgtttcaagggtgagtttggaattgctgcattaaaaggaagggtgagcatatccaaccaaagaggcagtaagtacataggtacatgggaatcagggtatgtttttgttaattgcaaatagtaaagatttcagggacagataagataaaacaggaaagcaaagagtagatgctgtggcactttcatgacttgctgaggaatttggaatttgtcctgaaggcagtcaaaggatttcagttaggagagttaactgaccagattcatgttattgtcagataatcctaattgttagaatgaataattttaatttcaaagagcacgtgactgtagctgtgtactttagttcactagtaaatgttcacataatctttaagaatcataagaacttagtaaatatactgaaaataactataaatgagttaatatttataatgcacttacaacaatgctgggcatagagtaagcactatatgagtctttgttaaataacattaactccttcaggctgcttgagtactatttagatattttatgacatcacttgaatgcaaaatggtgccttaattacctgagtttaacatagtcccagaagtatgttagaaattactcaaatttatatttaactaagtggaatcaaatagtcctagagatagaagagaacttataggttatctaacctaattcaggaattacttttcacttgttaagagcaagccattggctgggcatggtggcccacacctgtaatcccagcactttgggaggccgaggtaggtggatcatttgaggtcaggattcgagaccagcctgaccaatatggtgaaacccgcctctatgaagggtacaaaaattagcctggtgtggtggtgggcacctgtagtcctgagcctgaggcatgagaatcacttgaacctgggaggcggaggttgcagtgagcagagatggtgccactgcactccagcctgggcgacagagcaagtctttatctcaaaaaaaaaaaaaaaaaaaaaaaatcaagccattcaccaagatggatatgctgattaccctgatctgatcagtatgcattgtatgcatcaaaacatcactatgtaccccataaatatgtatagttattatatgtcaattttttaaaaggttaaaaagagtatggaaatcagcaatgtattacttaatgtttcagaaagcttccaagaactacaatgatataaaccacattaattttactcttaatgtgtccttgtttcaattttcatccccaaattgggacagaaaaattttagaagaaattttcattgtagttcttttaaatgttgacaatttgattggttttaaatagtaattctgttgatataagtacatattgtaagtgatttctttactgtatggttacttgaatgcatatactttatttttatcacaagtgggaggatcagcccactactgaaagcttattatgccacaaagtcctagaaatggtagtcaaagtaattatatttgactgtgggtagccttgctatcttcaaagttgtttacctagtctaaagtaatttcattcctggaaaatagcattcaggcctagaatattcaaaatattgagagcctttcttctgtcttgaaattatttgtgctgaaagaattgtatgtttgcaggtaaaaggataaaacttatacttttacctggacttctgtgtaggcaagatatcacctactgagtcttattgatggtttgatactactcattgtttgatacacataattgctattttttgaataagcaccttaatgattcttttttgtcaactaagcgtcacagatttacatccaggatgttattttgtggtttattttgttgtgttttcaccccatacatttttaatactttgttttttacccagtgattatatatttctacaaggagcaaaatttctttttgttggaagcctttgttgtcagtgaatagacgggctaacttttttcctctggctctttccctaggaagtgttatagcttcccaagtactaaagtgccaaggacatagatctacagtttgtcatagttttgataaccagtaacaaatgggaaaaatgccaaatggcagcaagatggcaagcagtaggtgtgctccatttttattgatgtacttatacatattcctgtgcatggatgagctgtactttacattgtgctgtttcattgaggagcactgagtcagcttgatggtaaattgtctgcagtactgcttccgtggcggaaaatggctcctaggaattacaactttggaagtattttgcgagggtagcacaaactttttttttttatactgtgcatttgttaaagtaagtggctcaatattgataaccttttgccaccaatcagaactttgttctactgctataaataggagacatttcacaatgaatttttattctcctaccaaccatcttcttttccaattaaattgtaaaaaaaagtaaaattcagaatcgtaggagtttcccttagtcttgtttttatgctatgaaatcccaatttgtatatatatgtatttttcgtatctttaaaattctacctaatgaggttatggtgcacagaaggaatcagtctttcatcacttctgtatagctacacataggaaactaactatgaatgactctaagagcttataggttgataaaaaatgttcctatttttatttgctttctcatattgcaaagaatgccaagagttctcctgttgtttttaacaaatagagtcccttagaagaacttggagagaggcctgcttttttctcacaacacactgagaacaggaatctgtaaggtcggtagtattccctaactccagtggggctaattagatagggccatatttatcattaagtagcatggataagccccaaagggaaagaagatagatgttcataaaagtggggctgggggatggagcagaagaaaaggtagagtccttgaggggaatggtgagaaggtggaaggaaaaggaaatgataaaaagagaaaaatacttttaatagtgtcactatatatgttatatactaaaatagctaaatatatggtaacttacatggctaccttttatgtgccaaatggtcttctgaatacttgatgtacattaattcattgcgtcctcaaaaaaatcatgtgtgacaggtaatacttatctgtaaagtcacaaagctgataggggatttgaacctaggcacttcagctccaccgcactgcctatgtgcttaactactatgctagactggtcttatggaagggggccaccaacgattctttagatgccattaaatgttgctggagtcagatttcttacatttaccccattggaactatatatgacttttagtgcctgaaaaatatatacattttaaagttagacaatagtgaagaagcttgcagagcacaacaggaatgtttcatttttattatcttgaaaatgaaaatggaatttgtgaggatatctgacatttaaatggtgaaaaacacctcttgaaggacacgtgtcctatttgtttgtagatatgtacactctctgttacactcgttcatcgtaagtcacatattagtattcagcaatcaacaccaaaattgtatatgcctttttgtggtcaaagtttcataggtagaaacattaattgctaagcagggatccatattcatatatttttctccaaaagaaaaaatacaaagtatcttttatgccttcatagaactagcagtaccagagtcccaaacgtgatatcattcaggtaaaagagatatgtaatcaataataacaaaaaatgatagcttctgaaaacatgtagttgaatgtgtttactttgataataaaagcacttgcaagcaaacattgggggaaatagttgaaaaaataaggattagtatttattaacttaaataaatataaacatttataatatataagtataaatatataatatatacaaaatataaataatatataactttttttgtcatgtaccaggcattgtattgagtgatttacatgcattatctctcattatgaggtagatactgttatacccatttgaagatgaggaaactgaagttaattaacctgcctaaggttatacaggtaataagtggtagaagtgggaataggattctcaaaatgttagacatcaacataaaataatcttttataatctttactacttatttgacatgtggtttcccatttatctctgtgttggaacatacctaacgttatttcttggtctggcccaggtctcctccctagctaacttgcagttattttacatataattaaaatagagtacaacatgctgtattttttaaaatagaaatattttatataaaaatgatttttgacttctggctatcctttacttttgattttatcattagagttccttttaaaatagaagtttgttttgtttcccccaggacagactgttctctgtaacttgattttgaaaataaaattgaaaattttgtaccatgatccagaaatatcagcggttctaactggaaagagaaggaataaagaacgtaaatcattctcccctacccctaaatatgcttgttatttgtgttgaagagattttcagaatcatgtatcagcgaggttaaatgaacatttttcttctcctttttaaaatttaattttgtactaggggattttagcacttagcaataattgcccttttgttgcattttttgtctcaagtaaagattgttagataactctttgaagatgagaaatcgatggtgcttttctgcagataggccttgagagctcacattttgcaagtgattttaaaattttctagctgaggcagaactcctggttgagttgtgtgagaccacttattctgcttcacactgccccatgtctctagcttttacctctagttggtcaatttctattctgctttattttttttttttcaatttgccttttaagtaggtttgtttcggaggaattgccttcatttcctccactagtgaggttaggggatttgaacctaggcacttcaaggttaggatgaggttaggatgttgggggtcaggctggtacacacaatttgctggtacacacaatttggtcattgctcaagcttttttctctgtgtggttttctttctttggattaaacagcatgatgctacaggaagagctaccacttgacagaacctggttctgcagatttctttgatttccctagtggatttttaatgcctttgggatatcctgttagtgttctgttgaggaactcagctgtggctcctcagcaggcataagtggcagttgaggctacacatagcttggtggtattaatctaaagtaggctggagagggagcgaggcgagcagttacctgaggaatgatctaggatcatcagatatggtcaggaacaggctgtaggtaaaagggtggtggcaggtgaggctcagggaaatcagagagcaaatgatcaagagaagatactaggctggtcaggtcagtatccttctggctcaactagaaagagctacctgaaagagtctgaagcactttctgagtttctggctccacccttgatctgtgtcttaggtctttaaagggaaacttgtgttttttttttttttgtttttttttttttagtcagtcttgttctcatccacacatgagctttaagtattcggttcctcctccttccttcttcttcttccttcctattctatatgtgtgtgtttttttctttttctttttattatttcttcctcctctttctttaccttcttgtctttcacctctttcttcttcttggtctttgtaaaggtctgcaggctagtgagagaatgctttaaggggcttcacacttctccccattttacagtttagactttagacactgtgccttgcatggatcaggagatgagaccattaaatattgatttcctaatttatgcaggagtttttcatactctaaaaaatcagtttgtacaaaatgagcaacatcttattttgaatagcatgtggtatgtgttaaataaatgtatgttgtgtaaatgaagagtccctaagttagaatttggaaaattcgttcttactgagatggataattttggtgtcagtcatggtttgccatagattgtgaattttcaaggttggtattagctgcagcttacaaatagttaggaatgctttcatgtgccttccagaaaaactttaagtaagtgtttaataaggataggattttgaaaaacagatatatttacaaatttgccagtatgctgaagaatgaagccaattatttcttttcttttctttctttttttttttttttgagatggagtctcactctgtcgccaggctggagtgcagtggtgccatctcagctcactgcaacctccaccctccgagttcaagcgattctcctgcctcagcctcctgagtagctgggattacaggcgcctgccaccgcacccagctaattttttgtatttttagtagagacgggggtttcaccttcttggccaggctggtcttgaactcctgacctcgtgatccacccgcctcggcctcccaaagtgctaggattacaggcgtgaaccaccacgcccggctgaagccattatgtcttaggaagaactttattgactttggtagaaaccttaacatcatcaaagatgatgaaagttttggatgtatatccagtaatagactgctggattgaatggtagttctgttgtaagttctttgagaaatttccaaattgctttccacagtggctgaataagttcattcccaccaagagtgtgtaagtgttcccttttctccttaccctcatcagcatctgtttttttgactttttaataatagccattctgactgatgtgagatggtatctcattgtggttttgatttgcatttctctgatgattagtgatgttgagcattttttttacttgtttgttggctgcttgtatgtctgcttttgaggagtgtctatgtcttttgcctatgttttattgggattatttattttttgcttgttgaattaagttccttatagattctggatattacactttcattggatgcatagtttgctaatattttgttgaattctgtaagttatctgtttactctgttgatagtttcttttgctgtgcagaagctcttgagtttaattatgtcctacttgacaattttgtttttgttgcaattgctttgaggactcggtcataaattctttctcaaggccgatttccagaatggtgttctctaggtattcttctaagattcttatagtttgaagcatcttgagttaatttttatatatggtgaaagttaggggtccagtttcattcttccgcatataactagccagctatcccagcattgtttattgaagagggagttctttccccatggcttatttttgcccactttgttgaagatcagatggctggaggtatgcagctttgtttctgggctctctattgtgttccactggtctatgtatagccaaaagaaaataaatcattctaccaaaaagacacatgcactcatgttcattgcactattcataacagcaaagtcagggaatcaacctaggtgctcattcatggtggactgggtaaagaaaatgtggtacatatataccatggaatactatgcagccttaaaaataatgatattatatcctttgcagccacacagatgtggcgggaggccattatattaagtgaattaatacaggaacagaaaaccaaatactgtatattctcacatataagtgggagctaaacattggatactcatggacatcaaaatggcaatggtagatactggggactaagagagaggaagggaaggagaggggcaagggttgaaaaactaactgctgggtactatgctcagcatctgcgtgataggatcattcatatcccaaatctcagcatcactcaatataccaatgtaacaaacctgcacatgtatcccttgaatctaaaataaaagttgaaattataaaaaaaagattatgaaagctttgattcagggctacaaaaatgttctcactttttatgatcctgtatagctggtttagctgtaaatagtacatagctttttttctgaattatttcctcgtgaaagtaccttctaacttggacagatattgagtgataagaagataggggaaattcaagaagtgttcattcctgtcaccaaaggtgaagccattctggctaggtaagttactagaggtaagactatgtcaaaccacagtgtatagcagttttcattgactctcagaatcctctaaagtaaaaaaaaaaaaagtggtggggagaggatattggtgccgagatactaagaattttcacttaatttaatttctgagacaagtttagcatgatgttcttatagttcttaataatcttgaatagacaatgttctctcatagttaacgagggaaaagtactatttattcataatcaatttaatatgacatctacttgcggtctttgatgagtgttttgggtgttttcttaagtgttctgattatgaaatgatgaactttgcagttattgtagggttatggaataaaaattattttaatttaattacacgcaataacatggaatgaaggcatggaccctcatcttcatttgtatttctttccatcgttgagcacagacagagccttgtacataacaggtgctcaacaagcaaatattgactgaatgaaattgttgatgccatgacttatagagggccctgtttcttcattaatgctcccatacccccaacattacatcaggttttccctggacaattgtttcttctcttttttcttcttctctttctttcatcatccctcaatataggctctgtcactttcctgcagcctctttccattttcctgtgtacatagctttgctcttttctcattcggtatgacccttggtttattttgtatttccccccactctatttctgccaagcgtctctttctctatgcaactaaagtaaaaacaagtctctgaaaggttatttacattcagtgttgggaaccatccctgtagcacattgctggacttattttgggatttagaaaatgtgttataattcaacacgctttccattttactacttacttgtaaacctatattttgtgaggtttttctttttttccattcatttgtttctgttgtgccccttgaattgctcctcattcattctcctctgtggatgtggattttaatgtcccttctgccctttattgctggaataatctccttcctaaaatcattttcctagttctcactgctcataatcccctggatttaagctttaaattatatgcttagtttaccctctacatttgctgatcatgtcatttttcaaagtctttgacagtaatccattgctacaggatagggatccattgctacattgctacaggattcatattcagtataaaggaatgaccaggcatttttataggtattctaaaagtaaaatttgcctcataggcttggcataaagttgtgcatgcttatgtgtccattaaggaggggattggggcgccgataacttgggtgttagtagaaggtgttcttatgaaacagattgtaatgttgggctcacaattggttattcatattcactattgtttgtgcactgcttagcactgtgcctgacacacagttggtgctcagtaaatatttatggtctacttttgtttcaattttctttcaccaaaaatgcaggaaaaaagttctgtgaccatttgttagtgattgtatgtacttttgagatagttccaagagttacaatatttattttctctggattatgtaatgctttcgttgggatggcatggagaggatcgtggacctcattctacttttatggctaaagccctaaattctttcctcctcttcctgcacttatacccctcctggcccagcagagccagggcctgtgttggtatggccgggctctcaaggtgagtgtttgaattgaagtagctgtccctcttgcttcaaatctgagtcaggatttattaggaaaggcaaagcctattaggaaaggcagggccatgatgacgaggggagggagacagccaaataaaatgacaggaacttggacaatgattggcatactgacgttctaccacataaagtctccttgctgtcttgaggccactataatcactgtgacaaaatcattcatgtcactttatagccctgtcttttccaacaaaaataaattcaagctatttaacctttttgtgtgactttattcaccagactttgtcattcgctgcctggagctgcattttctttaagacaatgatgtatgtcttctgagagagtgacatctactatttctgatggatttgaattcatatggcatattcagccaaggatttcccttactatttatttttagggtttgatttttttaaactatggttttgaactaaggacaacaaccttttttttttcctatagctaagccccagatattttgtctaaaaattaaaaataaatttctagtttttatcttacttttatggactaacaacctaatctaaaatattcatattatttaatatggattaattatgttaatataaatttatatgtaaatataaaatatagataataaaatatgtaagtttaaacgtctattatataaattataacattgattaatatgttaatataaaatatttatattcttttataacttttttatttcttaggaggtggatgttacccatactccatgaaatcttcatgcctctaaaagatcttcatatactagtttaaatcagaaaaatataccagtagagaacaggcacattagtataattagcttcaagaatttatatctcagtgtaaaaggaggctgtgaaagtagctttgtaatgtttctttttttattattattatactttaagttttagggtacatgtgcacaatgtgcaggttagttacatatgtatacatgtgccatgctggtgtgctgcacccattaacacgtcatttagcattaggtatatctcctaatgctatccctcccccctccccccaccccacaacagtcaccagagtgtgatgttccccttcctgtgtccatgtattctcattgttcaattcccatctatgagtgagaacatgcggtgtttggttttttgttcttgccatagtttactgagaatgatgatttccaatttcatccatgtccctacaaaggacatgaactcatcattttttatggctgcatagtattccagggtgtatatgtgccacattttcttaatccagtctatcattgttggacatttgggttggttccaagtctttgctattgtgaataatgctgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcttatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcaaactttttgatggggttgtttgtttttttcttgtaaatttgtttgatttcattgtcgagtctagatattagccctttgtcagatgagtaggttgcaaaaattttctcccattctgtaggttgcctgttcactctgatggtagtttcttttgctgtgcagaagttctttagtttaattagatcccatttgtcaattttgtcttttgttgccgttgcttttggtgttttagacatgaagtccttgcccatgcctatgtcctgaatggtaatgcctaggttttcttctagggtttttatggttttaggtctaatgtttaagtctttaatccatcttgaattaatttgtgtataagatgtaaggaagggatccagtttcagctttctacatatggctagccagttttcccagcaccatttattaaatagggaatccttttccccattgcttgtttttctcaggtttgtcaaagatcagatagttgtagaaatgcagcgttatttctgagggctctgttctgttccattgatctatatctgtgttttggtaccagtaccatgctgttttggttactgtagccttgtagtatagtttgaagtcaggtagcgtgatgcctccagctttgttcttttgtcttaggattgacttggcgatgtgggctctttttcggttccatatgaactttaaagtagtttttcccaattctgtgaagaaagtcattggtagcttgatggggatggcattgaatctataaattaccttgggcagtatggccattttcacgatattgattcttcctacccatgagcatggaacgttcttccatttgtttgtatcctcttttatttcattgagcagtggtttgtagttctccttgaagaggtccttcacatcccttgtaagttggattcctaggtattttattctctttgaagcaactgtgaatggtagttcactcatgatttggctctctgtttgtctgttattggtatataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaagaccctttatttccttcttctgcctaattgccctggccagaacttccaacactatgttgaataggagtggtgagagagggcatccctgtcttgtgccagttttcaaagggaatgcttccagtttctgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatatggtttttgtctttggttctgtttatatgctggattgtatttattgatttgcatatattgaaccagccttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggattcttttttattggtaagctattgattattgccacaatttcagatcctgttattggtctattcagagattcaacttcttcccggtttagtcttgggagggtgtatgtgttgaggaatttatccatttcttctagattttctagtttatttgtgtagaggtgtttgtagtattctctgatggtagtttgtatttctgtggaattggtggtgatatcccctttatcattttttattgcatctatttgattcatctctttttctttattagtcttgctagtggtctatcaattttgttgatcctttcaaaaaaccagctcctggcttcattaatttttttgaagggttttttttttgtctctatttcctttagttctgctctgattttagttatttcttgccttctgctagcttttgaatgtgtttgttcttgcttttctagttcttttaattgtgatgttagggtgtcagtattggatctttcctgctttctcttgtgggcatttagtgctataaatttccctctacacactgctttgaatgtgtcccagagattctggtatgttgggtgtttgttctcgttggtttcaaagaacatctttatttctgccttcatttcgttatgtatccagtagtcattcaggagcaggttgttcagtttccatgtagttgagcggttttgagtgagtttcttaatcctgagttctagtttgattgcactgtggtctgagagacagtttgttacaatttctgttcttttacatttgctgaggagagctttacttccaactatgtggtcaattttggaataggtgtggtgtggtgctgaaaagaatgtatgttctgttgatttggggtggagagttctgtagctgtctattaggtccgcttgttgcagagctgagttcaattcctgggtatccttgttaaatttctgtctcgttgatctgtctaatgttgatagtggggtgttaaagtctcccattattattgtgtgggagtctaagtctctttgtaggtcactaaggacttgctttatgaatctgggtgctcctgttttgggtgcatatatatttaggatagttagctcttcttgttgaattgatccctttaccattatgtaatggccttctttgtctcttttgatcttggttggtttaaagtctgttttatcagagactaggattgcaacccctgcctttttttgttttccatttgcttggtagatcttcctccatccttttattttgagcctgtgtgtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatccttttattatgatgttagctggttattttgctcgttagttgatgcagtttcttcctagtctcgatggtctttacattttggcatgattttgcagtggcttgtacccgttgtgcctttccatgtttagtgcttcctttaggagctcttttagggcaggcctggtggtgacaaaatctctcagcatttgcttgtctgtaaagtattttatttctccttcacttatgaagcttactttggctggatatgaaactctgggttgaaaattcttatttttaagaatgttgaatagtggcccccactctcttctggcttgtagagtttctgctgagagatctgctgttagtctgatgggcttccctttgtgggtaacccgacctttctcttttgctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccaatcagacgcagatttggtcttctcacatagtcccatatttcttggaggctttgctcatttctttttattcttttttctctaaacttgtttcatttcattcatttcatcttccatcactgataccctttcttccagttgatcgcatcggctcctgaggcttctgcattcttcacgtagttctcgagccttggctttcagctccatcagctcctttaagcacttctctgtattggttattctagttatacatttgtctaaatttttttcaaagttttcaacttctttgcctttgatttgaatttcctcctatagctcggagtaatttgatcatctgaagccttcttctctcaactcgtcaaagtcattctccatccagctttgttccgttgctggtgaggaactgcgttcctttggaggaggagaggcactctgctttttagagtttccatttttctgctctgttttttccccatttttgtggttttatctacttttggtctttgatgatggtgatgtacagatgggtttttggtgtggatgttctttctgtttgttagttttccttctaacagacaggaccctcagctgcaggtctgttggagtttgctagaggtccactgcagaccctgtttgcctggatatcagcagcggtgtctgcagaaccgcagatttttgtgatccgcaagtgctgctgtctgatcgttcctctggaagttttgtctcagaggagtacccggccgtgtgaggtgtcagtctgcccctactggggggtgcctcccagttaggctgctcaggggtcaggagtcacacttgaggaggcagtctgcccgttctcagatctccagctgcgtgctgggagaaccactgctctcctcaaagttgtcagacagggacatttaagtctgcagaggttactgctgtctttttgtttgtgccctgcccccagaggtgtagcctacagaggcaggcaggcctccttgagctgtggtggggtccacccagttcgagcttcctggctgcttcgtttacctaagcgagcctgggcaatggtgggcgcccctcccccagcctcgctgctgccttgcagtttgatctcagactgctgtgctagcaatcagggagactccatgggcgtaggaccctctgagccaggtgcgggatataatctcctggtgcgccgtttcctaagcccatcggaaaagcgcagtattcgggtgggagtggcccgattttctacgtgccgtctgtcacccctttccttgaccaggaaagggaactccctgaccccttgcgcttcccgagtgaggcaatgcctcaccctgcttcggctggcgcacagtgtgctgcatccactgtcctgcacccactggctggcactccctagtgagatgaacccggtacctcagatggaaatgcagaaatcacccgtcttctgcatcactcacgctgggagctgtagaccggagctgttcctatttggccatcttggctcctcctctgaaagtagctttaagaccagatgaaaaagtgaggacttgtggtggagaggagaccctacattaaaagataaagatcaaatacagctgttgtgactttagctaacctaatgtaatcccaggaacaaaatagttcctatcttacttatatgtatttttataagaggtttattgagatataattcacacagtatagaattaacccatttaaaaatggtatacgattgagtttttggtgtatttagagaactgtgcagcgatcaccactgtcaattttgaaaccttttcatcacttcaaaaagaaaccttatgcccattttccctaactgcctcccaccctcagcctgggcacccactgatctactttctgtctctacagatttacttactcttgagctttcatataaatggaatcgtacactatccagtcttttgtgactggcttttttcacttatcataatgttttccagtttcattcatgttgtagcatgtatcagtatttcattcgtgagtagtgtttcattatcaatccattcattttgatggacatttgagttatttccattctttggctatttaaaataatggtgccgtgaacatgtgtgtaaaaaatttttgtgtggacatgtggaaacacacacatgaaagtatcgtaaaaattacttattcttattacatacagtggtatacatttcattctgttctgttctatttcattttctttaaaaccctgcctatggtgcactcaagtgatttcagagtcctttctgtgatcttacccacaactttaaaaactaccctacaggattcctcacaggtaagctcagtacctgtgaggcagccctttgtttagacatctctggctaaaaagattttagaaagttgaatcaacatgtgcctccttgtatgttctgtctgttactttttgtttcttgtagttttcctggcaataatattagggacatctggatggttgtgttacttatcccttagctgttctatggtatcagtgaaattgaccatgtgagggtgcttgtaaaactttcttcagtttgtttaatataaaaagcttaagttttgaaataattcaaacatacaaaatggtagatagaataatgtaatggacacccttgtacataccacccagaatgaacaaaatttagtgtggtttgtttcttttgcaagaaactaacgttatagattcagatgatgctctcttgcccttctgttttccccttccttctcagaggagatcattgtcttgcaactggtgtgcatcctttccgtctttgttttcttttcttcttcttttttttattgagatggagtttcgctcttgttgcccaagctggaatgcaatggtgccatctcgactcactgcagcctctgcctccagggttcaagcaattctcctgcctctcagcctcccgagtagctgggattacaggtgcgcactaccatgcctggctaattttttgtatttttagtagaaacggggtttcaccatgttagccaggtggtctcaaactcctgacctcaggtgatctgcccacctcggcctcccaaagggctgggattacaggcatgagccaccctgtctggtctgttttcatactttcatacatacatatatatccataacaatatattactgttttgtgtgtatttaaatgtctatcttttatagcatatatatccttttacccctcctcaaaattaaattttttgatctcttatgatgatataggtaaaagaattaaattcatttctttttattgctgcctgccttcccattttataaacatcatttattcattttcccattagtagtatttatagcgtatttattctgtttcgctgttataagcagtatataccatttgacatacacatttgacattggcatgagtttctatggagtatatatttggaagtgaaattgttgattcctagggcttgtacactgtcaatttccctgtatattgccaaatcaaatagtgatacagcaatttacactccactagcactgtatgcgaatttatgtatagtctccttttcatcattatctggaaccataagactttaaagtttttttaaattttttttattttttattttttttttgagatggagtttcgctcttgtttcccaggctggagtgcaatggcgtgatctcggctcactgcaaactctgcctcccgggttcaagtgattctcctacctcagcctcctgagtagctgggattacaggcacgcaccatcacgcccagctaatttttgtatttttagtagagatggggtttcaccatgttggccaggatggtctcaatctcttgaccctgtgatctgccctcttcggcctcccaaagtgctgggattacaggggtgaaccaccgtgcccggccgactttaaagtttttaacaatattgtgggtatgagatggtatctagttattttactttccattttcctgatgactgatgaggtagagcacctttggtgatctgtatttcctcttttgactggcctattatgcgttccccatttttcaattgaaatttttgtctttttcttgtcgatttttggcatttaaaaatattctggattattctctattatctgtatagcaaatatttatttatcttttagtttatggcttatttttcattctcatggtatctttggtttagcagatttaatttttttatgttatcctatttagatccttaatgattcttggtctgtctgtgtattactttatcactgtggaatttactatagttttagaatatcttaatttttcacaaaataaatctcaaatgtagttttttttttaaaaaaagcattatagaaaagtgattaaatgttaaaggacctagaattagactccatggatttaaagctcacctctgccactagctcactgtgtgaacttggcaaacacttaacttctttaatcttgggtttttacaccaatacaatgtgaataagaatagtacccagttcatatgttgtgaggattaaaaaagataatatacataaagctgtagctgggcgtttggcatatagtaagagctcaataaatgttagctcctttttttttaagctcctataattatcatttcttggtataaaactgatactcggtgtcatatatgcaaatcgctggatttctctgttttcataagagctgtgatttgtatcaaagtctccaggatggtggaacaatttgctctctggtgctagttttggatctagctttggtctcactgcaggtgtttccaaaaacatagctaccagattagaggacaagatgctccgttttaatagtctgttttaatttcctttttaaaaaacatgttttgcctgaaatacttcaatatgcaaatcaaaaggaacagacaggtgatctagaagaaagggcttctaaaattttatagatggtagcatttattataaaaaaagttgagtcttctgtgaaaattaagatgactttgcatttgaaatatatgtatggcaacaatactgatttttaatatagtttttaaaacaatagctttattgacatattcatataccataaaattcactcttttagaatatacaattcagtggtttttaatatagttttaaataaaagtttgtcattctgaattcattgttttttcctttctgtttggactcttctcttttaattattgtgctgtttttggtaccattgtagagtagttgtgatcttaaaattttcagcttcttattaatctgggcccagcattagatgtagccttcagatcaatggaaagaactgaagaacttccatgttcttgcagtggattcccatatttaataaatattttaatacttatcaatcaaccatgtgtttctgaatttctaacagttttaaacagtctttccaaaatctgttattctgaagttaattgtttgtgttatttctctttttcaagaaataattaggttagaagaagtccatatgctttcattttaagcatcatatgttcactgatgaaagtattcagtgttcaggaagaagagagctccaagtgcagatagtattgttgctgctggtggtagtggggtgtgtgtgtgtgtgtgtgtgtctgtgtgtgtgtgtgtagagtattctgcatctcatctccataaggccattgggtcactcttcgtccttatatttcacttgacaagaagagaaacagttatacttttctctgaaccttctggcccttgtgcagttgggtatttcagttatgttagagctattaatcatgcctttttatagctcctcttctctgcagtatgttttcactagaactagagattcttgatttctctttttatcattctatctttgaataatgagggaactgaggggattggcaaatatttaatagactttggttcttgttccttttcttacaaagtttaaacttgccagctctgcaattaaaatttttccattggttctatttcaggttaaggctcagtagctgttttgagtaactaacactaatgcagtttgtgtgtgtgttgcaatttcctgtgatttgatttgtgaactgacatccttttaactcactccaaaaacatttattgaggtcctactatgtggcactgttctgtgcctttgggatacatcagtgaataataaaaaaaattctttcttctgggcttatgttctagcacatagacaaaaatatagtaaatgatgcagtaatacattatatggtacgttcaaaggtgataagtactatggaaaataaaaaatatagcatggtaatggagactggtagtgcaggggagtgtagggggcatacgttgtaatttctagtagggtagtccgttaggcctcagagaaatgacattaggaaaagacttgaaggatgtgaggagtgagtcatacaggtatcttaggaagagcattatatatagagagaataaccagtataatgaccccaaggccagagtatatcggtcaaatatgaataacaagatgactgctccaaagaagattggtgatggaagatcttattggaaactgttctgggaggaaatatttggaatcatctacatttcttgtggtatttttggtttcatcctgtggtctcacagtattggattatcccaccaaggaagaacatacagattttcagtatggtgtctaaatgtaatctcttcccctcctcttcctataatcccacaatgtaatgcatttggattcttctttgcaagacagtattacttccatgcacttaaatgtagttgtattttatgtttagtacaagcatggttatgaattactccttttgcaggatgttttatctggtgcggttggcagatatttttagaattagcctgccgtaaagcttactaagtagcagatacttctactgtgcctaagagatgagcagcacacttccaagctgtctttgaacatgttaatatctagtttcacaaatgggagaaatagggctaaattgcattaagacagagttttgttagtgatttaaaaggaaaagtaagatgattcagcattggaacagactataaatgggggttgaggaactgtctcaagaacttataaaacaggttcaacaatcatttttcaaaatggttttgtgtaggtttgtttccttacaagtgagggaatgaatcatataactcatcgaggttccctgaagctcaaagttccattcttctctgtctgccttatagataatgctcatgcaagtcatgtagccaaatgaccaccaaactcactaacaaatgtcagatgaatataattaacacaggaacacaggtcaaaagtatttcaggagaattagtgtaatgcatatactgttgagagttacactctataaaacaatgatagtgcttgtaattactagagaactcacaaggaaacagtaaagtagttaaactatgtgaaagcaacctttattatgtgagtcctgacaactacttttcacttttggctaattacagtttgcaaaataacttttgttcatgttattgtcagattaacagttgtcaggtttattttaaatttgtaagtgagcacattctttgtgctaagcaaggtgccaaacattgggactacagaggcacttggtatagcgttgagagtggaagatggtatagctataagccatgcacctcaatgagagagggatagaggaattgtcatctggaagtgacaagggaagcaagaacaattctgattcctgaatacaacacgaaattctgttcacactgcttacacttttttttaatcatgtggcagaataatatgcctaacgtttatggagctagaacattctgtggacttttttttttttgaagatggaatcttgctgtgttgcttagtctgggtcaaactcctgggctcaagtgttcctcccaccttagcctccccagtagctacaacaacaagcaccagccactgcagcagctcgttctgtgcatcttacatgtattcagtcttcacagcaatcctcagaggttgatactgtttttcgcagttaataaatagtgaaactgaggcacagagagcttaaataatgcccaggatcattcagtttaggaaggggtggagctaggatttgaacataggaaatttgtctcgaagatctggagttttaaccactatcctatgcaacttttcataagcaactgctcacagttttaaaacagagggaaaactcttggacaaagcaattgagcatagcattatattattgtcttgtaagataataacatgtctttccagataataaaaatctgttggtagggccatatcttcctcagagtcccttttggttctcctggaggtacctgtgtacacagtaggggttcaggacttggtggtggtggtggagacggtgaggcatgcagggaaggccagggaaggacaaaaaggacagcctgaaagcagtttgctaaggatggcccttcagggaaagtttcagtcatgagtctttgccaggaggcagcttcccagaaacccagtgggggaagttcggagcgacaacccacccagttttcagaagtgaataagttctcctagggtatcatttgataaattaaataaaaagtgacctccgtgttactttgaaagtattcatttgcctcagagcaacaagaagtttaaaaaaaactattataaaatatagaaagaatgactgtgcctggcgtttttcctttgtaaaaaagaatcaagatatcttgtaggaaacctttctttaacccagcatgtcaaatgtacagaatcctcattaaactgcactgatttgtctccagtagaggcaagaattacagagtccgatttattcagcattgtatccaaacacatcaacagcacagaacatgaagaaaacagtatctgagcccctgtatgctcagttttgttaaggctgagcagctaatcagagggaaggaatgaatggctctcctctagctactggctccagagctccaccatcctgtgatggctccttgtaattttattcatcttttatgtttctgatactgttggggtcaagttcaatgagcctttgatatgaaattgtttctattaagagctgagttcatgccagtgaagaaagagttttgagagtaagggttttatttcttttaaatattcagatgtgaggctgtaaaactaattagatatcaccaaggttatattaatatatattttttcttgtaataagatatatttcagagctaagggtagtcttcatgtgattctgactttacatcactagacactgttactatgtcttaagtctgtaagacccttcagtggtgatctatatcctatctccctcatttagagtgcagttgtttctcctatttccagctcttctgagctgggctcagcactagaaagtttgcttgctttaagtggtaattatcttccaggttacagttggctacaagcttttcctgccataatgtatacacgtgcacacacaagcactgttggatgtataatggataatgtgacttgatttgtgcagtttttctatgtctcctaataatggtatctcttaggatttcctgctttcaaagatgatttggagtcagtgtattttaaaaaggcatttcacttttctagggaaagtttaatgctaaggattaggtgacaagattgatctttttttatcacaggggctaatagtgactagctccaataaataatagaagtataaataaaattaatttctagagtctcttttattacctttgtctaacagaataatttgattatttttcaaccccttaggttttttattagaacgtgtttgaaaaattgtactcatttaatttttttttagattcagatgtttttgaagtcagaatcccagaagaccatataccagatacaggtaatgcagtacctataacaaaaattttcattttggatgttagtattttctctcaaacatgaattgtggatggattctttcaaccttcctggaactcaagggcaaggagttactcttcaaagcagcttggagacaccagctggtagtatgtggaagcctctgagtttaagaatttgggggcagatttaggtcatactgaatcactgttaaagattcttgctattttctaacctatgtgtgcattgcaagactacatggttttaagacatggttttctcagagagggctggtagtctgttttctctctttctttctcttacagacacacaccacaatcccatcttctttctttactgtggtagttaagatagctataggtagtgtgttcttcctaccagtcttcattctagcccactggcaaacaaaaaaaaatgaaatatttttgcggtggttcttgtcgctagaattctcttgtttggtgtcccaataaaggaagcctttggttaaaagaaagaaaggaagaaagtctctggtgtttgacagtcaagtcataggtgaaaacctgtcgtttgcatatccttaacattagggacttaactgcttttatttttctcttcttttttagcaggtactttgctcttagagtatttcttgactatatccttggaaaacttttagacgagtgagatatgttagtaaagaaggcatatggtcctatgtttaaagtttgaaacatagttccatagtttattatatgtaaatgtgtgagcagaacatcctttagaattatatagtttcattccttagtcctaggagaaaaggcctttatacaccatgtgaaattgtttcccaaaggaaatgctatggaatttatttgtgctagctatttattatgggattttgtacaacattatttcctatttttctttcttcagacacttggagctagccctttagtaaaagtgagcctttactctcagatacatctaatgtctatataagcaaataaaatcagggaaagaaaaatccattgatattacagaactgggtgaagtaaaccttgatgtgaagaactcaccattcttagttttattatttggacatggcttactcctgaagttgcctccaggagagattgtgacccagctggcagagacaattcttatttctaattctgtttttaaaattacctgatttagagctaaactgactagttattcatgtgagagtgtagtggcttgacagccatttactcatttttcctcttctctgctttttaccttttgatagttacattagtctctgcaatgagcttttatatactctcttcaccataaacaaaaatgttgtgtttttctcacagcattctgtaattgtgactattttcagcttgcatatggggaaaaacaagatgaagatgaaagttttcctaactctactctaatgaaatatcaagccaatagtggggctgggaagagctcttgtctcatttctccccggccttttctgtaccagaaaagagtatccatttcccagggctgatttgtcggagggatttttgtctgctgattttgttgcatctaaatgttagggttccttgcactcagatttaattatagctcgatacaactatactatattgtgttgttctcagactactaaatatcttaaaggtctgctttgactttcaggattatgtgagtaagcattttcttgttcaggccttaaattgaaggcctagtaatgggcagttaatggccaagatgatggagagactgatttatcagaagatagctgaagcataaataggtaatgaggctgcctgacttcctgaatggagatgagaaaataggagctggtgccagtgtcagcatagtctgtctttttgtctttgcctctggtttgttggagcagggaccaccttggcagccagggaatcacaagagttccgggcttttagtgccttcagaactggaaatgtagcaaggtaaattcggggaatgcctctcaagagttcatcttatccaaggaaagccgtttttttttttttttttttttttttttttttttgtggcatgtgtagccttcatctaggaattcctgggtagtgagatctacatgatgtaatctctgtcctaggaaaatgcatcccaaaacaagggcaagaaattgtttacatcagttgtgatatggtttggctgtgtccccgcccacatctcatcttgaattgtagttcccgtaatcccaacatgtcatgggagggacctggtgggaggtaattgaatgatggggatggttacctccatgctattctcatgatagtgagtgagttctcacgagatctgatggttttataaggggcttttccctcacttcactctgtacttcttgctgctggcatgtgaagaaggatgtgtttgcttccccttctgccatgactgtaagtttcctgaggcctccccacccctgtgaactgagtcaattaaacctctttcctttataaattacccagtctcaggtatttcttcataccagcatgagaacagactaatacaagttataaattttttcatgtaaaataaaatcaacagcaagaatggaaatttgacttggaaagcaagtataagtagataagaattccatgagaattggccatactttagactcacatgaagtagctctttaaaaaatatgggcttggaggccaaagtagaaagattgcttgagctcaggactttgagaccagcctgggcaatgtagtaaggtcctgtctcaaaaagaataaaaataccatgggaattccaatattttgctccttttcatgcctcatttaaaaaaacagtataggctgggcatggtggctcatgcctgtaatcccagcactttgggaggccgaggcagtcagatcatgaggtcaggagttcgagaccagccttcccagatggtgaaacccgtctctactaaaaatacaaagaattagccaggtatggtggcgtgtgcctgtaatcccagctattcgggaggctgaggcaggagaattgcttgagccctagaggcagaggttgcagtgagctaagatcgcaccactgcactccagcctgagcgacagagtgagactctgtctcaaaaaaaaaaaaaaaaaaaaaaaaaagtatattgaggttctactttgtgacaaactgtgccaaggtgcttacagagatattggccctcaatttagctggaaagactatctgactgaatttctttttcttccttttgtctttctcttactcattccctccttttagaaaaaacttttaaaacttttattattttggttgaactcaacaccaaaatgtaggtagtaaattgtcataagaacatacattttacttttaagaaataatgcaggaatttagtaagtaaatattcagttttgaaagttaaacatattttgtcataaatagtgaaggcaaggggagagagctatttttattggacatctattatcacaaaggtctttaatccatttttatggctttcaagataaggagggcatttcttaggttggtttagaatattgcttttcaactgttggctataccttagaatgacattgatggctctttaaaaaatgttgatgcctgggatccactgcagaccaagtgtatcagaatcgctgaatttgaggcataggcactagtattttttaaaaagtttcccaaggtagtctgggtgtggtggctcatgcttgtaatcccaacgaatcaggagactgaggtaggagaattgcttgagcccaggagtttgaggctgcagtgacctatgatcgcatctctgaatagccactgcactccagcctgggcaacacagtgagattctgtctctacaaaaaatttaaaaaatagaaatagctgagtatggtggcacatgcttatagtcccagctactcagaggggctgaggtggcaggatcacttgagcccaggaatttgaggttacagtgagctgtgactgtgcaactgcactccagactgagaaaaagagcatgaccctatctctaagggggaaaaagaaaagcttcccaagtgtattagtctgttcttacactgctataacgaaatacctgaaactgggtaatttttaagaaaagagggttagttggcttatggttctgcaggctgtacaggcttttgcttctggggagacctcaggaaacttaaaatcatggcagaaggtgaaggggaagctggcatgtcttacatggtcagagcagaaggaagagagagagagaagggggagatgctacacacttttaaacaaccagagctcctgagaactcactcactatcacaagaactgcaaggaggaaagtccacctccatgatgtagtcactgtgcaccaggcctctcctccaacactggggattacaattctacatgtgatttgggtggggatgcaaatcctaaccatatcaccaaagaagtctaatgtggaaccaggattgagaataaccagtttagaagttctttgatgtctttacttccatcttgatcttccataatagatcagtaacatatagcgtgccttgcaatttcctgattgtgctgagctgtttgctgtttttgtgcctttgttgttcctgtttcctggagtgctttcccttacattgtcaatctgaggagcaccaatgcattcctcggtatccctacagttgaaggactgctgttgtattttatacatatacctactgttagacttacactcattttgtaataatttgtttagtaccttcctcttgtgactgtgagtttcctgagtgcaagagccgtatccaactcatctttctttcccagagcctggtatgatcagcactctaaaagtgtcgaatggactatcacttatttaattattacagcaaatctacaaagtgtgtattattatttttgctctttaagagatgaggactttcagttcagaaacatgaaacaacctgctctagtttattccactggtaaatggaagacctagaattcaaatgtacctcagccctttaaagtttgttctttaaaaattgtgctattttgttttgtttcattttgttttaaaatgtcctgttgccaggcactgttctacttcttgtaatactaaatgcagatggttggatttcaagaacagtttggtttaaagataatgtgtaaattagatacaatatataatcagcttatgaaaactgtgggtgttactgagatggaaaagggagagtaacatggagtcataagtatagaaatacagacagaaaacactaatgttcttacatttatcataccaatttacatataggtagacctgttgggtagaactctctgttaacagatgccattgtaatacagttctgcttcacaaaattaatcccatatcttgatgtggccacaacaaattctagaatgagaaaccttcatctgaaatagagatatagtatcaatcctttgcagctcttttgccagaagttctcataaggctatggtgatttttcagttgccttttccgatgtagaaaagagggatcatatatacaagccatatatatatatatgtatttattaaactgaagatgttagacttccaagaattatacttgtagtttttttaaactgagctgaaagagtcaaatggcaaatatgtgtttaggacgcagtacctaaagtactgttacatgcattaactcttatttttaataatattaattactttcacagttatcttattgtatactaccatttgattggtaatattcccaccccattggtaaacatcaattcgttattcaggttggacttaattaaaaacctaaagtacctcatctttctccttgtgtcagagttctgattctactatgaatgttgtactgctaactttgctttaaaaattggttatcagtaaggcagtcttaaaaagttcctttgtgtttgatctctgggataggtaggttggccctggttcattgactctagaagatatgaggagaagaggacaggctgccacaaagcaaaatgcatgagaaacgagtgttatattaattccgcattttaatttcagctattgcccatgaataataaataggctccaatctggggattgtatcatgttcttatggtcctaaaattctgtgattcatttttgaatttagaatttagaattatctttatgtaattatactgatttattaagagttcctgccatttggagagttattttatatttttgcatttttcccttgaatcttttgtttcacagcttctataaatgtcagcctcactgcttgcctcaatctctaaagcacatacatactgcaagcacatactttaccatatccatgtaatttcttttccttaagtgacagacatatatatatatgtttaactataactctgagtttgtaaggttgttatcaaattggccttaggacatgtgctgtgtgtcagctatggtcatgttattaacttttagatggaaatggaattctaaagattgttttttatgttttgattttcttgtcatatcttctaaaaatgctctttagagtattttcatgatactgaaataacttctattataatatttattcattagaacccagtaaaacctgcaagtacctccaagctgtaggatgaaagcaaggagttgaaatatgatgaaaaaggcctaccaggaggtgagatgcctactctaccaccaaatatgtgactttggaagtgacttttgcccacactggcctcagtgtccctagttatatactaaggatcttgtattatgtgacctctaggaatctctcaatattattctgtaatacctgaagtacctgtttaatagtttttaaaatcacaattcattcttatgtagtaatttgaaagatggcatttctgcaaaattacgtttttccagtatctctgagaggtattactactttttcatcttcaacttaaagttaataaatattggaatttttccttgacagtaccttagcctgtgtcccccaccaaaggaaattcttggtattatactgattctctcttctcaaacatacctttttccttaaactaaaaaggcagggtctaagagtaactttctgagagccatcctggctcacttcagtggtgttgaataataagcctgataatatagcaactcagtgtagttcatttactttattccttctccaagataaccttaagaagcaaccatattggccgggtgcggtggctcatgcctgtaatcccagcactttgggaggccaaggcgggtggatcacgaggtcaggagatcgagaccatcctggctaacacagtgaaaccctgtctctactcagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagttgttaagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacgttccatgctcatgggtaggaagaatcaatatcgtgaaaatggccatactgcccaaggtaatttatagattcaatgccatccccatcaagctaccaatgactttcttcacagaattgggaaaaactactttaaagttcatatggaaccaaaaaagagcccgcatcgccaagtcaatcctaagccaaaagaagaaagccagaggcatcacgctacctgacttcacactatacctacaaagctacagtaaccaaaacagcatggtactggtaccaaaacagaggtatagatctatagatcaatggaacagaacagagccctcagaaataacaccgcatatctacaactatctgatctttgacaaacctgagaaaaaccagcaatggggaaaggattccctatttaataaatggtgctgggaaaactggctagccatatgtagaaagctgaaactggatcccttccttacaccttatacaaaaattaattcaagatggattaaagacttaaatggtaaacctaaaaccataaactccctggaagaaaacctaggcaataccattcaggacataggcacgggcagacttcatgtctcaaacccccaaagcaatggcaacaaaagccaaaattgacaaatcggatctaattaagctaaagagcttctgcacagcaaaagaaaccaccatcagagtgaacaagcaacctacagaatgggagaaaatttttgcaacctacttatctgacaaagggctaatatccagaatctacaacgaactcaaacaaatttacaagaaaaaaacaaacccatcaaaaagtgggcaaaggatatgaacagacacttctcaaaagaagacatttatgcagccaaaaaacacatggagaagtgctcaccatcactggccatcagagaaatgcaaatcaaaaccacaatgagataccatctcacaccattagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcgtgctgctataaagacacatgcacacgtatgtttattgtggcactattcacaatagcaaagagttggaaccaacccaaatgtccaacaatgatagactggattaagaaaatgtggcacatatacaccatggaatcctatgcagccatgaaaaatgatgagctcatgtcctttgtagggacatggatgaagctggaaaccatcattctcagcaaactatcgtgaggacaaaaaaccaaacaccgcatgttctcactcataggtgggaattgaacaatgagaacacatgaacacaagaaggggaacatcacacaccggggactgttgtggggtaggggtagggggtgggatagcattaggagatatacctaatgctaaatgacgagttaatgggtgcagcacaccaacatggcacatgtatacatatgtaacaaagctgcacgttgtgcacatgtaccctaaaacttaaagtataataataataaaattaaaaaaaaaaaaagagaaaccttgtctctactaaaaagaaaaaaatacaaaaaaattagccagccgtggtggcgggtgtctgtagtcccagctgctcgggaggctgaggcaggagaatggtgtgaacctgggaggcagagcttgcagtgagccgagatcgtgccactgccctccagcctgggcgacagagcgagactctgtctcaaaaaaaaaaaaaagaaaaaaaataaaagaaaagaagcaccatatttcttctctttggcctatttatcagccagaaacatggggaaggtaggttcctgaatattggaagaccacagaaaatgcaaagaaaccaggctcacatttattttagtgaccaccactgcaagtttggtttgggtgagaagtcctgtgttttgggtttgatccttgaggcctcatgagtttcagccctgctgctgaaagtgtcttggttttagccaaactgtggaggaaagtgacattgaatactggtgcaatgaactcattggagctgcttttcaaaatgttcagagacagtgtcagtgatgctgtattagtttcctggtgcttctataacacattagcagaaacttcgttgcctgaaacaacaacaacttattgtcttacaactgtggaggtcagaagcctgaaataggtcttacaaggataagatgaagtattggcagtgctttgctccttttggaggccctaagggagattcattccttgccttttctagtttctagaggctgtctgcattccttggttcctgccctcttcctcttagcactctgatctctacttccaccatcataccttcttctctggttttaaccctgttgccttccacttataaggactcatgtaattagattgagcccatccagataatccaggataatctccccaagtcaaggtccttaacaatatctgcacagtccctttttccatgtgaggtaacatgttcgtaggttctggatattagggtgtaggcatatttaggggtcattattttccctaccgcagattccttctagttattaatgttgttacctggatattacctccttctggaggccttctgagacacccttagacctccatcttccctggtcattctcgacagcatttctctgttttattaagtctgagaatactatgtttattttctaaacttatttttaatttaattgttcattttctgtctcctctactatcagataaactccacaggagcagaaacatgatcagttttcttcactactttgtcccccaaatctaaatagctcccagcacttggtaggctctcagaagaaggttattgaatgaatcaatctgtatatagtgtaagaaagcttgccttatattaaaactatgttaacatactcctgttcctattactatcaataatgcaaacattcttactaagcagtagttaagcattctgtcaatggattttcttttgaatttaagtacatgagtttctcattgggacataactgagatcaataaaataagataccagatgtaaaatggagctgcaggaaaaagaattataattaatgcagacagtaaataccttgccaagaagaattttaacattacctcaatccaagctgtaatcatgataccaaggtgaataacacgtggcccttgtgtttttcaccacaaatttgcaacattaatatttctgattcaaaggaaattgaggtaagagctttaatagtcctacaataaggatggaggagggagaggttcattttaactgaaacatcatttctggtaagcagaggctcttcccaaaacacagttgctagcactctaggaaactcaaagagctttaggtagagggagtgatgttatccattgacatcacattaaaagcaactctgatggaaagagtgtctttctataagcagttaacttatagctgttcagttgttgttcatttatacatccaggggattgataacaaccttcgaatgaatcaggcaatcagaagatcaactaagtacctggtgctggtcaagtactgaggtcttgatgtgatattgacctgtagtgaggaggagatgaggaggctagacgaggttggaaaggcttcatggaagaggggtgctatgcactgaattatgccctccccacatttaaatgttgaaactctaacccccaacatgactgtgtttggagatgggagacttttaagaggtgattaagattacatgaggtcataagggtgggaccctaatccaatatgactggtgtccttataagaagagaaagagacaccaggcatgtgcacttacaaagaaaaggctatgtgaggacacagagagaaaatggccatttccaggccaaggagacaggcctcaggagaaaccaaatctaccaacaccttaaccttggacttccagcctccagaactgcaagaaaataaatttctatttaggccacccagtctgtggtattttgttttggcagtcctagacgactataggtggaacttgatctaaatcttgaaggatgagtagggccgtttctgggaaacagctttggggaagtgtctagttcaggaaaggtctcagcaaaattaatgaatgaaaaagccacagaaaatgttggaatgaacatagcttttgaactaaagagcagaagagagaactgagtgtaggtgggctatgggtaggtgcttatgtaccattatgcctggggtggggaaggtgattatggaagatcctgaaatccagggagaagggttttttttttccttttttttttttgatacagtagaaaatctagggcttacatttggggttttgataaggagccaactttagaaagatcgggggatatgatgtatggcagaggtggaaatgaagggtaaggtgtggctccaagaactaccataaaaaaagaaaacagatttagttggggctgggtattagttgagaagagttaagagttatagttgaatggttcatgaggctgagaggtacccaggtagttcttaatttttgaagttttatgaggattagaatgtgttagcaacagaagtacaagattctcccatacctacttctttaggaggatagactttaaaacagaagaattatcctttctttccaaaaagtcttattattattaatcagactctctcctttcacctaatctcatagtttactgtgtgtgaaatcccagggatggttgaggtcacctgtggccccacagaatcctaagatgtccgttctgggatgtgctggttctcagggagcagcagcactgttggcctcacatactatgtgcagttgctcatgtggcttttaatctctaaaataatgtttgtcacgtttctcattttagtgattatacatattgattttagaggtttggatactgtagaaacataaacacgaaaaattccaataatttggagtcctactgtttggatatagctactgttcatatttggtgagtcgaatggaacacacagttttgcttcctcctttcttttcagttaattcacatgattattcagtatgcaaatattagtgctatgggaaacactatattttttagtttagagtcccttgtggttttctctgggagttcctaggatagcataggaaatagtgaattttttttttctaacacaagaacattttgataggtgatattggcagtagatgtgcagaggtttaattttgcttttaggaagatgtggaaaccttgatgaaattatgtctggtaaattataaaggaaatactatttttaaagtatatctttgtgataagcgaaaaaggattttttggaggtttagatatcttctttctaaatagatcatattcaccatattattttattcttgaattgagcatattttacttattttctttccaaatgtacaaaactttattttaaaggagctagtcacttaaaatcagataagatgaatgaagtgcagtcatcttagaaatgaaatgcttaaccacttgaggtaaactagaaaagtagggcacttgtcctctttgattgggtggtaatttacttcacattggtgaatgcttggcttctaagaaggtgtaaattttactttaatatgttttcacttattctccatgttgaattattttcttatgatattgtaagtgttttgaaataatcataagaaagactaattgtctgattagtatggctgagtaataaataaccttttttctttttgatattgtagttgactcatgttgaccaagcaagcttccaggttgatgcctttggaacgtcattcattctcgatgtcgtgctaaatcagtaagtgttgagttgcacttgcttttgtcagatacacattgaatccactttattttccacttgtaaagttttttcttactatattttactttgtcttcctataccggttaaatactacattttaaactatacttatttactgtaggttataaagtctggcagataacaagaaatatatattcatttgaaattgagcacctataatagagttaagaatgtaaaatgaaaggcaagagttaccccaatattttttgtaagaatatctataacttaagtttcctatgaatgacagtaaattatgacaataatactttgggtattgaagtatcttccttgagaacagcaggaaagagaaggttgcactttttgattaatgattcagaggactggctgcatgatatgtgatgttaaatagtacctggtgttcattagatgctttgatgtggtggtggatttctgtgaggtttctggtactgggattatcctgtgaatacaatataattttagaaatagttgtctatctagaattttaggtttggaaggtgcttttgatttgttgctggatttaatctcttgcatttggtctaagtgtagtgtttaataaatctggttagttactgttcacttttttaaaaaagggtttctatcctacttctgatcatgggcaagtgggcagagaccagggttctgccaggcctatgcttctgagctgggcagaattgggctatagttttctggaagcatttctacaacaggaagaaagtctgaggccagaaattcagacaaatagactaagagtgagaattagagcctgagttgtctgcaatggggaaccagctagatggaagttaatttaaaaaggcatgtaagaggcaagacttaggaccatgttatctggataggtagccattagccacttgtggctgtttaaatttacattaattcattcaaataaaattaaaaattctgttcttcagttgcattagccacattttaaatgctcaataaccctctctgccttcactccctcatctacttaatacctagtctccttctctgtttcattttaaaaataatacttatcaccatttaatatataggtgaattcttatgacattgccatttttataggtcaaaaaagtttgactaccattattgatgtatggccatctaatatttgatattttgattatttatttggtctatagtctttttcctacccctgcaatgtaagctctttgagggcagagattttctttgcttcactgatgtatccttaatataggggttaaactccaggctgggagtcatattgactcagaaaccagaggataggattagccaggagacagaggtaagatgactaggagaggaagagtgaaacagcaaaaaagaagataaatgtttgagactagcttctgaaagctgcatgtagatactaggtgtgatttggaaagtcaggttcttaggtctctattttaataactcccttccatccctctttgaaatcattgcccctgttggtaatctgtgttttctgcttcctgacatctgtaattccttgacttttaatactcaaacaaagaagggatgtttattcatgtccattctggccaaactgcctcacttgctttggagacatccgagtccaaagactttcttttcctgaaggagacacacatatggtcatacttatcaaagcgtgaagtttagaatactggggttgaagcataatttcttctgagatattggcagaaacctctattgggcatttttctttctatttcaatgcaaatttgcaactacaagacatataaaagattaaataagagcataaatggaggtagcctgggctgagaaacatgcactgtgctcttttttttttttttttttttttttgcctgggatcgatgttaaacataggtggcaggtggctgttatctttatactataaaaatcatgatgtgatacaaaaatgtttatcttatttttaatgtagaattttgtttttcgtggtttcagtttgtgtattgtcttaagttggttaaggagcaggaacgtgaagaacaataagttctttaaactttttttttcttatgaagcaattctggggctgtggaacatatagaaaatttttttaactggaggaaaattaaataagtccatgtagctagcttctggttgcagaatggatccaataatacatattttttgattggaatggatggaaaagtatcattacataatgtttcttcttaatgttcagtaaataaaattatctataagtagattatatctataagtagagtttaacctttgagtagtaacttccacaggaggctgataaaaatatggaaaggttaaaaatgaaaagcacagccagtttcttttttgtcaaaattatcaagaaaagggtggggagcagtttttcttcatggggtcgtagttgtgaaatttcactctttaggacagatgtattaacaaaatgaaacatatggcctggtctggccacactagtcctaggctgcattggacctttccagaggtcagcaatgagtcttatattttattgtgaaacattcttcggaaagaagaaagctcaataaagacatgtaactctattatctgagcaattcagtccaatttttttttcttgtacatctcctgttcttgaagaagtggataattaaactgctccaaacaatgcaagatgttgaaaaatgtttcctttcagcagaattctttgatcctttacaacagaggacctgacaaaaaccacacatagtcccccaacaaagaagcaagcactgtctgtggactgtggttggttgtttatgatgtgaaatatataacaattaggaaaaatatcttttatagcctgctttttttggaagggattctgttgtgcagctctcagatcctggatgatccagtgcctaaattttgagtgtattttacagattctcagcttcttgtcttcttatttcaataacaacgaaatggtttttctcactgtatgatccttatagcagtcttcttttcccccagttttacagtaagtggtgggaggacaactaggaactgaagcatgacagatgtcagcagatggggttgcccatgaagaatgggaggtggtgtggggatagggaagagggagagagagagagaagcagaagcagggttagacaaggaacacccaaattctgtttaaaagagaacattcagtcttgccttctctcatttagagaaagcatttccaattagttacctcttgcttgctttatactgtggctcttgaatttgtagggaaagtaaaaatcaccatggataaaagacaggatctgaattcaattggaattgaaagttaactctggaagagtctcatcatgctatatttacggtgtggctgatgatgatgataaaaataaatgatgaggataacattataattaaatgatgatgttatgtgataataatgaataacaatagatatctcactgttattaataaatctgtaactgaatgccttgctgttcaactaaattcattatggtgaatatttgttcccatgtacatttaatacaaagttattgtgtataagacaaatctgtgtttggagtagtttggaatccttatgtttatttcatatatatatatatatacacacacacacacacacacacacacacacacacacacacacacgcatacacaagttttctaagcctctagtaatgctaaaagcttctctagaccctgaagacttagacttgagaagaaaggaaacaaagactttactcttagggaatttgcatctagccagagaaacaaacaatgaacatgttaaataaggtaatttcagagagtgacagtgccatttatagagagtgtctggtgtgaggatgaaaatagcacattcgagaattggttgtccgggacaggccatctctaaggaggtgacatttgaaagtaaggggcccccatgcagagggaacagcaagggtctgggccctgaggcaggaacaagcttagcatgcttgagagacagaaatgtggctaaggaggttggcacagggatagccaagttattaaatgcggttggaaaagtagaaggaaccaaaatatctagggccttgtaggcaacagaaagactttgggtgaaagtctaaacagaggttattgatttttccccacactatttgttgcattattcactacttcccctactggcttatgaacatttattcatcagattcagttattacatatatatatatatatatatatatatatatatatataatttttttttttgagatacagttttgctcttgttgcccaggctggagtgcaatggtgcaatcttggctcaccacaatctctgcctcctgggttcaagtgattctcctgcctgagcctcccgagtagctggaattacagtgcaccacaacacccggctaattttgtatttttagtagagatggagtttctccatgttggtcaggctggtctcgaactcctgacctcaggtgatccacctgcctcggcctcccaaagtgctgggattacaagtatgagccaccatgcctggcccagttattacatattttaatattttttgaaaacaatctcttctgaagatcttttcattgattttagggcttagtaccatcatactatttattgtagctttataatgtgttttaatagctagtatggaaatatgttccattattagttttctgttgcaaaattttcttagatatttttgcctcttttaaaatagaaattcagaataattttgtcattcttcctttggaatttattgtactgtcactaaacttatattttaatttggaaaaaatagacatttttacagtgctgagtcttcccatccaacatcacagtgtattttttaaaatgttaagcattctcttatatgtcagtaaaattcagtatttttgtttttataggccctgaacatatcatgtagagtattttcctaggaattgtatttgtttttgttgctactgtgggtgtaatatttttccatcatattttataattatttattagtgttatacaggaaaggcactgatttgtgttgcaccttattgaactttcttatttttgctaatggctttttattgtttctcttaggtttgaatgtaacattctagtttgacaataacatgaatggcaaataattagagtttttcttttcaaaatgttacttattaccatttcctaccttaatcctttttctagaagtttctgaactgtataatttggtgataatagcatttttatctttttttttgtaataaaaataactaatgttcattgttaagtaagtagagtgttgattattgatttgtgagagctagtctttattgtgttaaagcaatatcttttgtcttatattttaagtaataggtattagattttattgaatgtttttctagtcagttaaagcttccaggactagtcagctttcccattggtgacaccaaccctccacaacaaggcctgtagataggtttggattttcttatttgacctgttattatgatttattatattaatgggatataaaattattctcgatgctgataataaacttgactttgtcatgttggataattcattgttttgtcccatatgttgctggcttctctggttgtgactataaagtagaattacaattcctattttttatcttaattattatgacacaagcccctgccgacattcttggtgtaaattaactctatccccaagtgtttcctttaactatttctgagattagtctctagcttttaatcttataattacattcctgccactggtagatccccctgcagtgacctgcagacagctgctctgccgggcagtttcccttcactagtgatgcccgctaacatctgccagagtggtttcttgaagaacccacaagcccaaacctatctataggccttgttgtggagggttggtgtcaccaatgggaaagctgactagtcctggaagctttttaagagagaaatctttgataaataatttttttgatgtctattgatgtattcaggttttctacttgtttttgaggccaactttgagaaattatagttttgcaaggaattgtccacaccatggggtgttttacctttatccatatttatctatgtgtgcttctcagaaaattctaaaatttccccgttcctattcttaaatcctctttccgaatcctatttttatttttggttatcttatcaaatatataaacttctagggacttatttttgagacaggttcttgctctgttgcccagtctggagtgcaatggcgtgatctcggcttactacagcctcaaccccctgggctcaagcaatcctcccatctcagcctcctgagtagctgggactacaggtctgcaccaccacgcccagctaatttttgtgtttttagtggaaacagggtttcaccatgttgcacaggctggtttcgagctcaagtgatcgcctgcctcagtctcccaaaatgttgagattacagacatgagctaccacacctagcttaggaacacatttgttgcatataatgaaagtctttttttttttttttaaagaattttattggctaggtgcggtggctcacgcgtgtaatcccagcactttgggaggctgaggcgggcggatcacgaggtcaggagattgagactatcctggctaacatggtgaaaccccgtctctactaaaaatacaaaaaattatccaggcatggtggcaggcgcctgtagtcccagttactcgggaggctgaggcaagagaatggcgtgaacccaggaggcagagcttgcagtgagccgagatcgcaccactgcactccatcctgggcgacagagtgagactccatctcaaaaaaaaaaaaagaatttattttatatttcataaaagtcacccatttcaagtatacaattcagtgattttcagtacctttactgagtggtgcagcaatcaccaaaattcaatttttaaatgcttttcatttttcaacaagattgtttgttgccatttacatgtaaacctcattcctggtcccagcccaatgcaatcactaatctactttctgtctttataaatttgtgttttctggacatttcttataaagggaatcatacactatgtattcttgtatgtggcttcttgacatgtttttgaagttcatccatgctatatgtgtcagttcattccttttattactaaatattattgcattgtattgatatatcacattgtgactatccattcacccgatggtggacatttgggttttttctagtgtttggctattataaataatgttactatgaacaatctgtctgtgtagtctttgcgtgcctatatgttttcatttctcttggatagatacctagaagtggaatggttggatcatatggtagtttcatgctttgagaaatgctaagctattttccaaagtaggcttttgatttttttaaatggtgctataacagctgtttttctataaattctattttgcaggagggatgatgtcaagtataaatagttactaaggcttcaggttttcagtttcatgtctcctgcaagtctggaaagagttccatacttctcatggctacgatcttatgtttttgatttatagtaaaactctacctttgaaatctacgttgaacttttgaaactttttaagggttgggattctactattggtagaataccttgaggaactttatatagaccttacatttcttgttctttagctgaagcataattcactttttcttgtttgttctaagttgagaagtggtaaagttgtgaatcccacaactagacttttggaaggctagttataacttcttctcacagacacaaagtctcttgtgctcagcccagggtggccttgttgttagaggggcagcttttggctgcaaagtccagagcaaaggggaactgtattggaaggtgctggaagatccatggatgtgtctggcaaagagctagagaatgatccaaggaagagaccagtactaaagctaagacctaggaaattgtttctgaaggggtatttggaaggaatcctagaggcaacaggaccccagggactagagacttacaggattcaaaaggccaaactcatgggtgaggaggatactgtgctaggcttgagttagctctattataaggatatatccgagcttactagagtagcatcaggctcctgtaacaccttcatgttactggtttatttaagctttctgctttcttgtttgtttttaaaaagtacagacttagcacagacacattatctttcatatgattgtttaatatgacttttagatatttttagtattacctgtttttttaataggggaatctggagattttagcatacttatgagcctgttatttaaattgtaaataaaataattgcagaattatttaatataacttagacaatttgtgttttttagtttttcaaggaaaataccacatacatactatttttatatttgaaatgattgctgtatatttttgtgcaacagatttatcaggtgagtgaaaaatgtaatttgctagatatagtcaacacttccaatgtgcaacaatgaaacctttaatgtaattaaatgtttttgcataaattcctagaagttcttttgagatttttacagtgattagatgtgttaaagattaaatcatcagagctcactgctatttttctcccaggtgtcaaattactattattattttaattattttttttggacagtctcactctgttggccaggctggagtgcagtggcacaatctcagcacactgcaacctccgtctcccgggctcaagcaattctcctgcctcagcctcccaagtagctgggattacaggtgtgtgccaccatgcctggctaatttttgtatttttaatagagacagagtttcaccatgttggccaggctggtctcgaactcctgacctcaggtaatctgcctgcctctgcctcccaaagtgctgggattacaggcgtgagccaccacgcctggccccaggtgtcaaatcattgaactttcttaaattatctagcagtgatagtggtacagcccaaccacagggaactttgccaggtttgacacattgggttcccagacatatttaatgtaatttgtttatgatatggctgttaaactattggatgaacaaaatctttgcaagataaaagattccatttgaataattggaaacttgttctctaatagttatatttgttttacagtaaggactatgttttagagtgaggtataaggtgcgtgcttactcctggtgataccatctgcacagagctggcttaattactttgtctctgaaatatttatctcagtatgtctgtatatcaatctgttacttcacactctgaatatatgtatattttcctgtgtttcacctgttggcatatcttcttagctaatgagtgtgtggcagattgtactgtatacccttgtcctgtgagtgttaactataaccattctcagacagggactgtagctaccttattctcagttgactcctttattattttgtctataataaaattaaacagttttgacctataatggtgcagaagtgataataccagatatactgcaaagaaacaaagaaagattaacagtgactatttaaatgaaaattttagagaagctgaagtctcttcttggaaactggtagagtatagaaatttagcttgaactttctttgaggaaatggtccggaaagcactggataagaatctacaagcagcaaggcatagcatcatggtttgatgttatgaaggatgtcatacacattattgcagaatggcatcttggtcactgttatatgaatggtacctgggaggaactatagctaggtactaatataacactatgggattttgccagagaaaggcactgtgatgcacctctgtgaggactgtgctgtaacaaccacatgtgggtttcattcatttagcacacccctttgccagagcacatacttggccctcagggataaaaaatcagaaacttgtcttatagtaggatatatattaagttagtgttttatcggaaggtatttccatattaattggatattttaaagcaagtcatatttgcgtattttattttaagaaaatcttatgacttactgacttactgataattatttcttcttaacttcagtgttatccaattcaaaattattggagagatggggcctgtagaggccttaagattattttttgtgctgcctttgccctttttactttctctggttctcaggggttcaggtgtgctttttagcaatgatagaagtagcgagtaggcctcttaaattcacaaacacacatatccctaaccctctctagtagacatggtaaaataactctgttacaggcaacttccctttagtcttagtctggagaagtagctttttcactgtattcttttaaaagagaaattgtagttgcaggaagaaaaatggaagattttccctaaaaaattggtttattgtgctttctctgttaatgtccccaggcaagaattagcaaatgaatgattaattctactgtttgtgtatgctttgtttccagagtcaaaagttaaaatagtcaagctttatgccttaatcagagatgtttccacatgaaagtttaggtttggtttttgaaggtgaaatataacatataggatatttgaatgaccttatgccatcacgctatcatttatgaatgggttctttaattaaaacattatttcttagatataaacaagctatggtaagtttccaggtacatagaatagaaacagatggaaagtttaaagagttgatttttatcctgactcatttttgtcaagtgattatttttattcatatttagtattttttagatatttaaatttttcaggctatattattgtatattatttatttatttatttagagatggggtcttgctatgttgttcaggctggaatgcagtggctattcacaggcatgattatagcgcactacagccttgaactcttgtgctcaagtgattctcccctgtatagtattcatactcatgctatatagcctggttagtagaaaactaattacatttgtttttctttgctactattattaacactgttgtcagagatatgtagtttaaaaagtgaattcttgactgggcatggtggctcacgcctataatcccagcactttgggaggccaaagcggccagatcgcttgaggccaggagtttgagacctgcctggccaacatggtgaaacctcgtctctgctaaaatcaccaaaattttccaggggtggtggcacacacccgtaatcccagctactcaagaggttgaggcaggagaatcgcttgaacctgggaggtggagtttgcagtgagcagagatcacaccactgcactccatccagcctgggtgacagagtgagactccatctcaaagaaaaaaaaaaagaattatttatattccaattcaatgtattattgctgatagttacttgagtaacttgaagcttcaaagtatcagaagagaatgtgtttcatactacttgcttatttgttgatttatttactcatttattcattcactcatctatccatccatcaagtgtatatagagtacacttgatgtactctatatacaggttttggggtgatagatacaaaaagataaagaccctatcttcaaggacatgacaacgtggtctgagtagaaaagcaaacagtgatacagtgtgtaaaggagcataaaagaggtatggccagtggcactgggagtgcaatggagctttattgaacagaagtatacgatctgctggagataattgtagatcatttttctacagacactaacctttgctcattttatgtttttacattgtaactgatgaaaaatcatttattttaaatacttttaaaatattgaagtctaacatacaccaaataagtaacatacatgaacatttttaaataattattaggagaaccagaataattattaagataactctacccaggtatagaacattaccagtatcccacaatcctccaatgtacactttccctccccactattggaaacaatcaccctgacttctgtgataatcagttcagtgatttttcattatagttttatcacttatatatctatccctaaacaaaaggtacatttatttctccccttttcttcttttttttttgagatagagtcttgctctgtagcccaggctggagggcagtggtgccatctcagctcactgcaacctctgcctcccaggttcaattgattctcatgcctcagtctcccgagtagctgggattacaggcgcctgccaccatatccaactaatttttttgtatttttagtagagacggagttttgccatgttgtcaggctggtctcaaaatcctgacctcaagtgatccatttgccttggcctcccaaagtgctgggattgcagacgtgagccaccacacccagcctttctccctcttttaaaataattgaatgtagaatggacttgtggatttttatttatgtgatattcacactcaatttcaatcatttttctttgtgatattcaaatctttctaaagttggtttatagaagcccttttgatttctgtgtttttttgacatgaccctattaatctttaagtgcttctttgtattctgggacaggaagagagccttttgctttctgggacaatcagattgactttttattatatcttagaattgatttctagttttttatggtgactagtttatagactaatctttgtcttcatttccctatttcagttgtttattatcatcttaacttattatattaaaaaatgccaaagactgacagctatcactagccttattttttttttttttttttttttttgagacggagtctcgctctgtcgcccaggccggaatgcggaatgtagtggcggaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggaaggtctcgatctcctgacctcatgatccacccgcctcggcctcccaaagtgctgggattacaggcgtgagccaccgcgcccggcactagccttatttttaatcaagtattgaaccaacacacaaatcagtgacaagcatttcaattctttgacttttgggaggattgctttgcacatattaattaaattgagtgaaatataagatctcagaaatagctatttttagaatgccatggtagttaaccatagtaagtttgaggtgataatcagaattttaaagaaacattagaattctaaaggggtaagttcttactcttcccaagattgaaacactcttaaaactcactagtgaaatacttaatctgtttttctctcacaactgaaagacatttgatcagagataagtgaaccttaatcagattcagcttagatcagagaaatgctctctgtgttcaagccactcttgaccatgtagaggaaacaaatatttatctggtgatctatagtgcaagatggtatccacccagggaaagaatgaacaatcttgcctggttaaagggcttctgataaagcttcatagaaaaattggtgttttttgtgggtttcaaagctgtgtaagattttgctacagcaggttatctaaagcagaggaaagagatggaacaaggatatagcgatatgaaagtgcccccagagaattatatgaagttcagggggctggggagggctgggaggctaagatgctttgtttggttggggcctagggaaggtgttggtgactccactaacaaaggtgttaatgactgcactaacaaagggggacttcattttgttggtaatggaggactgtcaaggtttttaagtgaatgttaacgttagtacgtttttcataaagataactttgatagcagtatggaagtttgattaatcatgaaaatagatacttgatatgttttgaaatattgaataagaagcctactttgattagtggttttgattatcaaaataattcctgatttccataggtagtattcgtttttaggtctactgtaagtgaagatattgcttacttattcataaattttttttctatagcacattttgataatgctttggactgaaagtaacaaaaaagtctgactcaagtatcttaaaaggagattcatgatctcgtataactgtaaatccaaaggttgtacagccccaagtgtgactctagccatgctgctttgtcattcttgggtccagaaaagacaaaaagaccacctcttcctctgactcattgtagggaaacggaaccttttcaccaaaacttcagaggtctcgttggctagaactgggtcaaaactcctcttaaaccttggtaaagtaaaaggtacctctgtgattagttgatactagtcaggatcaccgcagaactgaggtgagttcgcctttccccgtatcatataggagaagagaggatcactgaccaaacaaggaatctattggctagtggcgcatggggtggatattggagagatagctagagggtctgccaaagagaattttggtaaaggtaaccttgaggaataaatagacttgagtgctactgtgatactgctgctgagttcattccacagccttgctgaaaagagaaccctctaactactaaatgtacacccctttacacttgatccaacaggtgctccctttatcaaaaataatgaggcatgtaacagtaaaacctgggaatttttattgaattttattcattggtaatctttatacatcttattattcaaccctaatgatatctgtaataaattgctttaaatttttttcattttagtaacttatgctgtaaatagaagaataattcaattagaggtattgaatgtcagattgcacaataatagccctgggcacactgtgaaattcatttcttcagctgacttactctggacaccacctgaacttatagcttccttctgtcagaaagtcagtatgcctcaggccattctaaaggtccttccagcaccttacctgtcatgtgcattctcttcttccctctgctgtgcagtgtggtcaccctgatatcttggttctgttgattacctcttctctgataaatcaatccatgaagataaattggctggttctatcccccttctcagtccgtgtatgtgactttttagagatcttcttgcctctttggggtaactcaaaggattgactccaataggtggtattttaggacagggcaggattttgagcactgtgatatctcttaaacttcactgttgaaaaagcaatatatacacagaactagccctactcaaagagttatttgagcccatgaattcatatttacatgacttctcagagagattccacatattcaagcaacaatcatttagagaaaaaacaaaatcagcttattaataaataataaaattgtttataatcaataataataatcatgaaagtgtctgaatttcctgatataaagaatacactaaaaaccctctttttacaaaaattatattgtggctttgtgttaattgaagtctctttcacattgtgaaaatagttactgtcattccttttttttttttttgagacggagtctcgctctgtcgcccaggctggagtgcagtggtgtgatctcagctcactgcaagctccgcctcctggttcacgccattctcctgcctcagcctcgtgagtagctgggactacaggcgcccgccaccacgcccggctaattttttatattttttagtagacacggggtttcaccatgttagccaggatggtctcgatctcctgacctcgtgatccgcccgcctcggcctcccaaagtgctgggattacaggcgtgagccaccgcgcccggcctagttactgtcattctttagccaaactttgactatgcagatctgatagccttgttgtcacttgagtaacctttttctccattactttttccctttctggatctaattttgatgtgggtctaattcatatctcttctttttaaagtgttcttttttttttctgatcccaccctgattcctcctgtagcttatagctcagattataacagacaacaaagcttaatagaggtcacagaaacttccagttctcactttgctgtgtaccttgcatttaaagtgtgtaatcacagaaactgcctagttaatcacacaagtaggtcttcttcaatgcccatgtggtgaaatggctttgaaacagctttctagcattgtattttttttttttggagacggagtcttgctctgtcgcccaggctggagtgcagtggcgcgatctccgctcactgcaagctccgcctcccgggttcacgccatcctcctgcctcagcctcctaagtagctgggaatacaggcgcctgccaccgcgcctggctaatttttttttgtatttttagtagagacggggtttcaccgtggtctcgatctcctgacctcgtgatccactcggctcggcctcccaaagtgctgggattacaggcttgagccaccgcgttaactggtaacacatagctatggatatgaataccaaaggatttagagaaataacagatgttaatctatccttccctctgcaaaaatgatattgggaatctcagtgcctggatggagtggcataggattttctttcatgaacaccgttgattgctgctgggcagtgtctagaaggactttccttttgatatccctttccaaagctaacacaggccataaattagcctgcaaacccaaggacatcttaccttttgtgacaggttatcccagccatgcaaagttagtttccaccatgtcttcctcatttaactgttttcctagcctagtggtttcaatcctggctacacattataataacctggggaattttaaaaactactaatacctgggtcccttcctactcccatagaccaaatggtgcagtggttttccagagtggtccctgggaccagcggcatcatcgtgggaaacttgttagaaatgcacattcaaggttctcacccagacctactgaatcagaatcgctgatggatgtgacctaaaaaactgtgcttttagaagctctctgggttatttggttcaaatttgagaaccactgatctaatgtttttctgcatgacattcacctgctatagttttttctcactatcttgatgtagtccaaacctcaaccctgcaccgatatgtcactcattcccttacagatatttgaataggaatgtttttaaatttcaataattaaaaactgttctcactcatattctaataaagatagtatcttctggataaatcccattgaaaaccatgaccagatgtttgtttgttctaaacatgtttggccattatgaattacatcaaagaagattcctgctgagccctctgtaactttctgtgacctgagatattgcactcttgatctggaaatttgttaattagctactcagtcagtcactgtaggtttattttgcagtaatagggacacggccgtgcaccaggttattgggattttagatccagtaggaggcacaactttctagaagtttgtaatcatgggggcaggaaagacagctcaacaggaaacctccggcagtagattgtgctggttggctggttaatgtactgtgtactttgtgatgtcttagttcaggctgccataacaaaaataccataaggactgggtagcttaaaaacagaaatgtattccttacagatccaaaggctgaggagtccaagatcaaggctgattctgtcttattgagggccttcttcctagtttgcagatagctaccttcttgctgtacccttggatgacagagagaaagatagtttttcatgtctcttcttataagagcgtgaattctaatctactctcatgacctaatcacctcccaaagtccccagctcctcatataatcacattggaggttaggatttccacatctgaatttgagggggagacaagcattcagttcataacactgaagggaatattattgggacatgcagcctgccaaagtgatcagtgcaagagttcatatagaaaaaggtttaccccataaattctgggatcacgataccttgtatttgttgtgccaattatagatatttgttagatggtatctatcaacatgagaggcagtgttaccaaattggttcgcagcatagtctttgtagccagggtgcctggctctatactatttactaactgtgtgatcttgggcaagtcagttaactgctcattgcctagatttatccacttgtaaaacaggagtggcaacagtgcctgttttattgggtagttggcaggtttaatgagttaatgcatatgaaacacccaaaacagtgcttggcatgtggaggtgctcagtgtgtttagttattattatctaacagatgccctttcctttaaagggttgccatgaggtcacctgtcttgaaggaactgtttaactctgaaaactttaggactgaaagggagttaggcagtgagattactattggagtttgtttgttcgttaaaagcatatctaataaggttttactaaaagtttcaaagccgtattcatgtttattaacttggtaaacctactgaccatatttaaaaaacagaaataaatagttctgaatctcttcagtgcaatttaaaaacccccaaagctctgaaagcagtaacattttgtaaacttggagctcctcatttggcaataaaagcctcacttaatacgcatgaattagttttgtattgctgctgttaactttagctgcttaaaccaatacacatttattatctcatagtttccatgggtcagaagtctgggtacagtgaagctcaggtggattctctgcatagagtctcacaggcctaagtcatctggtctacgcttctttgtagaggctctggagaagaatctacttccaagcctttttaggttgttggcacaattcagttccttgagattatagctgaggctcccactcccttgctggctgttggccctggattgttgcaggcgctgcctgcattccctgggtggtgatccccttcctccactttcaaaggcaacagtggtcagtcaggtccttcacaggctttgaatctctcaaacctcccattttgcctcatctctcttctgctcttattccaccatatctttcccaccaagtcttctgccttcctcttctgcttctaagggcttgtattagtcagggacaggactaataggatagatgtatatatgaaagagagtttattaaggagtattgactcacacaatcataaggtgaagtcccatagtaggccatctgcaagctgaggagcaaggaagccagtgccagtcccaaaacctcaaaagtagggaagctgacagtgcagccgtcagtctatggctgaaggcctgagagcccctggcaaaccactggtgtatgtccaagggtccaaaagctgaagaacttggagtttgatgtttgaaggcaggaagcatccagcacaggaggaagatagaggccggaagacttagccagtctagtcctttcaggttccactgcttgcttttatcctaggcacacttgcagctgattagatggtgcccacccagattgagggtgggtctgcctctcccggtccactgactcaaatgttaatatcctttggcaacacccttacagacacacccaggaacaacactttgcatccttcaatccaatcaagttgacactcaatatcacagggctcatgggattacattagaccccttcagacaatgcaggagaatatcccgatttatctatttatttttttgagacagggtcttgctctgttgctcaaggtagagtgcagtggaacaatctcagctcactgcaacctccgcctcccaggtgcaggtgattctcctgcctcagcctcccgagtagctgcgactacaggtgcacgccacaatgcctggctaatttttgtgtttttagtagaggccgggtttcactatgttggccaggctggtctcgaactcttgaccttgtaatctgcccacgttggcctcccaaagtgctgggattacaggtgtgagccaccacgccctgccgagagtctccctattttaaagtcagctggttagtacccctgattccatctgcaaagtctcttcgtgcagcacccaaatcagtgtttgattgaatagggaataggaatcttgggggacatcttgagaattctgcctaccgtaatacattagactatttatagtctttacttatcccacttagcatgaacatcatttggtacagaaatattaatatgtttgattaaaagttgttatccttcattctgctgggagcattgtgtaatatatgatgtgtgcatatcattacctttctaaaattaaacaatttctcaactccaaaacacatctggccccggggttgttgaagagattgtggacacattataaaaagttactggtgaaagatatttttgaaagcatttattttatattttaaaatactgtgaagtggtacatgtgtagcacccactacttgagagaaagtatgttagtgtgctctccagatttaaatttagagaactaaaagggatatgggagacagactcattattttaaagattcagaaaaaggtatcaatgttacagataagaagggaaaaagatggaagataacatttatgaaacagtatactattcaccttatacacaatcacacaacatagctgtgtgtgggtgtatgtgtcatttaatccttatgatctatgtggggtgttattttccccattttacatgtgctggaatcaagaatcggagactcatttgccaagggtcacatggctagttagcatgtggaactggaatttgaactttgttctgactttaaaaatctgctttctctattcatcgaagaatggtggcagatctgggatttcaactctaatcttctgtgtcaccctaaaaacacccagatagttgtttttaatacataattacagatttacaagtaccttttgaaatatttgcaacattttaaaacttagaggggaaacttacgatgcttattctgttatcagaattgatttggatttatgatatcagttatacgggattaaaattttccattatttcaggatcttttaaaaaattatttaaaccttaagattagattctcaattgaatattttatcctcggataaattctttattaaaaattatttgccagcttggtgcagtggcacatacttgtagttccagctatttgagaggctgaggtcgaaggagacttgagaccaggagctccaggctgtagtgttccataattgcacctgtgaattagacattgtgctccagcctgggcaatatagtgagagcacatctctaaaaaaaaaaaaaaaaattatttgccataaaattccatctctcaaaatgacagagtttaccaatatgacattcattattaaatgctggaaataatatattttccaatagtggaatatgtctacattcagtgttaagtaatctctcattattctttagatatctagtttgttattccttctatataaaatattctcttttgaaaaataaacagctcccctgctgttttatgtttaaactcctcctcactgttttggtctctgttttctccatgtagtaaagtgttgacagcaacagtacagagagataaaaatatacatcaattagagcagcaaatcacagtatagaagctaagtattttagttatggcatgagaaacacagctgtaataagtgtctcaataggaatttcttttgaattgttgctaaaattgtatttcattgttttttattttatgattgtcctagtggattaaaaaaactggaataggcatgcatattcaggattgtgcatcattttgaaaaataaatatgaagtaaagactagttattttactaatgtcttcattctgtttctttattctgtttttatagccacaaagacaatattctagttttgcattatttattataataaattttttaaaatcttggtttttcaggaccaactttatggttcaacaaaataaattacagcttatataacattaattccttaacaaaaataacattacaaatgaagctctgagatggataccagtactgatgatgagaatatgaatatttttccatttagactgaagcttaggaaaattcatatttttttcagcaggaatgaatacaattttattaacttatatgctaggaagtaaagaagtggaatgactaagaggagagaactaggctttgttttcaccttggccttgaggaaggtttctgtccatttcttttgtttgctgtttatggtttgcttttgttttatagacaaattccagctcaggcactatgattgcattatcatgcaattgtttctatcttttggggctaagaagaattgagattggttagattttatgtgatatcctcccaaaaagttacctcatactctggtacatctgtctttcagacaaaaggtatagaaacacatgcaggaaaatagtatacaggttaaatatttcttatccaaaatgcttggggacagaagtgtttggattttaaattttttcagattttggaagatttgcatatatataatgagatatcttggaaatagcacccaattctaaacgtgaaattcatttatatgtaccttacaaacataacctgaaggtaattttatacaatcattttgatagttttgtgcatggaacaaagtttgtgttaagcattttcatgtggaattttacacttgtagtatcatgttggcattcaaaaagttttgaattttggattttagggttaggaatgctcaatctgcataagcttttggccaagacagtatgaaaagcagtagaaactcaaaagctaatattgaggaataagtaattatctcttatttagagatctggtatatcattgtctcttgagaatgggatcaaggctccctaattttataggcctgtgtttatatctggggagtgtgcttattccaaaatgagaggatggcattttgaggtttaaggtcagaactgattgtggcccactgtgtgctgccacttcataactttgtttttaggatagtggttatttcctccttggcatggtggcctaataatgcctataattctcctgttactagcaggtgagaactagcaaggtgagacaagcaggagcaagcatactggaagtttctataacatgtttataggaaagtaaaacttaagattgagtagggatataaaagacccaggcttgagttgcagctctgtaatttactagttacataaccatggccatgctgtgtcatctctctggaggtcagggtttttttttactttaaaatggcaaatgttcttgttctgcttgacctggcagagttgttgcaaaagcctaatgttataaactttgccaagtagtcaaatatgatgcatatcatttgggaatctttcagttgcaaataacaaaaatttaactcaaatttgcaaaagaaaaaggaatttattgacttgtgacggaaatccagcgtagttctggtttttggtctctaggactctgttgctctctatctttagtttctagctcaatgtgtctggctaggataccttcaagcatcatttcagtagggaggactgcccgcctctgtcctagtgtatcactgagtctcactgtctggaaccagcttcgagtgaatcacaggcccattcctgtggcatcctaaccaggaaatatggcatggcccttggctgagactgggtgcacgcacactgggagctgggtgtggaatccatccctcccaaaccatgtgagctgaatgtgagggaggggtgatttcccctttaccagcatcagggaatacgatgccacaagaacagctgatcactaaacaagatactgttatttctttctctgtgacaaaaatgtttaatggcttaaaaggaaagaataaataatagttggtgggcattcataaagtaaagaaagaatcatatttcaaagggagattatatttaataagccagagaggaaaaagaccagaaatttaatgaggacagatcagtacaaggatctgggtgaagaagaaccttttcctttatgcaccttggaggagagtcatcatagttagtgatactaacctccactgtattgggtgaccattttataagactgttttcacttcctccttgatcctgacccaagacataattcatttttaagaaggctggcctcagtctaaaggaatgggattaggaaaacttcatgcttagatgaagtaagaggatgtaatttgtgaagtgttagaaccttagtaaaaactggcaattctttgtcagaaatgtatatgttattgtcagaaaagtagctacacaaattgtgaaatgaattctgtttttcagtgactaactgggatcagaataaaaagagttgaagcagggaaaattatgaaaacgctaataaaattttatctgggaaaggcagacagctgcaggaggcatgttgttgctgcccctgaggagagcagggaatcataggagatctggaataaaaaaacttaaaaggaagaaagttaaacagctaaaactcaggaaataagctgtcaatttaaaattgccctctttgttccagaaactttatattcattatctcatttaaacctcatgataattctattttacaaatgaggaaactcaggcttagaggagttaaataacttgctcagggttctacaattgcttaatataagaagtggggctttaactgggaatcaagaggctcagtggtgctgctgctgctgcaactcaggtattccctgaaacttattagaaaatagagtgaattttatacatttaggttctccccccaaatttgatgtatcctgagagaatcacactgaattttttttcaaaagacagaattacatgtcagaattaagaaagatattgtgaaatatttagctatttcaaatttgggaagcaaagagaagacagatttcaatctccaaatggagggcagggaatcttgttctttaagaaaaggaaactctgagtcaaaagacgagtattttcagaaaccttaaaaaaacttgtcactgttgaatggcaactggtatttcttgagatgattttaaatgttcctaaaaaaagtttctaaggccagaaaagtttgggaaaagctctgcattatatctgcctcttggactcatatatagacgaacatatggaaccagggaaattgcccttgctctaccgagtctcaagtgagcactcaggaatgaactggcttgttactggttacttgcacctggtggaaaagtacactcaaggcctgactctgcagaacagttaggaggatctcaaaagaaagatatttaaaaagacctgaaaatctaaatggatctttaaccatgtaagcagaagcgtcagtagctggagccttcttggggatttgaagtcctgggaagctgacttcctttcttgggagtactgctgcattgcctgcactaagaggcttcttcaggcagtggagacctgtaaccattttcctgtaatttggtacctgttagtctatcagctcagtgacaaatgcccacatgttaaaagctctgagaactcctaagatgaagaaacttgcttaatgcagcatttcataaacttccttggtcatttgcttttagcatcttttggaccatagttaggggaataaggctcaagatatgaccagggtcagattattacctttgagggccaaagtactgaagagagaatggtggctttgccaaatgtaactcaaaataatagaacactacattataaactaagttaaagaagtctcacaaggttctaattttctaaatgatgaaagcacttagcatttaccatgccaggcactgttccaagaacttccaatatataaatgtgttcaaaactcacaaaaagcttaagtaaattgtgtaaggccacccctggaatatgtgctagaactgagattcagaaagagacagtttgaggccagaaaactgaaaaatttatttcagcttttcacattattagtaatgtaaattttgtggattttagtcaaatttgggaaaacctctgtcataatgcactctaagattttatggcatttcaagttttgaggggacagtgaatgatcttaaatactcttaaacaatatgtattttgcctctcagattaatgattttgatgcttctgaagaaaatgacattttttccaaataattttttctctcattttcttgatggagagggtcttgattttccagagccctaattgtcagtgtagtttgactttggataatccagcactaaatgtgagaatttaatgctatattattataaaacgctaagtgtgctgggcatagaggtgcattcttgtagtagtcccagctgtttggggggctgagatgggaggatcgcttaagcctaggagttcaaggccaacctgggcaatatagggagaccctatctccaaacaaaacacacacacacaaacaaataattgtgccctgtgttcacccactcactccccattaaatttgtgtattatagggataggagatttcctgagctggttgccaggaaagagatttggaacaggtgcaactctttaacatactgaaaaacaatataagactgtgatctggatgtcagggccaggggaggtggggagcattctgggcattgcaggggtagtggaagctatctggataagcagatggttcctatggagtaggcagattttggaggctgcaggcccagtgctatcaccatcacagtgggatctactaccttcaaacaattttagctttaaggcagcagcaaagtgttctttccatacccaagcagttcttgtggaggtttgtatcagtatattgacaggctcagatcttgatcctatgacaagatggatgtgagctcacagagaccagtgagcacctattatacacagatgcttaaggtgggtggatgaagggattgggcagagagagatgctaaatctgtcacattaaccgtatttcactaatgtaggcttaacttggaattttactaatatgatacaaggctaggtccagggttgaatccaggttcattaggcctgaaaatcatttaattttaagggatacttttaagaaaaaaatataaaattatgattacaaagttaagtatggagatatttataactaatgaaaaaagaagtaataacatttttaaaagctgacaagtaccacaaaaacctacatatataacataaataccacaaaaacctagaaatataacatttaaaaatgaattgcttgatacactactgtaatatttcattataatttatatgctgtggctgcatactttctaatcatttctcttaaggtaatagtcattttgaaatatcactgtctagcttttgaatgtgtttgctcttgcttttctagttcttttaatcacttcttttttcattagttataaatatatccatgcttaactttgtaattataattttatatttttttctcgacacatacactctcccaatactaaaccaggaagaagttgaatctctgaatagaccaataacaggatctgaaattgtggcaataatcaatagcttaccaaccaaaaagtgtccaggaccagatggattcacagccgaattctaccagaggtgcaaggaggaactggtaccattccttctgaaactattccaatcaacagaaaaagagggaatcctccctaactcattttatgaggccagcatcatcctgataccaaagctgggcagagacacaaccaaaaaagagaattgtagaccaatatccttgatgaacattgatgcaaaaatcctcagtaaaatactggcaaaccgaatccagcaacacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctgtctatgacaaacccacagccaatatcatactgaatgggcaaaaactggaagtattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagttgttaagcaacttcagcaaagtctcagtatacaaaatcaatgtacaaaaatcacaagcattcttatacaccaataacagacagagagtgaaatcatgagtgaactcccatttacaattgcttcaaagagaatgagatacttaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgccccaggtaatttatagattcaatgccatccccatcaagctaccaatgcctttcttcacagaattggaaaaaactactttaaagttcatatggaaccaaaaaagagcccgcattgccaagtcaatcctaagccaaaagaacaaagctggaggcatcaagctacctgacctcaaactatactacaagtctacagtaaccaaaacagcatggtactggtaccaaaacagacgtatagatcaatggaacagaacagagccctcagaaataacgccgcatatctacaactatctgatctttgacaaacctgagaaaaaccagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaatcctaaaagaaaacctagcattaccattctggacataggcatgggcaaggacttcatgtctaaaacaccagaagcaatggcaacaaaagccaaaattgacaagtgggatctaattaaactaaagagcttctgcacagcaaaagaaactatcatcagagtgaacaggcaacctacaaaatgggagaaaatttttgcaacctactcatctgacaaagggctaatatccagaatctacaacgaactcaaacaaatttacaagaaaaaaacaaacagccccatcaaaaagtgggcaaaggacatggacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataagaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcagcactattcacaatagcaaagacttggaaccaaggcaaatgtccaacaatgatagactggattaagaaaatgtggcacatatacatcatggaatactatgcagccataaaaaatgatgagttcatgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggtgggggtagggggtatagcattaggagatatacctaatgctaaatgacgagttaatgggtgcagcacaccagcatggcacatgtatacatatgtaactaacctgcacattgtgcacatgtaccctaaaacttaaagtataataataataataataataaaaagaaaaaaaagaaaaaaaaagaaatatcactgtctatactgagaatatagagatccaaactttccagttagcatggttgtttcaaatttattttcaattattgatagttcagaaaaatttatttcagcttttcaccctgttattagtaatgcaaattttgtggattttagtcaaatttgggaaaacctctgtcatagtgcagtctaagattttatggcatttcaagttttgaggggacagtgaatgatcttaaatactctgaattaatgacccccatgacacagtttgttatcactgtcctcattcattaggataccaacagttttgcattagcttcattgatgtcagtatttcacaagtcagtcagaaatttaaattttctggtatgctcgtatgattaacttctcttcataattagattgttaaacaacccaagagcttattcattaatttcaattggttacgtggccattttttgtcacttttgtttcatagttcattaattttttgtctgaattattttattttagttgtttaatgaattttttccaaaattacaaaagaagtagtctttgctgtatatagaaatcaggcatcataatttttcactaatttttttgaaatgccttttaaaatcatagttaaaatagtgtattcaaacttcaccaaatatgctattctaataaaaaaaagtgcatttatattgattttatttttgacaggagtgcactttgaattttgattaggtgtctgtgataatggaattctctgcttattattttagacatctggtgactggaaaaattttccatagactagcttctattttaaaccttttatccctactaccctatccttcagttggaggcatcatggggtgcatccctgtggtaagaggtctttggccctgcaccttgttttgttgattgagtcagcacagtgggctctaagaatgtatctggatgtcatttctacactgctaaggccagcagtaactttactgtacacaatagtgatgtgaaccacgtaagtgtttccgtaactctacttttcatttgtctgaatgccaaaaatgtctacaaccattccaacccgttatggttgaatttctctctttttttttttcaaatataaatagaaccatgtgaacatattgctagggtctctctatagaacttgtaagggaactgtccttggaagaggctcttaggttcttggtgagcctacttctggctatgtttcacttggaacagatcacctaaagaaccgtgaaaggacaggccatggaacactggctataaggtgccagaactgacctaaatttcaaatgtgtctgataaaattatcacaggtttttcatctgaaatggttgtttatgaatttgctttaagactttttttgcaggtgatggacacccgcttttaactagttatggctttggtagaaagaatttactggctcgggtaacaaaccactggaaggtaagcaggttggaagtagcctaaaggtcgcctggatttatatattcgaacagtgtcatatctgttaatctgtttctttcttttcccatctctctttttctatgttagttttattctctactcctgaaaaaggcctttttcttaaaaaatgattgcaggcagtgtggggttctatagtctgaaaggcctaaaggaacttcttttccagctcctagtgggaacacccttggaatgactctggccagcttgggtgatgtgcccacctcaacttttccgtgtctctccatgagtctagcaagtgatagaacattgtgattggcatgtggtgggttggaatagaagagcaggtcccccagaaaagcagggtgtcattttggtaagtcaaaaccataattgtccactgtagtagctgaggccaaggcttggtgtggaggtggcatggaagtcatcaactgatgaaacctactgtgtggggtgccactcctcgtgtatacagtaacttatccccattttgaagataatttaggcacaaaattcactctaagtctcagaaagtgtaattttttgtgattagtaaatgtggtgtgctttttaaagtatgtgatggcatattaagagttaattcacacagtccttcattaaagtgtcagtaaaatgggactgaattagttctaaaaagcattcagggctctgacccatttaacttggaatataattaggaaagctagtagttgagaaagggatcagagggctcagaaactttcagaagcaacactgttaatgtttacactaaaatggtaaaaaggcaatgtttaaatctaaaactattattgatttaaactcattaagacaattgatattgaacattgaaattaaaaacactgcctgtaatcccagcactttgggaggccgaggcgggcggatcacaaggtcaggagattgagaccatcctggctaatggggtgaaacccgtctctactaaaaatacaaaaaattagccaggcatggtggcaggcacctgtagtcccagctacttcagaggctgaggcaggagaatggcgtgaacccggcaggcagagcttgcagtgagccgagatcgcaccactgcactccagcctgggtgacagagcgagactcaatctcaaaaaaaaaaaaaaaagaaaaacactgcgtttttgttcttcctgcatttttgttcttcctaagtcaacttgttggagaatattaatagttggcaatatgtgtctttagagggaagatgagtggtgaaccctgaaagtaacccttcatctcactctgtaaggtgtttctttctctttctctctctctctctctccgccccccaccccccaacctttctctctagcttctttcaagattttctctttgtcttcggtttgctgcagtttgaatgatacacctaggtgtagatattttggtatttattctgtttggtgttctctgagcttcctggatctgtggtttagtcattaactttggaaaattcttgactgttatgatttcaaatatttcttctttgttttctcttgcttgtttttatgctattctaattatgcataagtcacacctttggagattgtcccatagttcttagtagagtattgtgttctgtttttttttcttttttttttttgtccttgcattttaatctgagaagtttttgtggacatagcttcaaactcactgattctttcctcagttgtgtccagtctactgatgagcctatcaaaggcattcttcatttctgttaacagtgtttttgactgctaacttttccttttgattctttcttagaatttttctctctctgcttacattattcatcagctcttggatgttgtctactttttccactaaagcctctaacctagtaatcataaattccctgatagttccaaaatctatgtcatgttggagtctgcttttgatgcttgctttgtctcttcagactgttttttttcttgccttttaacatgacttctaattttttgttccaagctggacatgatatatcagataataggagcaaaggtatataggtcttgaaatgtttggtttgatgttaatctggctagttgtgcagttttaatgattgctttagctgtaggtgccagaagtttcaggtacttctaatgttcttgttttaattttccttgttgagtttgtgaaaacctaagaccttcttcttagagtctacaccttgcagccctttcagctgtaacccgtgaatattatactagagccctagagccctgttcatgtgctggtaaggtatggaggaagagcaagtgttctataatttaatgattaaatctcagtcttttaagtaggctcatccctctgctgtgaccttcacagtgtttctgaactatccccctcactccctttgctgagactagaaggctagaggagtctgtagttggggaaatgctcttctgttaggtaggataaagttctggtgaagtccttccctgtggagagtagccgtttgttctggggaatgttccaggtgtatttcatgtaattcatattggttacttttcctctttccctctagagccaaggactcgggggaccagggaaatcttcaccatgagaacatggtaaagttcccggaggcaaaactctcaaaagtatgggaacgccccctaagactggaatccccagatgtctctcatgcttatgttagtccacagtcagcctccagcaaagcatcaaagccattacccaagtcttccaccaatttatagcatccagtagcttctgctccagataaactgatcttagctattattctctatgttcacctgtttttccagattttggggtggcagtttgccctgtgactctgttctctgataggttcaagaaaagtcattgatttttagtttgctcagctttttttccttgtgaaaatgagggtaatgacttctaagctccttacatgctggaacagaaactggaaaactttatattttcaatagattatattttttctgaactttcttattaattttcattttttgtcacagagtcttgctgtgtcacccaggctggagtgcagtgatacagtcatagctaactgcagcctcaaagtcctgggctcaagggatcttcccgcatcagcctcctgagtagctaggattacaggtacacagcaccatgcctggctaaattttttatttttattttatgtagtcagggtcttgctctgttgctcaagctggtctcaaactcttggcctcaagtgatccatgccttgcctcccaaagtgttgggattacaggcgtgagccaccatgcctggccatttcttgaaccttctgaatgttatatggaaatgagtgattttcactgatgttagtatgttcatactcataggaaaagtgtttcccacactcatgtttcaactttactagagtgtaaggttgatgatgagagcgatttgtctcgattctttacccaaatgacgtgaattataggtactcaaaaatattcatggaaaggataaatattagttgtatctgagtaccactatcttttttcttgaaattaattcccttttaaaatcttaaatacctactaccctctccttctaaggagtaacatctatgaaatcataggtttgatatgctaattgtctatttttttctgatatatgttagtatgatttcctaaagattagactaaaagtttcctaaaatcatcccgtatctatctagtggcatatgtacccatgatggaaaacactcctctaagctgatgaataacatgtagctgtatactgatttttatgggttctgtcaaaaattagctgttaaacaaaaacacattgtcccaagtagggcaggacagagtctttctgattctgcataggcgtgacaatataatgggcccgatgctgcttctattctaggaaggttcaactttctcccaactccccatcataaactttttcatattttattgcaccattctttaaatctgaaaggtaggtgaggaagttttttcagcaggcacattgtcaagaagttatatacttttgactgggtgaagtggctcatacctgtaatcccagcactttgggaggctgaggcgagtagagcacctgaggtcaggaatttgacactaacctagccaacatggcaaaaacccgtctctactaaaaatacaaaaattagtcaggggtggtggcagacacctgtaatcccagctactcaggaggctgaagcaggaggtaaaaaagaaaaaaaagttatatactttctggcaacactgggccctctaagaatttgccacatcaaactgagaagttgctttgagagctttctggcagaaggagcttttgcagaggtcacgtttaccaagtcatcattccattgagatatgtggtattctagtgattcccaaatgctgatcctcagattggctgcagcagaatcacttggataactttcgaagaaatgattcctaagctaagtcccacccacagagattctgagtagatctggtggaggaagcctgggaatccacaggtttgtagaactctccaggtgattctgctacagagccatgacgccgtatgctctagtctatgcagtgatcattgatacagggtagaactttaagagttcaacatacactgacatttcttctcatcttgaataaagtaacaaaggtttaataaagagaaaaagaaatggattgtggatactaaataatacctttgttctgaagaagacaatgaaaagaactttaacaaccatttaagaagcagttaggggttaaagatgattgagttgatttgaaccctaataagtgttatctgttgattggagagcacttaataaatattaattatgaagtaaataaattttaccttgctattccagaggtagaaagagaatagtaaaatgcttaaataattaccccacttcatgccatattatagcaaaataaagcaactgtggattctgtctctgctcatgtaaccaggctgtattcaccatccctgctgcccttagttgtacatttggaatcaatcatcacaggcatgcatagctgcaagcatgtggtttcaggaaagaggttcagaaaagctaagtggtaaaaggaatatggtttgatcaaataaaaaagctgcattcatgaaactggaggaggagatggaaacagacctccaaacatcacattttatcttagtacgttaaatgtctttttaccaaagccaagcaaagcccagaaaatactaaaagcttggcttcagaagccaggcagcttggatttttcttggatgccctatgttccaacaaatgatgaagtttaatattctcatatattgttcttttattactaatttaagaacctacatttcattttgcgtagtgaaatttgtggggagcagaggcattattgtgttttctctttgagtttttgtttttgattaaagttatgtatttacattttttagtgaattaatttgtggtacacttttcccatgagacaactgctttcaaatccttctttttttttaatttttcttcatataacaaatgtatatatgaatgactgaactacaaaatattattttccttttccctaaagctgtatttctcaaggtatattttctgattgctttcactggaattggctgatatgattattacaaatgaggagtcctgggtcccattccagacctaataagtcagacttgctagtgtatgagttctaggcatttgtattttaaacaatctctgagtaatcttcatgcaaattgaagtttgaaagtcacttccctaaagcttcttgatttttttctaggaatgtaacattttctaattgtatttctgttttcatatccattgtcatttggttagggtcctatctaacaaatgtttaacttttaccaatgacgttagtacaaacaaggcaaagtagtaagtttaccctttctagaacaatgggaaatgtccctagagactgaaatctgagtcctagatgtgcttagtgctattgagttaatgcttctagttccttttagtggacaaatttgaaaattatgttatttttgaattagaattattaatgcgtaccttataatttgttaaactttatatatgtctttttttcttatgtgaaaatttatacttcctaaaaacagtaacataatgattttgtgctaattgtaaaaccactgtatgatgtttaagattaccttgcatctcctttggatcttagaatatttcccactaaggaactgtagtcaaagtagtatgctctgtgttctcactcatatgtgggagctaaaaaaagttgagctcataaaagtagagaggataattgtggttgatagagactgagaaaggtagtgggaagggaaggataaggagaggttggtaaatggatacaaaattacagctaggccagcatagtggttcatgtctgtaatcccaacactttgggaagctgaggcaggagtattgtttgaagccaggagttcaacaccagcctgggcgttatactgagaccttgtcgctacagaaaactaaaatattagccaggcatggtggtaggcacctgtagtcccagcttcttgtgaaggctgaggcaggaggattgcttcagtccaggagcttgaggctgaagtgagctatgagcgcaccactgtactccagcctgggtgacaggcctaggtaacagagtgagaccctgtctctaaaaataaaaattaaaaataaaaaaatacaaatttacagctagataagaggaataagttctagtgctttatagcaccgtagggtgaatatatttaacgataatttattgtatattttgaaaaatccaaagaagaggattttgaatgttcccaacacaaagaaatggcaaatgtttaaggtgatggatatgttaattacctgatttgatcattacacattgtatacatatcagaatgtcactgcatcccataaatatgtataattattatgcgtcaactaaaaataaaaggacaaaagtactatgctgtgtcagtaacttaaaatacttaaaataagttaccttaaatacttactctctctgaatagttttattatcaatttgctatatatgtaggtttattcattttagtttgttttcacctagggctggcactttttctttttgattaaatttaattcttgaaatatatgaggcatatgcatgtccaaaatgatataaaatatataaagtatgtactcagaagttttatttacttctattccttccacctagtttctacgtccatctcctgtataagtaaccatttttattaatttctagcttttcctttcactgtttctttgtaaaaaatgcaagcatatgtgtgtgtgtatatatatatatgtgtgtgtatatatatgtgtgtgtgtgtataaatacatacatatatatacatatatatcttcctatttctcttcagtttttcacaaagaataaaaaaaaatttgttttacattttttttctccacatacagatatgggaaatgaaggaaaaccttcacaaagtaccacattcttctcgactccccaaagactctgtgatggtcccattgagttactagttcatcttgttcttaggtcctctcttgtttcaggtctaaaccagaccctttaagaaagatctgttgttcaaggtcagtattaattatcccatgttaatgaaaatgacctgaaaaatcacatagtgtatcctgtttgtgggctaattcatttgtagattatctaaacaatattgatattaagtggccaagaaagaagtggttttgccttccttttttgtcctttgaaaataaaaggtccagatgtagcacccagaaaccaccgttctctttgttgtttcatgttgtttgagatgccacagtgtctttttctttttttcttccttaaaactttgttaataacaattaaaaaggagtgtcattattggactcctctgtgaggaaccttttattttgtaagtaaataatatgagaaaatctagattttttttcccccattactgttctaccaaagtagcatttcacactgagtagagcaggaaaacatagtaggtgtataaaaaacaaagaagccaaatctaataaaatagatgatggaattggaatttgggtagaaatataaagcatctgctttattccttatttgcaacatttgttgacaataaggcacattgtgaagaaagaaaccaatctttccaagaagattttgcaattgaactcactctttaagattcccaatggtatgttcgcttcctattttactgcttatggcacacaaaagtgagaacatgaaaatccctggagatcaaatgttgtttaaattgtttcttagcagtgaataatggctccttaggaataaatatgtgcattttacatggcaatctataggaggcaaattgcatacttaatttctgagaaataactgaatatagtaatgtttacataaagctttggacaaaggtattatcagcacacattgcttttcatagatagcttatgagctctatagcttttttgtataaaaagttttagtataacgtaagagtatttatctcatgacatattatacatagtggttttattttttgccatctataaaaatgtgtgaactactaaaccaaaaaaaaaaaagtttagcttcaaaactattcctttttgatttggcgaaataaacttgcaagcaatttagcactgacccagaaagaatatccattagcccttctgaaaatttagcatgctaggccaggtgtcatggctcacacctgtaatctcagcattttgggaggccaaggtgggtggatcacttgaggccaggagttggagatcagcctggccaacatggtgaaactctgtctctattaaaaatacaaaaaattagttggtcatggtggtgggtgcctataatcccaggtacttgggaggctgaggcaggagaattgcttgaatctgggaggtggaggttgcagtgagccgagatcatgccactggactcctgcctgggcgacagagtgaaatgctgtctctaaacaaagaaagaaataaatacacaaagtttagcatactgactttgaaatttataatggtataaacttacttcaaaatatattttgttctggccgggtgtggtggctcatgcctgtaatcccagcactttgggaggccaaggcaggtggatcacctgaggtcaggagtttgagaccagcttggccaacacggtaaaaccctgtgtctacttaaaaattacaaaaattagctgggggttgtggtgcgcacctgtaatcccagttactcaggaggctgaggcaggagaatcacctgaacctgggaggcggaggttgcagtgagccgaggttgtgccatttcacttcagcctgggcgacagagcgtgactctatctcaaaaaatatgtgtgtgtgtgtgtgtgtgtgtgtgtgtgtgtgtgtgtgtgtagatgtatttcttaaaaataaaaagattaaacctcaaatgataaaaaactacattagtgttctgtcatcttccataatatagatgaaaatggtcaagttcctgaacctttatgggagctcacaaaaatagtgaaagccatctcttaggtggatagcaatttttttctgggtaatagcaatgattaaacagaatgggctttgctgatatacctgtgacctactgcattctcatgaatattggtatcgtggtgttaatgcgcaggcattgagtattagtcatggcaagggacaaatatgtgttctctaactgcaaatgtaaaagaaactgacaatgacaatgacaaactcattagtatatttttttcctgggacctcattcaggccagaaccaccatctctttccattgtaatttgggattggttggctaaggcctaacaaaatgggtttttaagtcgctttgcctgtggtttgttgagaagggagggctggtgccacaatcatgtgacaatactccacagggggttctccatgcttggaggaggatgcatatttgccaaggggatgggttttgtgatttgtacttctgggctttcactgggagagcagaggcaacttttgtcttggtttgtttcctccaatgtgtatcgactttggctgtacttcttccttcactattccaaggcaccctgacagtaccacttctgaaattccaccaggtgaatgctcattaaacctttgacctcttccactgcatcgcggtggaataggcccaggcagtccctgagatcagcagattatttgtgccaggataacatatatttttagaattttaaattttatgtattttgtattcacatactatgtaattcaaaataggattattccaggaaagtttattttcagtgagaccatttacaaaagcatgggggtaagagaaccccaatggataatgcagaaacctggcttttagtaccctagttggggatgaggagagggagtgggtactggaacttaaggggtgagttctggaatttagggagtgaattttactctagagtcagaaacccctgagaggaaccacaatcttctttggagagacagccaactccaggggaccatgttcaagagagccaggaaataaatactttgtcttcactaatttttctcctcttatcttctgtcctgccttccatcatccagtcttaccagaaaccagaaggcagggaactctttgctatgaaccataaaggtcagcctcttggggcacagggcagtgtggcaagtgaatcacaaggaaatggaaattcctagcataaaagaagtatgtgaggctctttcctaccttggcacctagttctcctctgcaaaagcaaccatttcaccagagccttccagagaccttaatccactcttgttattttgtaagtaaactgaggagtggggattatttttacagagttttaaatttgcctaaagcaaacctttttgctgggaagaaaccccggtatgtgccaaaggtttgctgagggtcacaaaagacaatatgacacatatcctgtttctgaattctggacactttgtatactccattttgtccttaaaaataataaataggttaagtttttgtgttattgccttatgttttctattagcgatctggctcagaaataaaacatgtaaaaatatattggctgttttcagacaagtaattatagcattttttcttcaatggacttttcagtggttctaaagcacagtttccagacccactgatcatgaatggatgctgaatttcaggaatgactgaaattgtattcaaaatattatgtatgtgtacttgtgcatttttcaggagagtggagccatgactttcaggaaattctgatagaggttttcgagtcataaaagactcagagacaatggtataaagtttaattcatttggaatttcttccttctctcattacattttttttttttctttttgagacagggtctcgctctgtcgctcaggctggggtgcagtggtatgaccaaagctcactgcagccttgaactccagggctcaagtgatcctcccatttccgcctcccgaatgttgaggactacagacatgtaccaccatgcctggctaattaaaaaattttttatttttatttttattttttttttgtagagatggagtctcactctgttgctcagactggtctcaaacccctaacctcaagtgatcctcctgcctcagcctcccaaagtgctaggattacaggcatgaaccaccactcttggcctcattacacttaactattacttaactattaattagctattacttaaccatcacttacctattaatgtgacctctgctttcttagagttcagtaggccagacagagggaatgataccagatggttcatgacattgcaattcaaatgttctcagtaacttgcaaactaaaattcaatgttttggtggactaatatgtgctaaatgattcttatcatataaaacagtgagattttggtcaagaaattccactatgaccagttaataagatgatttatattcaatcagattgtttcaattggattttaccaagagaacagtgtttagtttaagtaataggaaagaggatttgggttaatgaaaaaaggtgcataccattctgtttttctagagaaaattgtctggaaattttatgatctgttttggtgtatgaaatttaatttttttcatatcagtaagtagagttcgtgaattaaactactacactcatatttaagacttcctctgatttcatcataaaattattcttttacataggatgattttaaatgtttgccatagtttttattccggctttatatttatatactctgtcttctggccaaatatttttctgagaaaaaaactataactttatattaaccatcactaggtaagttcaataaatgatattgtagcagcatttaaaagatttttcttttctctttcaaaaggcacacacaaactattgaaactattagtggagcaatataactcttgctgcactttgtaaaacattgctagactagattagatacatcgattcattacttttacttatttcacttttcttttgcttaggactctttgtttataagtatctgaaacctgacttaaccaaaataatgaatttactgatttttgttttctggttgtttcgtggtcttctcttcattcttttcttccttcgttttaatgaaagattgtttagatggattatattcagaacaatggaagtggaactggcctcaggtatgcctgaatctaggatctcagttatatcagatctctttatatttatttattgatattgtttttaatttctgggtacatagtaggtgtatatattcaaggattatatgaaatactttgatacaggcatacaatgtgtaataaccatatcagggtaaatgggatatctgtcacctcaagcatttatcctttgtgttacaaacaatccaattatagtcttttatttatttatttagagatggagtcttgctccattgcccaggctggaatgcaatggcatgatctcagctcattgcaacctccacctcccaggttcaagtgattctcctgcctcaatctcctgagtagctgggattacaggcatgagccaccacacctggctaatttttgcatttttagtagagactgggttttgccatgcggatcaggctggtctcaaacaccccgcctacctcagcctcccaaagtgctgggatgacaggcatgagccactgcccccggcttagttattttaaaatatacaattaaattgttattgactatagtaaccctgttgtgctatcaaatattagattttattgatttttctacccattttttggtactccttagctacccccacttcccccctaccctcctgttacccctcccagcctctggtaaccattattctgctctctatctctatgagttaaattgttttaatttttaaatcccacaaataagtgagaacatgtgaagttgctcttcctgtgtctggcttatttctcttaacataatgatctccagtttcatccacgttattgcaaatgaaaaaatatcattcttttttatggctgaatagtactccttgctatatatataccatattttctttatccattcatctgtggttggacacttagattgcttccaaatcttggctattgggaatactgcttccataaacatggaagtacagatgtctgttataccgacttcctttcttttgactatatacctaacaatgggatttctggatcatatggtagctctatttttagtgttttgaggaacctccaaactgttctccatagtggtcatactaatttacattcccaccaacattgtatgcaggttgccttttctctacatcctcaccagcatttgttattgcctaacttttggatataagccattttaactggggtgagatgatacctcattgtagttttgactttcatttctctcatgattaatgatgctgaacactttttcatatgcctgtttgccatttgtatgtcttctttggataaatgtatattcagatatttttgccaatattttaattaaattattggatttttctttcttttttttaaattatactttaagttttagggtacatgtgcacaacgtgcaggcttgttacatatgtatacatacgccatgttggtgtgctgcacccattaactcatcatttaacattaggtaaatctcctaatgctatccctcccccctccccccacctcacaacagaccccagtgcatgatgttccccttcctgtgtccatgtgttctcattgttcaattcccacctatgagcgagaacatgcagtgtttggttttttgtccttgcgatagtttgctgagaatgatggttaccaccttcatccatgtccctacaaaggacatgaactcatcattttttatggctacatagtattccatggtgtatatgtgccatatttccttaatccagtctatcattgttggacatttgggttggttccaattctttgctattgtgaatagtgccgcaataaacatacgtgtgcatgtgtctttatagcagcatgatttataatcttttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgttccctgaggatttttcttattgagttgtttgagctccttgtgtattctggttattaatcctttgtcagatggttaatttgcaaatattttttcccattctgtgcattacctcttcactttgttgattgttttctttgctgtgcagaagctttttaacttaatgtgatcccatttgtccatttttgctttggttgcctgtgcgtgtggggtattactggtattgctcactctgatatcctggagagattctctaatattttgttttagtagtttcagagtttaaggtcttagatttgagtcttcaatccattttgatttgatttttgtatatggcaagagataggggtctcgtttcattcctctatatggatatccagttttcccagcaccatttattgaagaaactatcttttccccaatgtatattcttggcacctttgttgaaaataagttcgttgtagatgtatggatttgtttcttggttctctatttttttacattggtctatttgtctgtttttatgccagtaccatgctgttttggttactatagctctgaagaatattttgaagacaggtaatatgatttcttcagttttgttctttttactcaacataattttggctattcagggtcttttgtggttccacataaattttaggattgtttttactatttctgtgaagaatgtcattggtatttagtaaggattgcattgaatctgtatattgctttgggtattatggtcattttaacaatatcttttcattttttgtgtgtgtgtcctcttcaatttctttgacaaatgttttatactttttattgtagagatctttagtttctttggttaattcctagctatttaattttataagtatctactataaattggattactttcttgattcctttttcagtaattgctgttagcatgtgtgttagcacagactggataatttataaagaaaagagggttcattggcacatggttccacaaactgtacagaagcatggcatcatctgcttctggggagacctcagggaacttttactcatggcagaaggcaaagtgggagcaggcatttgacatggcaggagcaggaccaacagagaagggagaggtgccacatacttttaacaacgagatgtcacaataacttatttacccactatcatgaaaacaggactgaaggggcggtgctaacccattcatgagaattccaccccgatgatacagtcacttcccactagaccccaccttcaacactgggaattacaaattgacatgagatttgagtggagacacagattcaaaccatattagcatgtagaaatgctactgatttttgtatgttgtttttatatcctgcaatatgactgaatttattagttctaatattttttggtggaatcttcaggtttttccaaatacaagattatataatctgcacacaaggataatttgacttctccctttccaatttggttgctgtttttaatttctcttgtctgattgctctagctaggtcttccagtactatgttgaataatagtgatgaaattgggcatccattgtgttgtgttcccaatcttagaggaaggtctttcagtttttttccattcagtatggtactaactgtgggtctgttgttatggcttctatcatgttgtggtttgtttcttctatagccagttttttgagggctttttgtcatgaaagggtgttgaattttaggaaatgcttttcatttcagcatcaaatgaaatgatcatatgaattttcttcaacattctgttaatatgatgcatcacattgattgatttgtgtatgttgggccatccttgcatccctgggatgaatcctacttggttgtgatgaatgacctttttaatgtattgttgaatttggtttgctagtattttgttgaggaattctgcctcaatgttcatcagggacgttggcctgtatttttctttttttgacacatttttgtctggctttagtatcagggtaatactggctttgtagaatgagtttggaagcattccctcctccaccattatttggaatagtttccgtaagattggtgttagtacttctttagatgtttagtaaaattcagccgtgaagccttaagcttgcagcctttgtttttgctgagagactttttaattacagttttgatctctttacttgttattactctgttcaggttttggatttcctcatggttcaatcttggtaggttgtatgtgtataggaatttacccatttcttctagcttttccaatttcttggcatatagttgcaaatagtagcctctaattatcctttgaatttctgcaggatcaattgactcttttctcttttttttcccccattaggctggctaaagatttgtcaattttgtttatcttttcagaaaaaaacaccttttgttctgatgactatttgtattgtttcaatttcatttatttctgctctgatctttattatttcttttcttgtactaactttggatgtggtttgctgttgcttttctagttgtgaagatgcttcattaggttgtttatttgagcttttctacctttttttttttttctgagacagagtcttgctctgttgcccagaggcattatcttggctcactgcaaccctacctcccaggttcaagtgattctcctgccttggccttctgagtagctggggttacaggcatgtgccaccacatccggctaattttgtatttttagtagaagcagggtttcaccatgttggctggcctcgaactcctgacctcaagtgatctgcctgccacagcttcccaaagtggtgggattacaggcatgagccactgtgtccagccttttttctacttttttgatgtaagcagttatagctaagagcttccctccttagtactgcttttgctgtatctcataggttttggtgtattgtcttgccattgtcacttattttaagaaattttaaaatttccttctttacgtcttcattgacctactcgtcattcaggagcatgttgtttaatttccatgtgtttgtatagtttccaaaattcctcttgttattgatttctagtttgatttcattgtggtcagagaagagatttggtataatttcatttttttgaatgttttaaagacttgttttgtggcctaatatatggtctattcttgagaatcatccatgtgctgaggagaagaatgtgtattctgtagctattggatgaaatgttctgtaaatatctattaagtccatttgttctataatgcagattaagtctgatgtttccttgttgattttctgtctggatgatctgtctaatgctgaaagtggagtgttgaaatctccagctattattgtattggggtctgtttctgtctttagctctaatatatatttcttaatatatctgggtgcaccaatgttgagtgtgtgtatatatatatatacacatatgtatatattttaattgttatgtattcttgctgaattgacccttttctcattatataatgaccttctttgtctcttttgtagtgtttgtcttgaaatctattttgtctgacataagtatagctactcctgctcacttgtagtttgtatttgcatggaatatctttttccatccttttattttcagtctatgtgtgtccttataggtgaagtatatgtcttatagacaatagaacgtggagtcttgtttttttatccattaagccactcaatgccattttaatttttttaattttattttttgtggatacatagtcagtatatatatttgttgggtatatgagatgtttcattctctgtcttgattggagagttcagtccatttaaattcaatgttattattgataaataagggcttatttctgttattttaaaatttgttttctggttgttttatggtcttttcttcctttctgtcttctttttaatcactgtgattttctctggtggtaggctttgatttcttgctttttattttttgtgtatttgttatatgtttttcaatttgaggttaccactaggcttgtaaataatataatccactattttaaactgatgccaacttaacactgattgcataaatacacaaaagaaagctaatataaactctgcactttaattttgtccaccctttttaacttttgttgtttctactttttattgtactgtctgtatcttgaaaagttattgtaattattacttttaatcagttcatctttttgtctttctgtgtaagatatgagtagtttatacaccaaaattagtcttataatagtctgtgtttttctgtgtacttactattgtcaataagttttgtaccttcagatgattttttgctgctcattaatgtccttttctttcagattgaataactttgtttagtgtttcttataggacaggtctggtgttgatgaaatcactcaacttttgtttgtctgggaatgtctttatttctccttcatatatgaatgatatttttgctggatatactattctggggtaaaagttttttttttctttcagagttttaaatatgtcatgccactctcttctagcctataagatttccatggaaaaatctgctgccaggcatattggaacttcattgtagttttttttctcctgctacttttaggatcctttcttttttcttgacctttgggagtctgattattaaaaaccttgaggtagccttgtttgagctaaagtctcttggtgttctgtaatcttcttgtagttaagtattgatatctttctctaggattgggaagttctgttattatccctttgaataaactttctacctgccctcatctctacctcctatctaatgccaaaaactctttaatttaatttgcccctttgaggttgttttctagatcttctaggtgtgattcattcttttttatccttttttaaaaatttgtctcctctgattatgtttacaaacagccatcttcaagctcactacttatttcttctgcttgattaattctgctgttgagagactctgatgtattcttcagtgtgttaattgcattttcaactccagaatttctgcttgatttttaaaattatttcagtgtctttgttaaatgtatctgatagaattttgaattctttctctatgttatccttaatttctttgagtttactcaaaacagcccttttgaaatctgtctgaaaagtcacatatctctctctgggataagtccctcgtgccttattttattatttggtgatatggcttggctctgtgtctccacccaaatctcatgttgaattgtaattcctaattttggaggtggtacatggtgggaggttattggattgtgtggctggtttctaatggttagcatcatccacctagtgctgtcttgtgatagaggtctcatgagatctcgttgtttgaaagtgtgtagcacctccctctttgctctctctctctcatgccagccaagtgaaaatgtgcttgtttcccctttgccttccgccatgattgtaaatttcctcaggcctccccagaagcagaagcctgtgcagcctgcagaaccatgaactgattaaacttcttctctcggccgggcacggtggctcatgcctgtaatcccagcactttgggaggccaaggtgggcggatcacaaggtcaggagattgagaccatcctggctaacacagtgaaaccccatctctactaaaaatacaaaaaattagccgggcgtggtggcgggcacctgtagtcccagctactcaggaggctgaggcaggagaatggcgtgaacctgggaggcggagcttgcagtgaaccaagatcgcgccactgcactccagcctgggcgacagagcaagactccgtctcaaaaacaaacaaacaaacaaacaaaaaaccaacttcttttctgtataaattacctagtctcagttctttatagtaatgtgagaatggactaatacagaaaattggtaccaggagtggggtattgctataaggatacctgaaaatgtggaagcagctttaaaactgggtagtgggcagaggatggagcagtttgaaggttcagaagaagagaggaagatgagagaaagtttggaaattcctagagacttgttaaattgttgtgaccaaaatgctgatagtgatatggacaatgaagttcaggtttaagtggtctcagatggagttgaggaacttattggggactggagtaaaggtcactcttgctttgctttagcagagactggtggcactatgcccctgctctagggatcagttgaactttgaacttgaaagagatgatttagggtatctggtggacaaaatttctaagtagcaaagcattcaagatgtggcttcttcttaccatgtatgctcagatgtgtgaacaaagagattatctgaacctggaacttatatttaaaagggaagcagagcatgcctggaaggtgtttcagagaccttcatggcagcccctcccatcacaggcctggaggcctggaagggaagaatgattttatgggccaggcccagggtcccactgccctgcacaacctcaggacactgctccctctgtcccagccactccagctccagctgtggctaaaagggccccagatacatctcaggctgctgctccagagggtgcaagctggagctgccaagccttccagatggtgttaggcctgtgggtgcacagagagcaagagttgaggcttgggtgcctctgcctagatttcagaggatgtatagaaatacctggatgtccaggcagaagtctactgcagggacagagccctcagggagaacctctactagggcagtacagaggggaaatgtgatgttagagccccacacattggggcactcctggtggagctctgagaagaaggccaccattctccaatccccagaatgatagatccactgacaacttgcaccatgcacctggaaaagctgcaggtactcaacaccagcctgtgaaagcggccattgggtctgtattctgcaaaactggggtggagctgctcagggacttgggagcccactttttgcatcagtgtggcctggatatgaaacatggagtcaaaagacattaaatgattgccctgctgggttttggacttgcgtggggcttgtagccccttggttttggccaatttctcctttttggaaagggagcatttacccaatgcctatacctccattgtgttttggaagtgactatcttgtttttgattttacaggctcataggtggaaaggacctgccttgtctcagatgtgactttggacttggacttttgagttaatgctggaatgagttaagactttgggagactgttaggaagtcattactgtgttttgaaatgtgaaaaggacatgagattcggtgggggaggcaggggcagaacgatatggcttggctctgtattttcacccaaatcttatgttgaattataattcccagtgttggaggtgcggtctggtgggaggtgattggattgtaatggtttaacaccatccctttagggctgtctcatgatacagttctcacaaaatctggttgtttgtaagtgtgtaacaccaccccctttgctccctgtctctctcttgctagccatatgaagatgtgcttatttctcttttgcttttcatcatggttgtgaattttctgaggccttcccagaagtagaagcctgtacaccctgcagaactgtgagccgatccaacctcttttctacataaattacccattctcaggtagttctttatagcagtgtgagaatggactaatacatttggttaagtcatgtttttctggtcttgctggtcttgatgcttatggatgttcattggtttctgggtgtggaagagttaggtatttactgtagtcttcatagtctgggcttctttgtacctgtctttgggaaggctttccaggtgtatgaagcttgggtgttgtgatatacatttttggttgctgcagctgtatctgcattaggggacaccccaagcccagtaatgctatggctcttgcagacttgtagaggtgtaagcttggtggtcttggataagatcctgaagaattctgtttatccaggcagagactcttgttcttttcccttactttctggcaatcaaacagagtctctcattctgtgctgggctgcctggggctgagtgtcggggtgacacaatcacccatgtggccaccatcactgggaccacagtggtggttcagacccagagctaacatagcactgcatcttgcccaaggccagtggtgaccactgccttgctaccatctatgtttgctcaaggccctaagggtctaccatcagctggtggcaaagccagccaggcctttgttcttccctacagggcaatgggattccccaggctttgggtgggtccagagataccatctggagatcaggacctggagtcagaaaccttagaaatctacctggtgctccattcttctgtagctgagctggcgtccaagccacaagacaaaatcctttctactcttgcctttccacaggcagaggattctctccctgtgtccaccaccccacaggcccacgtggagtactgccaggctaccactaatgtttacttaaggcccaggggctcttcagtcagtttgtagtgaatgcttctaggcctggagctcactgttaagggcagtgagctcccctctggcccagagcagatccagaaatgccttccaggagccaaagcctgggacctagtacttcaagaacctgcttggtgctccaccccagtgtggccaaactggtacctaaggtgcaagacaaagccccctttactcttccctctgcttttctcaagcagatggagtccctccttgtggccaccatagctgggaatgtgctagtgaagtcagcacatctcagagtctcaccccaggcccacggcatgtactgcttggctactgctgccgattattcagggcccaaaggctctatatttagcaggtgatgaatcctgccagaagttggtccttccctttaaggtagtggcttcctttttgggatagcgtgtgtctagaaatgcctgggagctgggccctggaatgagggcctcacgactcttcccagtgccatattctgctgtggctgagctggtatccaagttgcaaaacgatgtcttcattactcttccctgtcctctcttgaagcagaaggaagaagtcttttttggagctgcaagctgtgctgccagggactgggggaggtgtggtacaggcactcccttagatacctcagctcgtgtctcagtaacttgagtgcccccaagtcccctaagcccagcacagcactaggacttgcttaggagttgcagtccttatggcttagactgtctttcaggtttatttagggcaccgaagcactttagcctcaggtagtgaggcttgccaaactcaagttctgaccactaggatggtcgattcccctttggctagggctcatttaaatgctccttctgtgggcatcagctgagttctgtctggtgttgcagcactgaattccaacgcaaagtcccacaattgctgtgctctcccttgcctaagtgcacagtttctctctctgtgccatgaggctgctgctggggtgtggggaagggttgctgttggcaattgaagactgtctttcctactgtcttcagtgcctgtttcagtgattagaagtttaaactatttactgatctctcacctgattcttggttcttatgtaagtgtttttctgtgtagatagctggtaaatttggtgttcctgcagagaggatgacctgtggaagcttctatttggccatcttgccctgcctcattctcttgctcctttatttcttgattctacttgagtttgtgtttgcctcgttctcctaatatggtttttcttcatgccaagaaacagattatggtcaccgaaaggtcaagacttgttatactctaggcagcaaacactgtaggaaggaaaactttcttttcacttattaatatatacaaatccaagagaaaggagtttgttgccttggcttgggccctagatccagttgtgtcaattgctataccagcagcttatcccacatttagcagtccatttatggaacagtggagccttcccccaagggaaggggtggggatagtattatcagagtaagcagataaggttgctgggctggtgtagacagcagatttccagcacaatgtattatgtatacagttggacctccacatctgtgggttccatattcatagattcaaccaaccgtggatcaaaagtatttttttaaaaattggatggttgcatctgttctgaacatgtattgattttgttcttgttattattctctaaacaatacagtattacaacaatttacgtagcattcatgttgtattagatattataagtaatctagagatgaccagagtaatgcataggctgtatgcaaataccacaccattttatataacagacttgagtatccatggattttggtatctgctcagggtcctggaaccaattccccaaggataccaagggatgattttagtcgtgtcagaaaatactgctaccaaattagtaactagagtgctgtcttctgagtttcataagctatggattaaacttctttttctagcagtaaaagcacaggcaaagtcaggaaaaatatggatctgtttaatttccacatgttcttggtctttgtgtagaagaaagtcaagtagataatacttacatgtaatcatcacataatctttattgttgcagaaagcttttaagtcaccgactagctggcaaaattaaatataaatgcaaatgaaaaataagtatcacagtactttttatgctactcacacatttggaaataatctctgcatgggtatttaaaacacaataggctttcactgcttatttttctatataatccttcatttttcttttggaaattaccaaaaccttcactaaagaaagaaaataacccagagttgtaattgatgcaaggtttattgcccctcccaaagttcagaaatcctctagtgtgaatgtttttatttgcttaattcttttgatggaaaaatataatatctttcttctgttgcagcattctaatgagggctggggatggacatgaaagggagtaaagatgtaaaatatttttcacaattgtatttttaatatagcaacccattttatcaccacatttattaccatttgtaatgtttggcaatcattaataatacgttaacagtataacagcacagatataaggaagtttccttactttagcacttcactggaatacagtactgtatctgtttcccctttgatataaaacctctggatacattgagcccatacttagtttatttttattttaattaactgttctcccttatccttccttgctgcccagtctgtgagaaagttgtgaattagaataaaatgaaaactcttctgattcattcaccaatttttgagtgttattttgtacagtgactgcaatttataacaaaaacagaaataaaaagaaaaagagagcctcctcctatgtaatcttaccatttgaagaaaacagttggcttttccttcttttctttcttttcctttcccaatgagaatatatatatattttatgtcatgtcattgtgatcatacttaggtagaatttgtagtcttccctctccatttaacatctgtcataaacatttccatgtattccacattcatttatggctacatatttgctgatgttccataatatgcaaaagaattgaaaatttcattggacatttatgttattttcagtcttgaactctataaatgatgctattatgaacatatttgcgcagtagagcctctcttctgggattctttctttgagaaaaattctaagtaatggaattagtagatcaaagggtagatacattttttatagcccagttttctagtggatttgagatgtttttgacatctggaaatatttaacgatgatgttttgatagtttattttaaattaaagctcttaaaaattcaattttttcttaatgtaattttaattcttattcttcattggacctatcttatgcgttctacaaaattatctccattttttctgtttcacatgatagagaaaaaaatgaaaatctaaagcctagatttacatatgcaagaaataaaagggaaagatgagaggacatatattgattttttcaccctgttgtctaattttcattaagtctgcctgctgtccaatttcccataggttggcctgctacctaatttccattaggtctgccttgatgtgttttatttttttatttttatttttatttttttttgcctatggataagagcttatttcataactgtatctgtatgttaacctttaaaccctgctgtggtcaatgaagaatgatgtttgataacatcctcaccatctttcccttcacaagaagattttgtacaattataccggctttctataccttatacacacactcactttctctcctgggagtttttcataaaactagatcactttcattttctgtgataatatagccatatgtactatctctttaagactttcagtgggaaactttgtgccaatattcagagagtcttaaatgcctgttgtacagcttgataaaccaaagataatgggtttaattctgaacttgtatctcataagcagttttttgtaccccatggacatagtgatatatctcagccagcatagaaatattcaggagttatgagctacttgattgtaagtgttgggaaaccagacaacatcttgtaattttttgtgtgtctctaggacctagctcagttcctgacaagtgtgacttttagcattctccatgtcctgtggatagataagtatactccatctattctatgggagagaatgtagactatgaagtgataagtttcaggaataattggcttattttgacttaggatagaaaggtattaaaaattagcaatgagctaaatttattacatatagtgtaaattttagaatgttttggcttatggttgtcagacatattcactgccttatgaactacaaaatccctggatttaaacttagactggagcatccaaatataagcacgctctaaaaaaaaagtcacataaacagaatgatacatctctgctattcttttttttttttttttcttttgagacggagtttcgctctgtcgcccaggctggagtgcagtggtgcgatctcgactcactgcaagctccgcctcccgggttcacgccattctcctgcctcagcctcccgtgtagctgggactacaggcgcgcaccaccatgcccggctaatttttgtatttttagtagagacggggtttcaccgtgttagccaggatggtctcgatctcctgacctcgtgatccgcccgtctcggcctcccaaagtgctgggattacaggcatctctgctattctacatagtaactgaataatagatatttcttcttcttcttcttttttttttttttagacagagtctcgctctgttgcccaggcgggagcacagtggtgccatcactgcttaatgtagcctcgaccttctgggctcaagcaatcctcccacctcagcctctcgagtagctgggactataggcatgtgaggccatgcctggctaattttttagttttttgtagaggttggttttcactatgttgcccaggctggtctcagacttctgggctcaagcgatcctcctgtcttagcctcataatacatttcttaacccaactgaagagctccagatttttccaagactatggatctgcaaaggatggtagtcataatcatcaagtttatgagaaggagttttacattagaaaacaatttcatgggccgggcatggtggctcacacctgtaatcccagcactttggaggccaagggaggcggatcacgaggtcaggagatcgagaccatcctggctaacacggtgaaaccccatctctactaaaaatacaaaaaattagccagacatggtggcacacgcctgtagtcccagctacttgggaggctgaggcaggagaatcacttgaaccgggaggcggcggttgcagtgagccgagattgcaccactgcactccagcctgggcaacagggcaacagagcgagattctgtctcaaaaaaaaaaaaaaaatatatatatatatatatatacatttcatgtacggtggctataatctgaacctgattttgtttctatatctttccaaatattaaggattccaaggacagggacagataatataattatggttgaaatgtttttcattcatgtttgcatgtgtgtgtgtgtgtgtctgtgtgtctgtgtgtctgtgtttagtatgaccagtggtgattactgtttggcatttattacgtatctaaaaagagaaagaatgagccacttttctttttctcactatcttgtttctatctgtgttattctactgaatatactctcgccactttaccagtaacatactagtcttcaaacttaatgaccgtttttgtccttggattctctgtaggtacttgaaaaggctgattctctcatcctcaaaactcttaatagtaattcttccttccttttctccagcttctttttagcacatcttccctctctaaatgtagacatatccaagcctgagtcagtgtccttttcactctcccactcatcacagttcaaccctatttctgtagatatttgctaagcctgacctctttcatgactgttctccccacaccaccagttcctattgcatctttctcaaagggtcaggatttcagttatcacttcaagatcaacacttccattttttttttaattttattttttgagatggagtcttgctctgtcacccaggctgaagtacagtggtacaatcttggctcactacaacctccatctcttaggttcaagctattctcctgcctcagcctcctgagtagctgggattacaggaacccgccaccatacccagctactttttgcatttttagtagagacgaggtttcaccatgttggccaggctggtctcgaactcctgaccttaggtgatccacccgcctcagcctctcaaagtgctgggattacaggcgtgagccactgagcctagccaacacatccattgttaaactcatcagcttactccccatcaccatcaggtcttctagattttcacacatctgtaagtggttctgtctatacttcccctgtcatccaagtttattaaatatctgttgcagatgatgtggtaaagagaaaattaaaattttatttagttttttttttgttttgtttttctattgctgtgtaacaaattaacacaaacttagtggcttaaaataacacaaatttattatctcacactttatgtggttcaggattttgttttcagatgagctgggtctctgcttagggtgaagtaaaggtgttggcctgtttgcttgttcagatgagctgggtctctgctcagggtgaaataaaggtgttggcttacatctgaggtttgggggttttctcagagtcattcaaggttgttggcagaattcagcattccttgtggctcgatgactaaggtccctgttttcttgctaagagttggatcaaaacctctcttagccccaaaaggtcactctcagatcttgtccaatggccccttccataggcagtttataatatggcaactgctttttccaggctagcaggagagcttttgctatggcttctgacctgattaagggctcacaatattaaattaggccactcaaagttgtctcccttttcattaacacaaagtcagctgataaaggaccttaattacatctgtgaaaacccctttgccatgtaacattatatggatggtaacccatcgtatttacagtcccaccaatattcaaggggaaggaattgtgcagggggtatacaccttggggtgggaatcttgggggctatcttagaattctacttaccacaggacagatggaatcaagaatggtagtgagtgccatcattaattatttgcggaagttaaaatagttatactaacatagatggtgccaatggaatgctagcttggagttttacattagtatgtgcatgtttgtggaaaactatactaattacacatccatatatattttatatatataaaaatacctaaaaatgttttaatatactcatctatatctatacattcattttatcttaaatctgtctttgttacctctttgtaaacatttcccacaactcaactatatttgaatgtgaaatttaagattaattttgcaaatatcatgtttttaatgagagatacacgccagtacttttgcccttatcctttgttataaaattctggacaatttaacatgcttttttccctagcccaggtaaagtgtaatgtaaagtgactgccttcctctgtcttcccagataaggataattgcttctggtgaataatcaaattatggctttcatcctctgacctttgaaggaatagcattccctttattttaagttgcctttgtgtgtatgtgtgtgagccaagccacattttgaaatgcaatttttcttagaaacagatctgttgagaaacaaaataaaaatgtagatttcttatttgaatagagagaaaagtgtttttctctggtttcttaaaatgtatttataaatagcacctgtttctatgtaaatatagagatttgttgttaattgttctctgctggtattgctaaaattgatgatagagcttttctttgagtcatatctatactgtattgtttgctgtactgtctaaatcatttctccaatctaagaagaaagtttatcttcaggggagggctttctcactgttttccattgattttgaatacatcagaatctattgccagtttttgattgtttatttagtaggccataagaaagattcaagtttacttccattttgcagagggtttgaaaatttataaattttccaaatatggtgtgttagctagagcatcttgtagggaggaaaaatgtgagaagtgaactttggtttcattttcaaattggtggattatgttgatctggtatatagctggtatgaaactaaatactgacacttaaagacttaactgttttgtttgcctgtttaatttggagctgcttatagctattgagatcattacatgcaacaatcttttgtatatttattcatagattactctgctatacagcctttagctttatacttgatttgaagtttgaaatgaaattggaaattaatatttttacctttactcacatgcacattcagtcttcatttctctccattgacttagcatttctcttcatttaggaaaaaaaatagatttgtggctcagttagtaattatgttcatcctccaattcaagtctttcctgaacttgttcaggtcaggctgacattttgcacttgattaagggagactcgatgatagctaggaatccacaatataatatcttgttcttgagtgtgacttaatgtgcttctaacctaatctcaaggtgtcctgattgtcttgttcattcattgatatttcttcctatttccttggcataccagatcaaaatttgaatatattaatagccttctaaggaaagaaatacaccatagctgtaaaagaagaaaaagttgcttctggtagcaagaaggtggatgacacaaacttccttgcgcaatggtgacctttcaattagcttacctattttctctgttctttgagggtttgatgctagctgcccatttcaaatctgcagcttcaaacaatattgctgtttcttctttgaaacatagatctcagggaagtgactgttggaaaagtaataataatgattctgtttattattttattaactgtatatattagtacagataaatgaacacatggataaagaatattctatactttgggaggccgagatgggcagatcatgaggtcaggagatcgagaccatcctggctaacacgatgaaaccccgtctctactaaaaatacaaaaaattagcccggcgtggtggcgggcacctgtagtcccagctactcgggaggctgaggcaggagaatggtgtaaacctgggtggcagagcttgcagtgagcctagatcgcgccactgcactccagcctgggtgactgagcgaggctcagtatcaaaaaaaaaaaaaaaaagaatattctacttttcagggtaagatttatgccattccatattatagaaaatgtatgctagccagtctcagtggcatgcgcatgtagtcccagctagttgggaagctgggggatcacttaagcccaggagttagaggttctagtatgttacgattgtggagtgccctccaacatgggcaagcctggatagtgagactccatctcttaaaaaaaaagagaagaaaatgtatacttaaaaatttatatttatttccaatttgaatcagtgaaaaagctgagtaaaggtatagacaaaataaagagcatttacattatttatttcagatacatccatgcaaatccacacaagtccatatgtggatgtaaattgtggagagtttttaatcagtgtgcatgccatttaaaaatacaagagatcctagggaaaataatttccatttttagcatcaaagatacttcatctgtttttataaatgtgtgttatataaatcaaatcaactattcttctcattgctacagtatggcatacattaaatccaaagagaagtacttgttcttgaaattaaaatagggaagccaaacaatatgtcagttattaaaaagtagatttttaaaatgattttcaaaattgtagtcaaataatagcccttgactgctctcaaatattacattgcagttccactcttagctaagctattgataattcaattatttgaagaaagtggtttaaaattaacttaaaagttactcttcccttttggataatagattctgcatcatatcatctatgattatgatgatgatgtctttagagtgctcaggaactgctatgttatctgctctgttatgtggttccataatgataacatgcagatggatgtatacgtggaattttcaactaaaagctcctcgatttggagaaatttattaaattcatataatggagactttttgtttgtttttgagatggagtctcactctgtctcccaggctggagtgcagtggcgcggtctcggctcactgcaacctccccttcccgggttcaatcaattctcctgcctcagcctcctgagtagccgggactacaggtgtgtgccaccatgcctggctaattttttgtatatttagtagagacagggtttcattgtgttagccaggatggtctcgatctcctgacctcatgatccacccgcctcggtctcccaaagtgctgggattacaggtgcctggcctttttttttgagaggaagtcttggtcttgtcagttaggctggagtgcagtggcgcgatctcggctcactgcaacctctgcctcctgggttcaagtgattctcctgcctcagcctcccaagtacctgggattgaggcacctgccaccacacctggctaatttttgtatttttagtagagacggggtttcaccatgttggccaggctggtttggaactcttgacctcaggcgatccgcccacctcggcctcccaaagtgctgggattacaggtttgagccactgcacccggcctttttttcttgagacaaactctcgctcttgttgcccaggctggagtacaatggcgtgatctcagctcactgcaacctccgcctcccgggttcaggcgactctcctgcctcagcctccggagtacctgggattacaggcacctgccaccacaccgggctaatttttgtatttttagtagagacagggtttcaccatgttggccaggctggtctcaaactcctgacttcaggcaatctgtccacctcagtctcccaaaatgctgggattataggcttgagccaccgcaccaggcctaatagagacatttcaaccatgaatctcctttgttaattctttctatgtcttgcagttaggttattttttttttcttgttgctttcccacccagctttattaagatatgattgaaaaaaattgtgtatatttatggtatgcatgatgttttgatgtatgtacatactgtgaaatgattacatcaagtgaattactttatctgtcacctcacgtacttttcatgtttttatggtgagaacatttcaccatttccaagtatataatacattactaactgtagttaccacagtgtgcaatagatctccagaacttattgccccagtataattggacttttgtaccttttaaccagtgtctctctgtacaccctcctcacttcctccagagtctggcaccatcattatactttctctttcgtgagttcaacttttttagattccacatgtaaatgagatcatgtagtatttgtctttctgtgcctggcttatttcatttataatgtcctccaggttcattcgtgttgttgcaaatgacaggatttccttcattttaaggctgagtcgtattctattgtgtgtgtgtgtgtgtgtgtgtgtgtgtgtgtgtgtgtgtgtatgtcaccctgttttctttatccattcattcatccatagatacttagtttgaccccatatcttaggtattgcgaatagtgctgtaataaacatgggagtgcagatatctctttgacatactgatttcattttctttggatgcatacccagaagggggagtgctggatcatatcatagttctatttttaattcttggagaaacctccagattgtttttcctaatggctgtactaatttatattcccatcaacagtgtgtgagagttcctttttctctacatcctcaccagcccttgctatctttttgttattttttgataaaagccattcttacttgtgtgaggtgatatctcattgtggtttcactttgcatttccctgattattaatgatgttgagtattttttcatttacctgttgtccatttgtatatcttctttgtaaaaatgtctattcagatcctttgcctattttttccatcatgttatttgttttcttgttattgagttttttgagttcctcatatattttggatgttaacaccttatcagatgtttgtttcagaaatatttgcccccattttgtaggttttctcttcattctgttgattgttcctgtgcagaagctttgtagtttggtattatgctatttgtttatttttgcttctgttgcctgtgttttgggggttatagccaaaacaattattgcccagagcaatatcaggaagcttttaccctatgttttcttccaaaagttttatagcttcaggtctgtgtttaagtctttagcctattttgagtgttttttatatatgtcatgatttcagagtctgattttattgttttgcatgtggttatccagttttccaacactattacagttaggttaatttttataggactttcatcttgaatagttctttaatgtgcactggccactttgttgatacaatataaaatcatgggcaacttagttttactctttttcattaatagtggaatgtggttgttcagatggtagactcaggaattagacctacgtgggaatacatcttggtgtaatcattcaccagctgtggaacttggtgcttgttcctttcactggccacttgtgtacctccttgggcttgccatttgtcttcaggcatctatttcctagcctaccaaatgagatcatatttataactaccttcccaattggctgtttatttctgtgatctatggatgcatttaaaatacctagtacagttcctggcacaccataaatgctagctggtggtattatttcctcaacttaaactctcaggcaggcttatcttttctctacctctgtagttttttccctgccacagctttgctgttgttattcttttcatttgaaatgttcctctatgcctctttacaaaccatggacatttaatctatcttccagcaattaagtcttcatgaatcctgatttgactgttctaattcaccaagatcttttcttttcatggagtctgtgtgtctactgtcagttctgtttattgtgactctcaatgatacattgggatttgatttttgtattttcttgttttgttaataagactcaaaattccatgcagtcaagtgctctctaaatttttacatatttctaaaaattgagcacacaggcatgttttggatttttttgtcttttattaaaaaatgattttttgttatgtaccatgaactgtatgtattctgaacattgaagatactactaattattttaattgttaacaatttgattaagttatatgagtttgtaatacactgagatacattcaaatttccgttgttatttattttagcgggatctttcacaaaaatttatttttaaagtgccatgattagattacacgtatgcagggcactgaatttataagtaaatggatcaaataaataaatgcatcagatgtatatacatttaaataaaattattcacatatacatatatataagaaaagtgaaatacattttttaaaaagatgaaaatataaaattagcaataaaaaagaagtgaaataaaagtaaaaatggaagtttcttgaacttctctgccactggaatacctctctggccatgttttcttcttatgtcctgccctgttgctagacttccacaacttttgaaataaatattttccctgttatattattgaatctgataatatttgtgctgatcggcagcctacttttttcactgtttattttataaaaatttttacgtttcataagtagatccctatggtatttttaatagttacatagtatgccagtgtatgattgttttgtaatttatttaacaattaacttcttagtggatagttagattgtttctagtattttgctgttattatatgaatatccttcacatattttactattctgggccaattattttctttggaccttttcttaggagaggcattttggtgactagaaatatatcctctatttatactgcatattgtcaaactgccttctataaagtctataccaatgtattcactcaagattaacctgtgttcctaaatttttattaatcttttaaaatacttgtttatgttaggtaaaaaatttcatctttcaatattctttgattctggaaagattgaacatatgttttgaaatgtatattggccatttgtaggcattttatgaattgcttcctaatataccatttccattttctactagaatgttcaccttttcttattaatttatacattaatagtatcaactattttttatatacagggtggtcgctaagtctagaaacacaggaaaatatataataaatggtttatagatattataattcatgatcaaataatatctgtttccagattttatggctaccctctacattctacagataattcccttttctctccctacctcccagtatgtcatttatcattaactgagtttagtgtgttttgtcagagggattatttagatttttatctaaaaatgtggccaaatttatagggatgttttattttcagttttggctttggttttagaaaggcccttctcattgaggaattagtcacccaaattttctcccatgacttttattactttattttaaataattgatcatttaacccacttagaatttatataggtgttagtgtgaagtaaggctccatctttatttttcagaatggcctgctggttgttctcagaagaggcctccacctgaggctttaatgactgctaactagcagatttcaagctcttgggaaatccctaacatctctgagtctcacttttctcacttgtaaaatggggagttagaatatttcttatctcaaattgaagtccatgtagggtaaataacttgtccagagtctaacatcttttctcatttggaatagaactttaccctgtacactgtttctttttttttcttttctgttttttgttttttgtttgtttgtttgtttttgagatggagtttcactcttttactcttgttgcccaggctggagtgcagtggcacaatcttggctcactgcaacctccgcttcccggattcaagcaattctcctgcctcagcctcccgagtagctgggattacaggcatgcaccaccacgcccggctaattttgcatttttagtagagacagggtttctccatgttggtcaggctggtcttgaactcccaacctcaggtatctgcccgccttggcctcccaaagtgctgggattacagacgtgagcaagtgcacccggcctaccgtgtacattatttcatgtgtcatttggataactatagtttggggtgaaagggatgatttttaccttgatcataaattgagaaatctaaggttagagttagtgaatggtatatagattcttttttatttttggtcagcagatgttattttaaattgatgaaatatattattttatataaaatacttttcataacagaaactttgaaatatgaagtgctctcagaagaattagtaatgttactttgtaaaaaatacaagaaaatgtcaactcagaaatcaaagtacagatacagaacatggtttttattttgattttgtttaaaaactctaacctcaagatgctttcttgtttaataaatataatgtaaatttttgaaagatttataaagaattaaacaggaaggccaggtgtagtggctcacacatgtaatccaagcacattgggaggccaaggcaggaagataacttgaagccaagagttcgagaacagcttgggcagcatagcaagcctccatctctactaaaaaaaaaaaaaaaaaaaaaaacctgggcatcataaggtgcatgcctgtagtcccagctcctcagaaaactgaggcagtaggatcacttgagcccaggagtttgaggctgcagtgagccatgattgtgctactgcactgcactccagcccgggtgtcagagtgagaccctgtctcaaaaaaacaaaaaaaggaattaaaagaattataccagagaaaatgagaaaatgcccagagtcagtcttagtgatttcaggataactcaaaaaaaaaaaaaaaaagaaagaaattaaaaaatattattgaatggtttgtagtcactgaagtcagagctagaaaagaccttaacttacctgatttttctttgatttgcattctctgatggccagtgatgatgagcattttttcatgcgtctgttggctgcataaatgtcttcttttgagaagtgtcagttcatatccttcacccactttttgatggggttgtttgtttttttcttgtaaatttgtttaagttctttgtagattctggatattagccctttatcagatgggtagattgcaaaaattttctcccattctgtaggttgcctgttcactctgatggtaatttcttttgctgtgcagaagctctttagtttaattagattccatttgtcaattttggcttttgttgccattgcttttggtgttttagacatgaagtccttgaccatgcctatgtcctgaatggtattgcctaggttttcttctagggtttttatggttttaggtctgacatttaagtctttaatccatcttgaatggcgatcattaaaaagtcaggaaacaacaggtgatggagaggatgtggagaaataggaacacttttacacgttggtgggattgtaaactagttcaaccactgtggaagacagtgtggcaattcctcaaggatctagaactagaaataccatttgacccagccatcccattactggatatatacccaaaggattataaatcatgctgctataaagacacatgcacatgtatgtttattgcggcactattcacaatagcaaagacttggaaccaacctaaatgtccatcagtgatagactggattaagaaaatgtggcacatatacaccatggaatactatgcagccataaaaaatgatgagttcatgtcatttgtagggacatggatgaagctggaaaccatcattctgagcaaactatcacaaggacagaaaaccagacaccgcatgttctcactcataggtgggaattgaataatgagaacatatggacacagggtggggaacaccacacaccggggcctgttgtggggtggggggaggagggagggatagcattaggagatatacctaatgtaaatgacgagttagtgggtgcagcacaccaacatggcacacgtatacatatgtaacaaacctgcacattgtgcacatgtttcccagaacttaaagtataataataaataaaaaaaaaaagaatgtggtttttcagtagtccattttttgctatttcttaacaagttttatagagtcttggcctttgacttagcctttttatattatcatttcatattgactattgaaagggtcttatactagacccattgtgcccactgagtaggagttatgagatgaagttattttgttctttttattttggtaaaattattttttgtatttttacctttgcctttcaacagggcatccttaaatatccctccaaattcagaatatgggtttaggctgggtttaacttgccagactgcttaaagctgtttgctaattgaatttatccaaatatatcatttgttgcaactttgatgtgtttgtttcactcatccaccatgggccgtttactgcccaccacttggggtgtccctgctatccacttcactttgtaaacattggaagatagttgagtaccatgaagaaaacaaagacctcgggctttagcacataaaaaaaaaattcccggccggacgcggtggctcacgcctgtaatcccagcactttgggagaccgagtcgggcagatcatgaggtcaggagatcgagaccatcctggctaacaaggtgaaaccccgtctctactaaaaatgcaaaaaaaaaaaaaaaaaattagcctggcgtggtggcgggcacctgtagtcccagctaccagggaggcagaggcaggagaacccgggaggcgtaacttgcagtcagcggagatcacgccactgcactccatcctgggtgacagagcgaaactgcgtctgaaaaaaaaaaaagttcccagatgctgctatttgattagattatcatattttgcatacttttagaatctttagcaaacataacctaaaatcaaagtacacagtacacatatcacaaaatttgtgataatttttggctgtttttccaaacagattgaagctgcacgtgatagtttccttgtttatctctattgttccttccacacacccatgtgacatttattttctttgtggttgactgagaaaaaaagttaactttcccatgtccttccccggtcagctatcctgtttgccttaaattctattgctcttcacttgtgttggtactttcaggcctttttcactaaacactgtctctcttcaaataccttctcggctgccatcattcatgttgaatctttcttcagttaaaaaagttcagcatggacttttatgttttacttcattgttaaatgtatattatgggttaaatgtatttatttttttgaaaatattatatgggtataggtacagaattttaaaaagtttcctttacatctctgtcctccagttatccagttccccctttgagcaatatctattattgcatttattgtcagtctccttcttgagggagcccatgtattcatgtatgcatgtatatgtgaatatacacagacacacagacacacatacttacagacacacacataattgtattttttgtatgcagatgttggcatattaggtacatcctactgatatctcttagcaaaagccaagagttggagaccagcttgggcaacatagcaagacaccctctccgctaaaaaaaaaaaaatttagctgggcatcatagtatgcatgcctgtagtcccagctacttgggaggccgaggtgggagggtcacttgagcctgggagtttgaggctgcagcaagccatgattgcaccactgcactctagccaggggaacagagcaagtatctctctctcaaaataataataataaaaagacttaaagagaagaggaaatgctcagaggcattcttagagatttcaggataactcaaaaaagaaagaaagaaagaaggaaggaagaaaggaaggaaggaaggaaagaaagaaagaaagaaagaaagaaagaaagaaagaaagaaagaaagaaaaaagaccaagtaaaaaagatatcttcacttagcaaaatatcttagagctaattccatactaatacatgtagaaatgtttcattctttttaagggctacatagtatataccatttgatggatttaccataatttactaaatattcctctgttaaggctcattaagtttgtttacagttttttattattacaaatggtgctgtgggctgggcatggtggtttatgcctgtaatcgcagcactttgggaggctgaggcgggcagatcacctgaggtcaggagttcaagatcagcctggccaacatggcgaaacccgatctctattaaaaatacaaaaaattagccaggcatggtagcatgcgcctgtaattccagctactcgggaggctgaggcaggagaatcacttgaaccagggaggtgaaggttgcagagagccaagatcatgctactgcacttcagcctgagcgacagagcgagactccatctcaaaaacaaaaacaagtggtgctgtgatgtcatgtacacatgtttttatatgtgtattatattacacatataggattatatctataggataaattccagaaatgaaattgctgagtcaaagggaatacataatttatattctcaccagaaacatatgaaagttcctttctcataccctgtttccatcacatgcaacattgctctagctgtttttggcttccccgtagggccctgaggtgatgttctcccatacttctctcagtttttctgttgttattatattattagaaagctctgcctattatgtgcctgttccaccacagctccctccatcccaccagtctgttttccttcaagactcagatctatcatacattcatcttagaaacatccttgctccataatcaccattctgttcccttcccctagaactttccaggcctgattaggtgccctcctgtgtgtgtgtgtgtgtgtgtgtgtgtgtgtgtgtgtgtgtgtgtgtgtgtgtgtgtgtgtgattcctctgcacacatggtcggtttcccctgcacgcttctattatggtgctcatcactgtgaattgtgttcgtgggttctttgtacattctttcgccattttcatctctttgtccaaaacacttttcctatgtcaacatgtagtagaggctcagtaaatatgtttttggataagataacttaaatccagtcagaattttagaattagatagggccttagtgatcattttatatgtttactttattagtgaaaagtagacttttaaattttaatgttttaaattcaaaattcaacaattcgttgttttaaacttctttaagaaaaaaaacaaactaattaaagtcagtagttttttacttgcctgtgacttttttctccctgggttcaaatcaataccccagtattacggtccttaatgtacaggggttttataatggaacatgctgctgtttcttcaaactcaacaaatatcagatatatatatatatatcttttgtttcttcccattttccttcttgctcaactatcctttgttctcaggaccttgctccctagacctgcccaagtttggaaaagactgagagggaaggaagctgaaagcaaagaatcactgttctggctgggtgcagtggctcatgtctgtaatcccagcatttcaggagaccaaggtgacagggtttcttggggtcaggaagtagagatcagcctgggtcacgaaactagaactcatctcaaaaaaaaaaatcgctttttttttctttctttttgctgggggacctgtgaaaagcattgtgccttgactgtgaaggccaaatgatgctcttagtgctcccatccccgtttccttttttacagtctagacattgatatttaggaacgatctcggtctgtagagcagacagattctcataatctctattcacattgatctggggcagagaggaaaagaaaagagagagtcttcactgtttacaaactttaaaaatattaaccgcacctagttgagaaatgtggaccatggtgtgaagataactcggtccttctccatagggagggtaagaatccagaaaagttatgccagtgccagtttccctacctgaaatccagtcactcgagggagaggctccctaacacacctttcataacgcttttcgtttatttatttatgtgcccttttaattgtacatacctcttctgtgtgttttggtgttcatctcgacatcttttggctatctctccttgaactgtggtaaccaagttttcttatcttcaacccctatcatgacagatgttttgcttgttattttggattgccaatcatcagccaagacttttacagctgtgataccattattcatgtctcaggaatctgcacaaaagaaaaacctcagattattctcaggcattttgggaaatattctgttagtcctgtgcaatacctagttcctgcttccatttaatttcattgcaattttaaaaatgtttatggagtccctattaactcatagttttggacttcttggtactctgcatagaatatttataggttctttttttcttctccatcctctttacttcatagaaaaggacaatgcttaatttttattaaaatattccccacagatgcctaattcatttaatactgaaatctagaattagagcaaaaagttgagagagccatgagaagaatatgtcagtgatgtagatatatcttggattcttttcacttggatgcatctgtagagattattttgtttcaggatctcttctgttcctcagtagcttaacatgaagccttaccattatgcgttgatttctcttttataaaaacataatttgaaatttatggctgaaaagcagcaatgaagacactgtttttccttttgctgggctgtcggctgaatttagtttgaggaatacaatggttcatcagataattgtgaaaagaggtgccacatccaaaggccttagataatcaatcctctgtgtctggcatatagacattcacaattgataatatatatgatgttttctccttttccatcttatcttcttttgcatgttttcagatgttgcaaaaaatttagtaattttccacaagaaaattcactcctaaaaggttgtcctagaaacagttttgtaaaatctggcaggagagcaaagcatatttaacttttatgtttgtagttttgatatgattattagctctgaaaatatagaaactaactcaagttaggtcatcgtgtcaaggtcttgatttgttttctttccatttattatttatttaagccagttttaggagtgattatgaggcaatgggaatttttaacaggcctttcaaaacttatacagccaagtgagttatccctttaaagttattaccctaggaggacattgcatttattacaataaaagctgtattgctcaaaccaatgttagattgagggtagggcaggtaggatttgcttttaatgtctacagcacattattgaatctttttttttttttcttaagacagggtctcgctatgttgtccaggctggttttgaactcctgggctcaagcaatcctcctgtattggcctcccaaagttctaggattacaggcatgagccaccatgcctggccacatttttgaatctttttaatgatggaataacatcaatagggtatatttgagttttagaagtagccaacagctcttcaggatcatcttttcactagtttaagtgtttagcctgactaattatttgttaatcacaaaaatatggttaggaattaaggaaactgttttttcttgtatgtcacatacattgtctctgaagctaattccaaaagataagctttaattaagttttgaactatggcagcatcattgacataaatgaagaagatctcaagatgacagttttaaaaatgacaactctcatctgactatttagttctgttataataaggaaaaaagcccattccattatttattgtagcattctggtattgtgaaaacacaaagacattttagtggaatcaaaataaaatagtttgtctaggtgtgattactattagctcatcagaaataattgtaagttggctgatatttgctggaaatggcccttggaatggaaagctaggtcaggaaatgacagctaatggaatagactgaaatgtgagagagtggaaaggtcaccttttaaggacttactgctggagtcttgagataaatggtgagacataattttctactctttggtgcctgtttcatgcccccattacttaaatttccctggctcaggtttaatccagtaattttccatcataacgattatgtgctcatgatagaaaaacaaacatttaaaaatgacccacattttctggctaggtatagcagagtgaactcttgcatatatctttgctccattataatgatagtgagggtataataaactaacaagaataaaacagatgggagacatcaataaaattttggaagatacaagaagaatggacaagtggtaactgacttaccagagtggaaaaagctgacttctgatttcaacaagaagtagcacttgggaaaagttctagaaatagaggtgatgagatacctcagaaaactgggtggtataggtctgagaagagaaggttatcttagttttgtaagatattaaactctaaaactttgttttaaaatgggaaacctgacagtcatagttttgttttattttgtttcacatctataaacatatggaagaaaagcgaagtgccaagtctacttttttggcttaatggttatttatgctttatagcaaacagagatgtctgtttaaatattcttaataggataacagattattaaggaaacaaacagaattacagactttttagaagttatacttaccttcataggacataacaacatattttcatgtctgaattgtgggaaagggtctactgttggaaataatgttcacaaagactgttctgttacatagattagtacttgctttcctgatgatctaaaagaaaggatgttttcttttcatcttgatggccttcctttcaccagtagttggaagggcctgtagtgttaaagctaactattgcacttccactaagtagaaaaaaagcaggcctgaaaagcataaagcttataatgtgaaatgaaaatgtcagaaaaagaattttaatcaatggaatatagaacatatactgtgttgcctctagtgcttgaattttcctaaggagcagttagaagcccagctaagtttcagtaaccagggatatgcttcttcctttcctggcagaagtaggaggttctctttctggagaaacaacccacgtttctggattgtgggcatagtcagctgagggcaagtgatatactgaaaacaggagggtgtactgatttctatatgttgaatcagagatccttagttcccatccccaggttgctctctgaacattgacaccaagtttatgctgtccaaccaggagattggaggttcactctctgggcaaagtgatcaatccatggtaaagaatctgtggatgttgacatttaggatccttctaatgaaatttctgcctccctctagagacgcccacccatccacaaccctgctgttcttcacagagcttccaggaatgtcgtaatgcttcactgtcaacaacaatggagagccaaggacgatcagctgtttaaccaaaaagaaagagagcagagaaacaaatgaattcagttgaaacaatgaaaaatttgggaacagaagaaaatctttaaagctcaaagctataataatatataggcctaccttggagagattgagagttcaattccaaactgcctcaatacagcaaatatcacaataaagcaagtcacgtacattttatggtttctcagttcatataaaagttatgttcagacacctgtactcatatgttcaatgaagcactactcataatagcgaaaacatggactcaacctaggcgctgatcgatggtggactggatttaaaaatgtggcatatatacaccatggaatactatgcagtcataaaagaatgaaatcatgtcttttgcaggaacgtgaatacagctgaagaccattgtcctaagtgaattagtgcagaaacaaaaaaagaaatactgcatgttcttacttataagtgaaagctaaacattgggtacgcatggtggacataatgatagaaacaatagacactagggactcgaaaaggggagaaagggatggggacaaacgttgaaaaactacttactgggtactatatttactatttggttgaggggttcagtaaaagccaaacctcttaattatacaatatatatacatgcacatgcaccccatgaatctaaaaaaaaaccccaatactgtgtttacactatattatagtctagtaagtgtgcaacagcattatgtctaaaaaaagtatatactctaattaaaaaatactttactgctaaaaatgctaatgatcatcttagatttcagcaaattataatctttttgccactcgggggtcttgcctcagtgttgatggctgctgactgatcagaattgtggttgctgaaggttggggtatttgtggcaatttcttaaaataacaattaagtttgctgcattgattactttcacaaaagatttctccatagcatgagatgctgtttgatagcaatttacgcatagcagaacttctttcagatttggacttaatcctctagaactctaccactgctttatcagctaagtttatattattttaaatctttgttgttatttcaacagtgttcacaacattttcaccaggagtagattctgccttaaaaatacactgtttttggctgggcgcagtggctcacgcctgtaatcctagcactttgggaggccgaggtgggtggattacgaggttaggagatcgaaaccatcctggctaatggtgaaacccgtctctactaaaaataaaaaaattagccgggcatggtggcgggtgcctgtagtctcaggctactcaggaggctgaggcaggagaatggcatgaacctgggaggcagaccttgcagtgagccaagattgtgccactgcactccaccctgggcgacagaatgagactccatctcaaaaaaaaaaaaaaacaaaaaacactttttttcgctcatccataagaagtgactcggccaggtgcagtggctcatgcctgtaatcccagcactttgggaggctgaggagggcgaatcacttgaggtcaggaattcgagaccagcctggccaacatggtgaaaccctgtctctactaaaaatacaaaacttagcctggtgtggtggcaggcacctgtagtcccatctactcaggaggctgaggcaggagaatcacttgaacccaggaaacaaaggttgcagtgagctgagattgcaccactgcactccagcctgggtgacagagcaagactctgtctcaaaaaaaaaaagagtcctcctccatccagatttgatcatgaaatgtagcattcagtcacatcttcagactacatgtctaattctagttatcttgctatttctacgacatctgcaggacttcctccactgaagtctttaaccctaaaccatccatgatggtcaaaatcaacttcttccaaactcatatttgtgttgatattttgacttcctcttatgaatatggatgttcttaatggcatctagatggggcgaaggttttcaatttactttgcccagatccatcagaggaatcgctatctatggcagcaatagccttacaaaatgtattttttaaataataagacttgaagttgaaattacttcttggtctgtgggctgcaaaatggatgtggtgttagaaagtatgaaaacaacattaatcttgtacatctccatcagagctcttaggtgactagttgcattgtcaatgaatagcaatattttgaaagaaatatttttttcctgagcagtagatctcaatgacgggctgaaaatattcagtaaaccacattgtcaaaagatatgctgtcatccaggctttgttgttgcatttatggagcacaggcagagtagatttaggataattcctaagggccttaggattctcagaatggtgagtgagtattggcttaaagtcaccagctgcattagccctaaacaaaagagtcagccttctctttctttctctctctctctctttttttttttttttttttttgaggcagagtctcagtttgtggcccaggctggagtacagtgacacaatcacagctcactgcagcctaaacttcctgggctgaagtaatcaacctgcctagcctcccaaatagcttggactacaggtgtgtaccaccacacctgggtgctttttaaaattttttgtagagacagggtcctgctgtgttgcccaggctagtctcaaacacctgagctcaagccatcgtcttgccttggtctcctgaagtgctagaattacaggtataagccactgacctgagcccttcttttgaagcgttgaaaccaggtattgacttctcctctctggctaggaaagtcctagatgacatcttcttccaataaaaggctgttttgtctatgttgaaaatctgttgtgtgctatagccaccttcaattgtcttgtctagatcttctagataaattgtggcagcttctccatcagcacttgctgctttaccttgtaattttatattgtggagactgcttccttctttaaacctcatcaagcagcctctgctagcttcaaacatttcttctgcaacttcctcatgtctctcagccttcatatagttaaagagagttagggccttattctgggttaggttttggcttaagggaatatgtggctggtttgatcttctatctagaccactaaaactttcttcatatcagcaataaggctgttttgcttttttatcattcatgtgttcagtatagcagcatttttaatttccttcaagaacttttcctttgcattcacaacttggctaactgtttggcattaagaggtttagtttttgacttatcttggctttcaacatgccttcctcactaagcttaattgtgtctagcttttgatttaaagtaagagacatgcaactcctccttttcttggacacttagaagccaatgtagggttattaattgacctaatttccatattgttttgtctcagggaatagggatgcctgtggagagggagggagatgggggaatggccaatcagttgagcagtgagaacacacacaaaatttattaagctcgctctcttatatgggtttgattcattgtaccctcaaacaattataatagtaacatcaaaggtcactgattacagatcaccataacaggtaaattaatgaaaagttttaaatattgtgagaattaccaaaatatgacacagacacaaagtgagcatatgctgttggaaaatggcgctgatagacttgcttggtgccggattgttacaaaccttcaatttgtaaaacaacaatagcaataacaagaacaaaaacacagtatctgtgaagcacaataaagcaaagcacaataaaacaaggtatgcctgtattcaaagagataactactgcatttatgaaaaaagaaaatcatacttaaaaatgcagagaaaaacacctagaaaaaacagtagaaacagtaacaaagcagtagacgtttgaatactatggttgaaaataaaagttctcccagaaaacaggacaaaagatgaagaagtggaatataggagagacaagataaaaacttagaggatcattcaccatggtagtgatattaagaaaagaaaatttagaggatcattcaggagactaaacatctgactggtaggagtcccagaaagacactagagaaaggacagagaggaaattatcaaagaaatattttaagaaaatttttcataacttaaggacaggaatttctagattgaaagtgcccattgaaagcccaggacagtgaatgaaagaagacccacatgaagacatacaattttgatgttttagaatggtggagataaaagagaagatcacaaggcttccatagaggaaaaaacaggtcacatgggaaagatcagaatcagaatagcattagacagacttattactagccatactaggagacaatggagcaatgctgtgtaagttctgcaggatttctgtacttacaaatccaaaccatcaatcaaagatgagttctcagaaaatatatgtgcaagatttaaaataaattaacatcatgcattctttatttggaaggcattggagactgagctccaccaaaataagagggagaagatcaagaaaatgtgagatataggaaacagtttacaatgaagtgagaagccaagggaattcccaggatcataggttctaggattatggctgtacaacaggcctagggtgcagttagtccagatgtgagcaggaggatggaaggccacaggagggatgtagccaagaaaatattggaattaatttattacctaatatatttgcccatatcgaaggctttatagttacgtagaaaagtttaatgctgatgtagctacatatgtagaaaactagacaaatgaaaagagaagaaaattatgggaggagtaaagatacaggttgaggttgggtttagtggtccagagaatgagctttgtagtcaggctatctgaatttgaatgctgtctataacacttagtactactaaccgcatacccttgagtaaattacctttctgtccttcagtttcctcatctatatggagatactaatcatacctaccactttagtctactcctgcttctataacaaagtaccacagactgagtaatttataaatcatagaattttttttcctcacagttctggagactgggaagttcaagatcaaggcactggcagattcagtgtctggtaaggggtcattcactgcttccaagatggtgcctttgtgctgtgtcctccaggggtgacaaatgctttgttttcacgtggcagacaggatagaagggcaaaggggactaactttctaaagattttataaaggcactaatctgttctatgagggcagagctttcatgacccaataacctcccaaaggcctcacctcttaatatcatccccttgagggttaagttccaatgtaaaaactttggaaggatgcatccattcaaaccacagcacctacttagcatgttgttatgtggatcagatgagctaatacatgcaaaaccattagatcagtagaaatagtactagtaatcatagtaatagtagtagtagtggtagcagtggtaatagtagtaggtgctcaaaattgttaactattatttctattattgctgttatttttaaaattgaaaaataattaagatgtttaatacttttcttgagaaattttgtgataagtacccagaagaaactgtttaaaataataaacccaaaacaaaacatttttaatgacctatagtgccaccactcaaaggtgaaatttttaaacatgtaggtgtattttttcccgtgcattgttttatttatataattgttacattctctctatataattttgtgttctgcttttgttttttaacataaaagaaccatattacctgttaatgcaaactctaattgaagagtttttgttgacttcattattttccactaaatgtatggaaaatatttcgtttaaccaagtatctatttttatatatttggtttgctttgtgaataacattgggtgatgcttttctaaaatacatttcaaaatttaattttattattagaaatataatacatgtttattatagacattttaaggtgccaaaataagatcagtaaaattaatgtaatagtaatctaactagctagagataagcactgctagcgtcttcataatgtatgcctgttgtcttttttcttgacaatatatattttttatttcttttgcaaaatgtagaacttttcttgtagatggtatgaccaccttttgatatcttctatggcatgttagtgtcagcagagtgtttaattgtaaattttgggatcttattttttaaattgctttaaaatttttcagtgtttcacaatgatagtgtatggaagatctttacagctacacatctattttaaaattattcaaaattattccttaaattcttagaaacagaattgcaggttcaaaaggtatacacttaatatgtattgtcaaatttccctccatgaaaattctacaaaactctatgctcacagccttgtcaacactaggttttctgatattatctttttaattccataaaatgtctcctatatttagagttatttttcttcattagattcttaggtacaaagaatattagaagtttaagacttttactgttttgaaaaattgctttatcagaagaggacagtatttgactgtcattaacagtggataataatgtctgctactctgtcttctcactaatgatggaattgttatattcttcatgtggatgataagcgaaatgttgacaggttaacagagtagatcttaagccttgcagtactccaggcaagatagcatggtggctcagaccagggtggtggcaatggaaatgttcatattctggaaattttttttgaaaacactattgacagaattttcttatcagttccatatatgatttgtaagagagattaaagagtcaatgatcactctatgatttttggccagggtaactggaaaattgaagtagccatttaagaagcttggaagattataggagaatcatgtttgtcaagcaagatcaggagcccaagtttggacatgttaagtgtgatgcttatttaataagtaagagatgttgagtatatagttggatatatgattctggtgtttagaggagaattctaagctggagaaacatcagcatataattgagtacaattatatcctgtataattaattaagagaaaacattagatgaaatcaccgaggaagagagtgtcaaaagaaaagaggaggatcaagtactgatccctgggggtactccaatgtttaggaactgtagcgatgagaagaaacctacaaaggagacagaagcagcagcaagagaaaggagaaaaaccaggactgtgtggttcctggtaggaaattgaaggaaatatttccaagaggaggggtgatcagctatgtcaaatgctgcttatacatcaagtaagattaagactaagaattaactgttagatttaacgatatagaggtagctaaatagtgaccatgaaaatacagttttggtgaagcggtgtggtgaaaaccagattagatgggatctgattttcaagtgattaatattataaaaatgcccaataattcaacattaagtgcccaaaatctccatttctagggtactcataagaagtctaagtaaattttgaagtaagtctggcaattttacccttaaaaaactacaaaacattagtcctttacttgactgtaatggggaggaacatgtctccctctgttgattatttgcaataagattcaccagggactcatttgaattgccttggtgtagtgtgttccctggtaccttggcttttttttttttttaaattatactttaagttttagggtacatgtgcacaatgtgcaggttagttacatatgtatacatgtgccatgctggtgtgctgcacccattaactcgtcattcagcattaggtatatctcctaatgctaaccctccctcctccccccaccccacaacagtccccgagtaccttggcttttaaagtggtattgagccacaatgatcagatatgccaacaggccattatatgttaatagaattttactagcatatttgtagactgttaatttgattaaactttcatgtcttggtaacttttctttatagcagaataaacgtagaagattctgatttggtaggcctgacggtgtctaggcatttttttaaaaaatctgattctgctgcaaagccggcttggaaaactttgctttattaggaacaggattctataaataagagctaacattcatgatagtggcaggctcagcttttacttgatcacatttattgtaagtgccctagtcctagcatacacatttaaagctccctgataattttcatcagattgtgacttcctcaatagaagtaacaaaaatagcctcacctttagacacaggggtacacagaaaatttcttttatgtgcataagcaagagagaaattatatttacaaactggaaaagtaattaagtgaaactttcatccaaaaatcagatatttaataaacttttaattcccttttgtagtttccttttaatttagtttaaacaacataaacattttaaataccactcattacatgctgagggtatagataacagttttggcactttaaaaaaagctgaggaatggatggttaattctcagtgatatttattcattttctatagtgaggattctctagtatatcaaaaggatctggagggttggtgcatggctagagaaactaagaaaataaagatgatgaaatggaggtgttggggagggattcagagaatggagagaatgggaagaatgttttctttaaaaaacctttccaagctcataatttgttattcctcttaaatgaaataatgaaatttggatccttaaagcttccattttttccagttctcttcttctggagaggttttcatagtttaaagaccttatgaaatctttgattttcgattgtgaactatgatctgtgggcttcttttattttcactggttggattataatcatatttgaagtcttatgattcttttatattggtccaaagaaagttacatttaatatttggtgactgctctaaggaaaacatagtaatttggggcagcataacaatcactgaatgttagaacaagaaggcatagcttgttacagtatattataatctttacagtgtatattgttttgcacaattctgtaggtcaactgggcagatatgctttatgtagtgtcagctgggatgctattatatctggaagatgcaaacttgcctcaatcacgtgtttggaaattggtgtcagtgttggcttggaattcactgggtctgtcagctagggacatgattctcctccacatggtctttttatgtgattgcttgggcttcctgacagcatggtggctggattcaaaggagaattctacatgcatgaaaatggaatctgcagatctcagatgttacgcagagctgtagtttgaatgtttgtcacctctaaatatcatgttgaaatttaattgccattgtaacagtatgaagaggtgggaccttttaagggtcattaggccatgagggctggctgcactcacaggcctgggattggtgccttattaaagggcaagttggattccctcttgcttctgtgtgtgctctccccctctctctctggctcgctctcaccctctcttgtcttcccttaccttccctccctcttcctccctctccctacctctttccctctcttctccctgtctccttcctccctatgtttctccttctctccctttccttctctctccctctctccttctgctttccttctctccttctctccttctaccatatgatgacacagcaaaaaggccctcacaagttgctggcaccttgatattggacttcccagcctctggaactgtgagccaacatatttctgttcattctacattacctagtctgtgatattctgttacagcagcacaaaacagactaagacacacaatatcacttctgtctcatatttttcacagggccagctcagattcaaggggagaagaaatgatttccacttcgccattagaagagttacaatttattgccttctttaatcaaccacagtttgtcctttggccacaaattatttgtatttatcacatatgcagaatgcattgaattcctccagagacccctgaaaaatcttattccattatagtatcaggctcaaatgcaaggttcaggttctcatcatctgaattaggtccaggtgtagataaggctgcttagatgaggtagcccaggtgtagacccttgaaccaaaaagataacctgaaatacagggtggataggggcaggatgactgcagtagatactcctgttcaaaaagtgggaaatagctactcggcagtcactggtccattgaatttctgatactgaatcaggtatgtcactggtttctcctgctttggcagaagggaatatatgttgattaaggctctgctttgcttcctgggagcagtccttttgtggttcttgggttcatcctctgagtcaacatttattttttttttaaaagaaatgtgccgggctttaagctagctatctttctggtctgtttcctcactataaagagtttgaactgactgtccattttggtccaagctggtgtggttccagtgatataattctcttaagaacttcacaggtttcatgtgaatctcattggcatttaccccattagacaaatccacatccacagatctttttgagataggtccctctctactgtgagttaagatgctatgggacaatgcactgaagatccatactagcctttttgtttaggtgagaatgtctatgagaacctacaagatacttagaaactcttttgtctagctgaggcccttaatagttttcggaactcttttacatagatgatttggtaaaggcgaaacagcctttagtctgtctgagttataacaaagcgttttaaaactacacccttgacttactcttgaccttgagattacatcttactggcagcaccttggattagatctttgctctgaggctgtttctttgaaaatctattgcacattcaagttgctttgttcatttgtttgcttcttatgcaagcatcacttcagaagcacatgattttgtttttttctattattggttatgttaactgtgatcacttggttaaggtgatgtctccagtttttttttcactgtcaagttgttactaggatacattttgaaggtagaattgaatgttcggatttgactgagagagttatgcattagacatgttgaatttgagatgcctatttgacatcctagtagagactggttcagaaacaggggtgctggtagattggaaagatgaggtagtcttgttttcatttttccagtgaatacagaagtgagattatctgaagggagtgataatgagggagcacagtagagatgtgaggagagagatttagaaggatcttctcagagtaaattgactggaaaagcgtagtggacttaagggcagtgttgtgatgagggaccatttgacaactgtgatcctacaccagcctatgaccattcaagatgttctatttcttggagtcagactttgattagtagaaggagttttactgtgattgaggtttggtcaagcaagtacagtggaaagaggggtaaattagtttagagtgtgtgaagggaggtgatttatcaggacagatcatggaagataaactggattaagtagacaagaaggtgaggagagtgaaaaagtggtagataggctcaatggttttaagttccaaaacagtgagatagagttctagagaaagatgaatagatatgagatggtgaatagggtatgtgaatgattgaaatcaggatatgggatgcatttcatctatgttctggtttaataccataccagctttatgaagtgattttttttttttttttttttttagtgtctccattttaaacagaagcaaattatgttgatcaagattaagcagcttggccaagggtacacaattagtaaatggcagagcttggatggaaaattaaaatatttgtttttgtttttaactcccaaacctttgtataatactgtacgagctgtctctgattcatgacagttgcccactacacaaaggataatcattattatgactgaaaatgtttacattatatttgttttgcttttttaggcttgttatgacatgcaaatgaaaaaaggtctcagaaaacatttctaattttataaacatcttacttcctttagagaatgagtggcctttagaaattggttgaaaatgatttttacttttatatttcaaagttcacaaacaagcattcacacatcattattaagctattagtatggagtgaattctacctgacccatttacattaatataaaatttcctttatgttaaggaggtcttccattttcctacacttaaaatgatttaagtagatccctatataatgatgaacaatgatgttctaaagaaaataacaagataatttgattatctctacttcaggaagcttcaagaaaattaacttaggttctaacttgatgatagtaaagattttatggtttagtagagggaaaagtgaaagtttaaatttaaggattctcaccctaatcattaaaataacaatactttgcagactttcacaatatgcaaacaaacaaaaccaaattgcatgagctgtttttggtttaaaattacatggagcgctttccagcaatacttgtatatagaggcttgattgaaatagctgcataattcctgagcagagggcttttctttgctgtaattacattcgtgcagtgactcatattctcttaatgcctagattttataattcaaagggaaatgttcccttgaaatttgaaagcctggaggactcaaaagtagtttttagattttattattattattattactactactattcctacaccacagctagtattcctctgaggagtatttgacttaggtgattttgatttcactcatgctggctgcagtagtggggtttgactcatgtgacagtgagagagcaagggtcccaaagatgtctagcacagggatagggtgttctgcattcagggacttcagcagtggagatgtggggctttcactctggtattcaccaccgtacagctcagtttcttttaagtgtcaacttacttttgactttctgtttctctttccttcatcagctgaatgatttttttctgaatttacaagttcagattcccaggagagggaacctggctggctctgctgataaacatgcctctgtatgatgatgtttctctcctacatctggggaagtttttaagactgatagcaaggttggaggacagtcctttgcaaacacctggctagtatctctcctgttttgggtaaacagggtgtgatgtggatgctggagcaattaccagttttgcctgaggcaggtctttccatataattttacgtttttgttataagcccttggaaatttgtgaaatatataatatactcatgatgaagacaaaaaaagagacaattttcaattggatgtacaacaggtactttcttcaccactctcctttccaacaatattgttcagttctctgtaaagaatcatgatggtcaaggaaggcctggcaggagaatcttgattgttcaaagacaaatgttcttgtcaaaggattggtttaggagtggccatataatgtaattctggcagaagatacttgagaagatgaatgctaagagctatttttgaaagggcttgttcacttttaaaaataaatacaaggctttttttctttttttaatcttggaataatgtattttctataagatggtgagaattgcagccatcatatcagggtcatgagaggagccagttaagagagccccggctaccatgctgagggcagagcagaaagttgtaaacacccctcatctcattaatggcactgagccaccacgtgagccaaccctggaactgccctgatgtcagatgggaagattactttgatgcaatggtagcctccaagtatgcttaggtgagctatcctagaggtgagggaaccaaaagctcccacagactaaattccaatcctcaaatcacgtaattcactaaattaatttaaagtgcacagtgagaggcaagaggaaagattattaggttggtatacctgggttaggggcaagtagggtagaggggccatgccagctaatcctgggatacatagtgttcatgttcatacatctgcatatgccttccccactgatggtgtggttacaaggaccagagttgaggtttgggcaagccccaaagatagcagtcgtcccaagctaataacacctgctcaagtgtctgagagatactgggacaagtatgcctagtcagtggctgtggcttgccagttagcctcacaaacagtcatgagttctgttatgtttattggacagataacaaatggagcaggaaagagtatcagcagttgttaatcagggtaattttgtaccccagtgtacatttagcaatgtctggagacatttttgattgtcatgactggtgtatgtaagagatgctactggcatctattaggtagaatctagggatgctaagtgtgctacagtgaacaagacagcctcccaagacaaagaattatctggcccaaagtatcaattgtgtcgaagctgaaaaaccccctcatgaatattaagtacatatgtatatttagtgtatcctggatatttagtgcctcttatatatttaatatatcatgaacatttattactcatatgcttcaagagtaattgacatttcttgatcttgcagccctttctgtcagtgtgtaacacatatacaatcttctttttatactttatacatctgtgaattctgttcatgtcttactagcaaaatatatactgaaaatatcttaaaagggtttgcctatattttataaacatcaaatttatttatcaagtagaactgaatatcctcaaaagcaaatttatattatgctagacctggaatttcaaagaagaaataagatgataaatgtcctgattgtttaatatactttttgttgtgttttctacagcttgcagctgagagcgtgctagctgattctaacataaagtcagtaagaacatctattctcaagataaatgaagcattgacttagactataattacaagttttctaaatagtaatataagtgtcagataatacaggattatggtgcctgcattaatgtaatgcttgtttgatcgttctgtttacatttcaagcaattgtaggcatggtgcttatcatgatgaacctctgtgctcaaaaatgcacatttttagatgattggaacagttttagtttgatgaccttcagttcacttaaggagtttttagttggctcaatgtctattaatagagcaacactagaaatttatagcttgatgcattttttaaaatttattaatgatagttttatttatattttagtgctttaaaagattaaaaatattttacggaagttgtgtcttgagacccctccattaaaagggaaagtttttcatatatatgaaattaaagagaagcatatttaagattatagaaacatgtaaatgttgtttaggattgatttcaaaaaagaataattttcaaatgttgatggtatatattccatttcatttcttttaactttctttgcctttttttattttgtgatgaaaactaacattttgtcagatgaaaatatcacatataacacattaaagaaatggtaaggcataatatacaattaaaactgtttgataaaaagttaaagtaaaaaattaaggacaatatgtctttaaaataatgatgtgcttacggtagtttcctggaattattggctggttcagcagaatcagctgtgctcagcaatggagtgacaggtggtgtaggcagttcaacctcatgtccttttagaaatactgggtgtgtgtgtgtctgtgtgtgtgtgtgagtgtgagagagagagagagacctataaagtgttgatttggggggcttaaagaattgttaaagcagatatgtgtaaactagatcctgattttcgtgttttacatttttgggatcctctttagtcatcatttatttttgttgttgcagtgatttgctgtcctctgaatacatagagagacacattgaacatggaggcaagactgtggaagttaaagtaagtgaaattttcctacttgtggggaaatttgttgagaatcttttaatactactgattattattttaattttcaatgatatttctaatgtacagttttgagggttttaaaaatactttataatttgaagttttatcacccactttggaaaaatgaaactttacttttagttatcagaaaaagaatttttagggtactgtaggaattgctagacttaatgttttgtaggattgctatagctgcaagtactaggttggtgcaaaagtccttgtggtttttgtcgttacttttaatggcaaaaaccccaattattttattttattttattttatttttttgagacaaagtctcgctcttgtcgcccagctggagtgcaatggcgcgatctcagctcactgcaacagcgcgatctcggctcactgcaagctctgcctcctgggttcaagtgattctcctgcctcagtctcccgagtagctgggattacaggcgcctgccaccacacctggctaatttttgtatttttagtggacagggggtttcaccatgttggccaggctggtctcgaacttcagacctcaggtgatccacccgctccggcctcccaaagtgctgggattacaggcatgagccaacgcgcctgggaaaccccagtgacttttacaccaacctttagttctttcttagattatgtcactgaaagtagtttttgaaatttgcctttaatgttacccctgagaaccaagaggtgaaaacttgggtccagggtaggtgtttgcctttgcattcagctgtgtaagattcccagccctgccgcccctccaccctgccccaccccacacctccaccagtaaaatgtaaaattgttagatctacaggagatcaaggagttaaaaatacctggagacagaaatctcaggatactggttatgacaggtaaactgtgaaaatattaacacaaaaataaaagcctccaccagctagaggcataagaatgtggcggttttcccccagatctgcagatggtataatctgagagcatatgaaaacaaaagccacccaagtgtagggcttccttctgctcagtgtttagtatagtgacttttggccaagtgtttattttcttctgaatagtgttcagactatctattctactttatctgaattataatcccactcgttcatattcatttcctttttctaattacaaattagataaatgctcattttagaaaacttgtaaacagagaaaagttgaacaaaaaaggaaaactttatccttaaactcatcactgagagataaatgttttcattttgttatttgagtgttttttgtcatatgcacacatttgtatatatacatagatatttatatagtatcatatgtagctacaatattgtatctgcttgcttctgtatcattttgtaaacatttgccaagttattttcccataaagcctttgttcagttttttatgtacatttattacatagtaaagctttttatttaaactgttatcagtaaccaaaataaattatattgtcctattcaaatgacattctgaagataattgagtttttccattacatatatatgtaaactaaaagaaaacttttcattatggaaaagtttaaacagactttgaagtgaaaagaatgctataatgagggtcgggagccaagatggctgaatagaacagctccagtctacagctcccagcgtgagcgatgcagaagacgggtgatttctgcatttccaactgaggtaccgggttcatctcactggggagtgctggacagtgggtgcaggacaatgggtgcagtgtaccgtgcgtgagccaaagcagtgcgaggcatcgcctcacctgggaagtgcaaggggtcagggaattccctttcctagtcaaagaaaggggtgacagacgacacctggaaaatcgggtcactcccaccctaatactgcgcttttccaacgggcttaacaaacggcacaccaggagattatatcccacacctggctcagagggtcctacacccacggagtctcgctgattgctagcacagcagtctgagatcaaactgcaaggtggcagctaggctgggggaggggcgctcaccattgcccaggcttcagtaggtaaacaaagcagcccagaagctcgaactgggtggagcccaccacagctcaaggaggcctgcctgcctctgtaggctccacctctgggggcagggcacagacaaacaaaagacagcaataacctctgcagacttaaatgtccctgtctgtcagctttgaagacagtagtggttctcctagcacgcagcttaagatctgagaacgggcagaatgcctcctcaagtgggtctgtgacccccgagtagcctaactgggaggcaccccccagtagggtcagactgatggactgacacctcacacagctgggtactcctctgagacaaaacttccagaggaacgatcaggcagcagcatttgcaattccccaatatccacttttctgcagccaccactgctgatacccaggcaaacagggtctggagtggacctccagtaaactccaacagacctgcagctgagggtcctgactattagaaggaaaactaacagaaaggacacccacaccaaaaacccatctgtacatcaccatcatcaaagaccaaagatagataaaaccacaaagatggggaaaaaacagagcagaaaaaccagaaactctaaaaatcagagtgcctctcttcctccaaaggagcgcagctcctcgccagcaacggaacaaagctggacggagaatgactttgacgagttgagagaagaaggcttcaggagatcaaactactccgagctaaaggaggaagtttgaaccaatggcaaagaagttaaaaactttgaaaaaaaattagacgaatggataactagaataaccaatgcagagaagtccttaaaggacctgatggagctgaaaaccatggcacgagaactgcatgacgaatgcacaagcctcagtaaccgatgtgatcaactggaagaaagggtatcagtgatggaagatgaaatgaatgaaatgaagcgtgaagagaagttcagagaaaaaagaataaaaagaaatgagcaaagcctccaagaaatatgagactatgtgaaaagaccaaatctacgtctaattggtgtacctgaaagtgacggggagaatggaaccaagttgcaaaacactctgcaggatattatccaggagaacttcccaatctagcaaggcaggccaacattcaaattcaggaaatacagagaatgccacaaagatactgctcgagaagagcaactccaagacacataattgtcagatttaccaaagttgaaatgaaggaaaaaatgttaagggcagccagagagaaaggtcgggttacccacaaagggaagcccatcagactaacagctgatctcttggcagaaactctacaagccagaagagagtgggggccaatattcaacattcttaaaaataagaattttcaacccagaatttcataaccagccaaactaagcttcataagtgagggagaaataaaatactttatagacaagcaactgctgagagattttgtcaccaccaggcctgccctacaagagctcctgaaggaagcactaaacagggaaaggaacaaccggtaccagccgctgcaaaaacatgccaaattgtaaagaccatcgaggctaggaagaaactgcatcaactaacgagcaaaataaccagctaacatcataatgacaggatcaaaatcacacataacaatactaaccttaaatgtaaatgggctaaatgctccaattaaaaggcacagactggcaaattggataaagagtcaagacctatcagtgtgctgtattcaggaaacccatctcatgtgcagagacacacataggctcaaagtaaagggatggaggaagatctaccaagcaaatggaaaacaaaaaatggcaggggttgcaatcctactcttggataaaacagagtttaaaccaacaaagatcaaaagagacaaagaaggctattacataatggtaaagggatcaattcaacaagaagaactaagtatcctaaatatatatgcactcaatacaggagcacccagatgcataaagcaagtcctgagtgacctacaaagagacttagactcccacacaataataatgggagactttaacaccccactgtcaacatcagaccgatcaacgacacagaaagttaagaaggatatccaggaattgaattcagctctgcaccaagcagacctaatagacatctacagaactctccacctcaaatcaacagaatatacattcttttcagcaccacagcacacctattccaaaattgaccacatagttggaagtaaagcactctcagcaaatgtgaaagaacagaaattataacaaactgtctcccagaccacagtgcaatcaaaccagaactcaggattaagaaactcactcaaaaccgctcaactacatggaaactgaacaacctgctcctgaatgactactgggtacataatgaaatgaaggcagaaataaagaggttctttgaaaccaacgagaacaaagatacaacataccagaatccctgggacacattcaaagcagtgtgtagagggaaatttatagcactaaatgtccacaagagaaagcaggaaaggtgtaaaattgacaccctaacatcacaattggaagaactagaaaagcaagagtaaacacattcaaaagctagcagaaggcaagaaataactaaaatcagagcagaactgaaggaaatagagacacaaaaagcccttcaaaaaatcaatgaatccaggagctggttttttttaaaagatcaacaaaattgatagaccgttagcaagactaataaagaagaaaagagagaagaatcaaatagacgcaataaaaaatgacaaaggtgatatctccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaatattgaaattgaggcaataattaatagcttaccaaccaaaaaaagtccaggaccagatggattcacagctgaattctaccagaggtacaaggaggaactggtaccattccttctgaaactattccaatcaatagaaaaagagggaatcctccctaactcattttatgaggccagcatcatcctgataccaaagcctggcagagacacacaaaaaaagagaattttagatcaataaccttgacgaacattgatgcaaaaatcctcaataaaatactggcaaaccgaatccagcaacacatcaaaaaacttatccaccgtgatcaagtgggcttcatccctgggatgcaaggctggttcaacatacaaaaatcaataaacgtaatccagcatatagacagaaccaaagacaaaaaccacatgattatctcaatagatgcagaaaaggcctttgacaaaattcaacagcccttcatgctaaaaactctcaataaattaggtattgatgggacgtatctcaaaataataagagctatctataacaaacccacagccaatatcatactgaatgggcagaaactggaagcattccctttgaaaaccggcacaagacagggatgccctctctcaccactcctattcaacatagtgttggaagttctggctagggcagtcaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtccaaaaatcacaagcattcttatacaccaataacagacagagagctaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcgatgccatccccatcaagctaccaatgactttcttcacagaattggaaaaaactactttaaagttcatatggaaccaaaaagaacccacattgccacgtgaatcctaagccaaaagagcaaaactggaggcatcatgctacctgacttcaaactatactacaaggctacagtaaccaaaacagtatggtactggtaccaaaacagacatatagaccaatggaacagaacagagccctcagaaataacgccgcatatctacaactatctgatctttgacaaacctgagaaaaaccagcaatggggaaaggattccctatttagtaaatggtgctgggaaaactggctagccataagtaaaaagctgaaactggatcccttccttacaccttacacaaaaattaattcaagatggattaaagacttaaatgttacacctaaaaccataaaaaccctagaagaaaacctaggcaataccattcaggacataggcatgggcaaggacttcatgtctaaaacaccaaatgcaatggcaacaaaagccaaaattgacaagtgggatctaattaaactaaagagcttctgcacagcaaaagaaaccaccatcagagtgaacaggcaacctacaaaatgggagaaaatttttgcagcctactcatctgacaaagggctaatatccagaatctacaatgtactcaaacaaatttacaagaaaaaaacaaacaaccccatcaaaaagtttgcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagtgcaaccattgtggaagtcagtgtggcgattcctcagggatctagaactagaaatgccatttgacccagccatcccattagtgggtatatacccaaaggattataaatcatgctgctataaagacacatgcacatgtatgtttattgtggcactattcacaatagcaaagagttggaaccaacccaaatgtccaacaacgatagactggattaagaaaatgtggcacacatacatcatggaatactatgcagccataaaaaatgatgagctcatgtcctttgtagggacatggatgaagctggaaaccatcattctcagcaaactattgcgaggacaaaaaaccaaacaccgcatgttctcactcataggtgagaattgaacagtgagaacacatggacacaggaaggggacctttacacactggggactgttgtggggtgggggactgggggagggatagcattaggagatatacctaatgctaaatgatgagttaatgggtgcagcacaccaacatggcacatgtatacatatgtaacaaacctgcacgttgttcccatgtaccctaaaacttaaagtatataaaaaaaagaatgctataatgaaaccccccattcccatcatccagcatcaatagttatcaacactttgactatcttttttttctctttttactttgtgtttgtgtgtgtgtgtgtgtgtgtgtgtgtgtgtgtgtgtgtgtgtgtgtatgtgtagtattttaaagcaaattccagactttaggacattttgtcagtaaatacctcctgtatacctatacatttctaattcataatgacttaaaatctggtaattcttgtaagcgacctagatgtaataattatgcctgtctctccagaaagttattcggaactgaagattggtgaattgaatggtggattaatttatattactgcctccctacagaaaggacaggattcatctagatataacatgggagaatggagccattttgtttatagttgggaaaaaaaaattacctagggctagaatctccaggtccttttattcccatcccttttcatttggcttcacttctctattttgtatgataatgtttttctgatgtagagtatctcttattcccttgttaaattaaagaggaaaggaaacaggccattcactatctatttctatctgtgtctgtcagtggaatgatgaaatgcaaataggagcatggagggtggacccagcagacagctctctgctgtctctacagtaatatcctttttcagaaaaattgtacctaatcagcaaagtgcacttcactctgggatcttaaggctccttgggtatacataactcatgaagcgctgactttgctgcacaatctttgctgattttccaacctgagatttgcagtttctttgttgatggtttttctaacccctaagcctgtcataccagggaaatgataaatacaaactttgtccagactgaagggccagtggtggtttatttttccctttaagaaaactgctttgatctcacctgtcacctccatttgtttccactccatttgaaaatctaactcaaaattctcctctgggtttttccaggaaccacattgaaaatgctgaattctgcccatcaatccaaagtcagtagccaattatttctctgctggttccctcctgtctcgacttctgtgcttagctctttgagatgtttctttttacatgaaatctgatagaagtctattttctttattaatgactcattaatacattataaatcaaagttgtaacgttttatattttttccttccctgcagtacctttttaaaaagcaactcttaaaacttttacttctttaccttccatgttagtttgctaaagctaccataacaaagtaccacagactgggtggcttaaacaatagaaatgtatgttctctcaattctgaaagctagaagtccaagatcaagatgttgacagggttggtttctgccgaggcctctctccttggtttgtgcatggttttcttcctgtgtcttcacatggctttccctctgtgtatatctgcatcctaatctcttcttgtgagaacatcattcctattgaactaggacccaacctaataaccctgttttaactgcgttacctctttagagaccctgtctctacatacagttatattctgaggtattaggggttaggactttaacatatgcattttgggggaacacaatccacctgtaacaccttccttaagagccctgtaagtttttttgttttttcttaaagttggcttttctcttgggactgaagtaaatgaaaggaaatatgaaatcaaagctaaactctaagagcttcttgtgtcagtttgcacaagcatggccatatgtatcctaaggatgcaaatttaaaattaaagtgttattccaaatttaacaatggctagaaaccagttgataaatggctgtactcaggtgtctttgaacttttggtaaagaatacatttttcaggaaaaaacatttttaaaaaagagctggatgcagtgtcatgcctgtttgcacctaccaaggaggctgaggtgggaggatcacttgagctcaagagttcaaagccagcctgggtaacatagcaagagactgtcttgaacaacaacaacaaaatcatgataaatcttttagattgcaattttatttttaaaaacctatatggtaaaatatacaactgacacagaaattcacataaaacatgtatgggttgatgaaatactaaaggcaaacaattttatattgaccattcagttcaagaaataaagctcggccagctgtttatttgctgcatcccaagcccttttcatcctcctcttgtaagatttgtaaacactatcctgacttttatcataaccccttccttgcttttgtttatagttttatcaccaaagcatgtacccctacagtttaattttggctgtgtaggttttaaaaataatttttgcctgggcacagtggctcacgcctgtaattccagcactttgggaggccgaagcagggggatcacgacgtcaggagatcgagaccatcatggctaacacggtgaaaccccgtctctactaaaaatacaaaaaattagctgggcgtggtggcatgcacctgtaatcccagctactcaggaggctgaggcaggagaatcgcttgaactcaggagttggaggttgcagtgagctgagattgcgccactgcactccagcctgggcgacagagcaagactctgtctcaaaaataaaataaaataataatgttttaaaaattatctttctcttttgtcccccccttgcaatttatttgttgaagaaaccagattgtttatcctatgtaatttcctacaatctggattttgatgttgattgcaattttgtatttagtgtaaaaacagacacattttggtgattgttccttaacataatgatttgtgttatctgcagggacatcatcagcctcattgaaatcagtttatcttgttcatgtagctgtgcataattctgatataaaagttatattaaaacttaaaaagaatttttttcaaaggttacaaaaataaagtctttatgcaagaaaagaaagatactttttattcctttaatgggacatattaatctttcacttacgtttattttcaatccatttaaaaattaaattcttaatttactcatctgttcagggagaacttttatatgattgacacggacttctaaaagaattttaaagtaaagcctcaactaatcagaataccttgggaatacaactttaattctgattatggagaaccatcgttctggattcataagacaaaggacattggaattgatgagtagtggcagcagagtctcagccatgcagtttgctgctttatagcttgttttgtcttgaaacagaaagctgctaatatatggggctaattgaaatgaacagttatataggctttagttaatcagtattataatgctaacagtaataactatttattacagtaataacttttattgtatgatgtgatagtcacataaatttgtatgtaccattcaatcctcaagacaacctgtaaatacaactattatcctaatttacagaaacgagacacagagaagatatacaacttgtgaaagtaacgtagtaaggagtaataaagctgcagtttgaatctagattctctaactccagagctgactcttacatgtataatattttatatactatacaatgtacaccatacattcggtgtacattctataatatgtaaaataagaggcataaaaattgaaatgtattttatttttatactcatggtatacatatctaattcatttttggtatctaacaatttctcctttatggtctttaatccttaaactgaaatggtgatctacatcaagaccctttaggcatttctctcaaattcagttatgcatttaggtagtttttctgtaatatcagttgccttgggcaagaatggtaaaagacacactccaggccaaagcttgttttatttttgtttgaatgaacgtatgaggaaaataaccatagtatgaattttagaaaactaagagaggaatgtcaaatcctttatataggtcaggaatgtgtgtagatggggcagggaacagattttcttgtggccaaaaagtaaaagtagacatctttgtagagatatgatttattatatcaccaatgaaagatcatgacagtcaggcatattctgactattagcattgttctgataatatttcttggtgaaattatttgatctgatatgattatagtaaaaagtaatcatcagtgaatgtctatgtgtattagctcaagttatttctaaactactgtatatgagcattcccaacttgtcttaggattagattcctaatccttaacgatgagtttgtacagagacatccgttacacaatattgacttttgactggtaattaactgtttacgactcatcatttgattgaattgagtgcactcaagaatcactgcatcaaaatcttaattgtattcatagttgcagtaaaaagatgaataagtaagcaaaggagtgcgggccaccattgaagtctggaaatgagtaaaggaattggagagagtgctgtgcgttgaagggcagttgtcagaggagaaaggaatacataagggtgggagaggttattatgactctagggaaccttttactctggtggtagtatagttacattcaatgacataaaagttatatttatttaggaaaactgaaaatggccactatcatctgtggaaacaaagtaacaaggaatttgagttagtagcaaggaggaagcctgagtttttatccagaatagttttctgcttctgttcacatctgtcttccctccctggggtgggagccccatgatagatttctaacttagcacaataccatctcccagcaggcacctatgctgctagcagagtctctagattccttttgtgctcatttttctaagtcagatttccatttcttctttcttaaaaaagggataccttttaaaaatcctgccttaatcgtttagttttccccagtgaatgtgtcaatgacaggaaaaaaaaaaaaaacactagtagaggacagctgtaagaaatcacttagaaaattttaaatatagtgactgtcaggacaacagatgcctccctggctaactttataattcctgtgaacttgaacagcagtgatagaaaatttcttgcgatctcaaattgtattcaggatttctcatgtcacctcttctagatttccccgcaaggaccatacttctcaatacttgaataactcgaaaggtacacaacgtgttagagaaataatgtttcttaagatatcttttaaaatgtattgtttgtaaaaacaacaacaatccaaaattatatgtgcaatataacaccgtggactccttttgtaagtgaaatatattctcagtttgtcattagtgacagagttcagtttatatacgatataggttatagtttagtgactgcattccatttcttttttttttaatgacagtacttatacttaacatattctgttatgggacatagattttttttctgagtccagtgcaaattgaatagtaaagaattgcttgaattgtttcttttttggccatgggaagcacacaagtagctattaaactgtcaaagtggctcatatttattgcaacagaaaagatgaacacaggggttaatttgcttttgcttaccctggatataaaatttccttattgattcttaaaactgcattaccatacagaatcttggctctttctataagagtaagaagagtaagcaattaaatatatatataaaaaaagaaaaaacagaccttggtgtgcagtaaattttgctgcatgcgttattagtacagagctatccatacccttgcatcaatgatgaatcttctgaagtagagacttgtgtgttttttcaagtaggtttttaggttatcttttgttttggatgcagtctttgagataaaatgtgagcaacagccactgttaccaagtaatctatactaaggctttttcctttactctcattttcatttttcttttccaatagagcaactcagcaacagcatttctcttccaaagtgccttccttatttacagctttcccttgcatttgagaaacatgctttctgtcttgaattctcacttcagtagcttctccagaaactcttggataaggctcttggataatacttagtcacctagacagtaattaagtcacatgatttaggaagatggctttagaaatgatgtttttccttttgaaacagatctatttatagaagttgtcacttaagctcttaattttatcaccaaatttcaaatccaagtttcaggcattttccttggctctgtggagatggggaggctgctttccaagtaaacaagctcagtgatgtgcattttaagggccggctgatgggcagagtgtcaactgagggccttcagtcattggaggtctcctgctgccatggtaattggaatttcttttttctaaaaagaacagctatattgaggtatagttcacatagcataaactgaggtgagttttggtctccattttgtctgctagggaacatagattctttaacagtgtgtgtgtaaatacagttgattaaaatgatcacaaacaattaatgaagcaatgatagggttgtttggcagatgtgactacctgtatgttaaaatctgtttttatgttttccttgctgcacttgctgggagatttaggttaaggactcttgctgttaagcttaaactctgagagcagaacttttggtgtggaacaaagagaaccctcaggtgcaggtgttacaggttgtggcatgagcatgcaggtacctcacataggttctctcagacaggagaggaaattttggatggtatagctatgaacatggtgtctttctatgctaatcagaaccaagttaaccacaaatacacagattttaaaattaggtgacttgcaaaaatttattttcaagaccattctctgaaaaacagtttggccacgacttaatgtcagtttgactagtaatgaaactaaaatgactttaaaaatatttatcaatacatcttcatacatgaatatttagttgttagctgtaggtaggctagctttaaacattattatattttaatgactccattctcccctaattactgaaataaaatgatttttttaaaacctcaggatataaagatcctacaagaataagagctcaactttctaaaagtgattccataagtagggttcaccatatggtaatttaatgagaaattattgaattgaatttcatggtgcttatgggaaacaatattaagatcttctgatttagagatgattctgtaattgcagatagggccaacacaggaaaccgtgtcccttggttcctgtgggtttgagctgttgcccatttttaagtactttcatttttaaatagtgaattgtgtcagaggaatactcattaattttctctgttactcgttcaagaactgtgatattctcacagaagtattttaaatactgaacaaaagtttatctggaaatattatagttttgatggttagtatatgtaagtcatagtgagctagcttcattgattaataattactgtatattgctgtcctgtagaaagattatgctttcatatactgtctattaactcaggctccctaactcagtcttaggggcaaataactgccgccagtaatttactgttagtcatttggaagagttaaccttttctccttacaaatccaaactcattttgcttacttaaggctactgatggattattctttttagttaatgacactcatcttaatggaattaaaaaatataatgacttgttgtatttctgttttacatcattgtcaaagtcttgtatttttacaaataaatattatatattcctataagtgctcactttaacaccagggatttcctgtattatgcaatctgtatgtctttcaatcctatgatattcagatgagatcaatactagtaactggatttaggattaataaaagtactggtagcagttggagtaatagcaaatacttgtatggtatttactatgtgctagatgccagtctaagtgtttcacatatgttaagtcattttatccccaagtaataccactgttatcctcattttgcagatgaggaaatgaaggcacagaaagtttaactaacttgcccaagaattttaagaaaggaagtctggcaccagaatgtgtgctataatctactgtagtttatcctccctatggaaataaatgatcataatagcagaggaattagaatgcaaatattttaattacagcccttctacaatttaccatttgtaattcaccgtctcttttagtagttgttttaataggccagaattgaagatgtgttagttcaggtgagtcccaattattccaatataaaattttctttattccaaagaccaatgccttctaaagactcccccaccccccgctttttttaaaaactatttcattttggagttcatttttagtccttctttgttcttcatagaagttggattgtgtattgttcagcacaggggagcaccatcgcttcaaatcattatagtttgaaatatgttactgtcttgcacatggcaaacacatggctcagtttatgcccatcttttgcctatgtgtaaatttatctgcatctggagtaaatgtgaagttttatgggcaagagtaactaagctgaaacataccattatcctgccaagagactagaagatatttgattgtatctctgccaaagagcttcaaaatacccatcccccctacctcttttaccctccgttccacaacatacacagcccgcaagcaggaagagagtaaaagagccatacaaatctaacaaacaaactgataaagtgtttatttcctcctcacatgtaatatcagttattccagatatgtttcctaactttacatgtaacatcagttattccaggtatgtttcctaactttactttttatctgccactaggcatcatttagtatcttctggatgagcttattgatgtgtgcatttcccccctggcaggcttatgcagacatatgctcctctgccatcttgtaatcagtgtggtttcaggaaggtctcagatttcatgatttaattctctttgcattataggaaaaaaatttggggggattaagtaaattttgctttctcttgggactgaagcaaggttgctctaggtccatcatcatgtataatgcatcaactgccttaatggcattgttaagattgcaagtggtcttaactctgtatcctgaggaaaatatgttggcccattgccagtttatacaggtcaggtgtcttagtgctggaagaaaggaaaaatgaaaagtgacagctgctgtcagcatgagttctgttcctaagctctgtttgtaacctatttgagtagaaagtcctttattttctttctggtataagattttttttcccccagttaactatctaaagagttatttcatctgttaatgttcaagatgttatctataaacttaaaagacatattcagccataagtttttttaaaaatcaaagtagcactaactgatgatatttccatgtatggaactaattagctattttataatagaatttactattttaattctaattatagaactaaccttttcattatagaatgtcttttccaaatctactcttgcaatttttttgaaactagagtgaactattacagtaattataattgaacagaaagtagtagaaatactgtttttgattttaaactggtttgaagcaaaaaaaaaaaatcacaaattattcccttggtgttgtcataagctacaattattttcctattcattaataaaaataccttagtttccagtgaataaggtgtggccactataaaatcagaaaaggtaataaagaccagagaatatatactattggtattgagtggtttgagtgtttacagcctttttgaaggaggataattgatcagtgctacatttgatgttttttgttttgttttgtttctttttttctttctttttgttgttgttgtttgtttgttttgagacagggtctcactctatctcccaggctggagtgcagtggcgcagtcttggctcgctgcagactcagagtcccaggctcaagtgattttgccacctgagtcctaaaagtagctgggactacaggtgcatgtcatcatgcccggctaatttttgtatttttagtggagatggggtttcaccacgttacccaggctggtctcaaattcaagtgatctacctgcctcagtctcccaaagtgttgagattacaggcatgagccactgcatctggccacatttgatattttatcataacactattttctttgcacctatgaggtagaaaaagagcagatggacttgattttccccatagccactcataaaaactcaggcatgtggagtttaagtggctggaaagctgacatgagagatttacagtggaatagaaaaaaagccataattctcagatactcaatgtgtgttctcaaccctcatttattcaatagacatgagttgagtgcttgccaggggccagtgacagggatatagctataaacaacagatgatgcatttcttgccctcatgaagcttgtcctttagtaggagagacaggcatgatgcaggcaactactgagaactctttgtaaatgatagaaatgataagtgttgaaaagaattacatgttgctctgagggcacttgctgggagacctgacctcatctggttggtcagggaagactttcttgaggaaatgatattatttccaaagttcaaaaaataacaggtgaatgaaatgggagcagaacaacttttcaggtagtcaaatcagcatgtgcaaaggccagaggccttgatgcaggatcttggtgtgtgaaaggggcagaaagaaaccagagaaggtggacagaataagaggtggagcaagtgcacaggaagaaaagggatgaaagtaggaggatggtatttgaccagagcctcaactcagaagaatcaggtacaatgtaaaggaaatcagactaacagtgtttttggacttcctacattggtcactttttgccttcgttttctcttctcttgaaaatctggaaattattttctaactctgtggatggcagagtggttgctttggtaattctgagtggggttaataggtattccacatagcaattagatttttggacagagtaaatgctattttcttgaagtcctgctgtctttctgattaaataaaaaaaataaacttcttgaattgtgttaacaaatggtacccattttttggttgttatttttaactccaggacatatctgtggtttgaggacagtaaagcttagagaccatgaatattgtgagggctagaaggacctaaactcaaatcctgactttgccagttaatatacgtacgtccttagacaatttacttatgcctcctatacttcattttcctcctctgttaaacaagacaaacatgtagctcagagctttgggtgtgggaaatactccataaatattagttctgatatcattattgaggtaaagtggcaatttgtacagaatttctggcaaagtctttggtggcttctacccattcttactgctagtttctgattccactcatgacaggaagcatgtcaggatcaccagcggcagttctttacttcctgctttataagacaattttctgtgcctctagactgtaaattccataagaagttcctccaagagaagcacccacgggaacttgtactatattctcagcatttagcataatatttgttcatagaagacaataagtatctgctgaatgaaaaaaataagtgaaagaattaatccaggtattagaaaattgagtggtttctcctgttcacccaacagtatgtcagatgtgtaggggaaagtacagcctggacaggtctgggaacgcatattattccccctgctatcaaaatatgcagtgaatataaacaggaaaaataaaaactgatagccttataatcggcttgcctgatggtaagcgcatcctccacacagaggctcacattcatgcgttttctttctaaggtattttagagccacgtctgatcagttttaaattttaagtcaccaaatatcaacaattggcctgcgataaaaatctctataatcgtgaaatgttttaaacatgttaaaaattgtataaaatacctcaacagacatccacgtgtagatttaacatagttcagtgttttgctatattagcttttaaatcttttcatggttttaaaatctactaattgtgtatcagcatgtctcctgttagtttttatttttattcttgccttgactcttttacttgatcaatcttgttagaattttttgtaaatactctctccccacccgccccccaccccccctttttttaaagacagggtctcactctgttgctcaggctggagtgcagtggtgcgatcatagctcactgtaaactcgaactcctagcagtacttctccctcagtctcctgagtagctgggactataggcatgtgctgccacactaattttttaatttttacttttagtagagaccaggtctcactatgtttcccagactggtctcgaactcctgacctcaagcaatcctctcgcctcagcgtcccaaagtgctgggattacaggcatgagtcattgtgcctggctgaaaatacttttttttttttttcccccaaagaaccagctttactttctttaccaaaatatatttttcaataatttctgctcttacttttgtaatttccttttttctgctctgaaatttctgcttttcttttcataattcatttagttaaatatttaatttgttaattaccaatcttcttttctatatgcatctaagaatttaaaatttactcaagtaccattttagcagcatcctaaagctctgctacatagtttttttttgctgttgtccacacacacatatatatatattccataacttatactatgactttatatgactcataaattatttatatttttagaaataatataatattttaaaaaattgtatatttggtattttaaaaatttccaaacatatgaacatctttgttgttggttttaaattctattcctttgtggtaagtgcagtgtacaagatattgattctttggaagttggccttgtatttaaaagaaaagtaacctgtgattttttaaaacagtttgcaaatcatggaacaagaagggactctggtggttcaactcccttcttgatttatggaaacataagtaacagaaatagtgaatgatcagcttattctcatagaaacacttgctgggaaaaaaagcactttactttttcatgcttagcatcacttttcattagatacaaccttaaatattaatttgctttccatgaaggatattgtttgagacctctttagtaatctgactctttttacctgttaataaatcctgggctaatccaaaatcatttatgcagagataaaaatgaccactgaatgctagtattaactgcttgagcttagcatgtaaggctcaaggtgcaagagagccttacatgctctcttggacgtgctgcaaccagaatctttttttcttttcttttttttttttttttttgagacagagtctcactctgtcacccaggctggagtacagtggcaccatctcggctcactgcaacctccacctcccacgttcaagcgattcttgtgcctcagcctccccagtagctggaattacaggtgtgcgccattatgcccggctaatttttgtatttttagtagagacagggtttcaccatgttagccaggtctcaaacacctgacttcaagcgacccacccgcctcagtctcccaaagttctaggattacaggcatgagcctctgtgcctggctgcaacagaatcttttagcggccagaaattttctctttatccttccttcttcaaaaaaggaatggaggatagaattgaagtgaaactaaaggaggttatgtttatggtaaaagtggagaaaaaacgatttcctttttttccttaccttagaccctcatatagttgtgtttccttaaaaaaaaaaaaaaagaaaacaacaacaaacatctttttcagatatgacaaaagaaaattcctcctgtattttaggaatgcacaaatatgttttctctttgtgcaacaatcatctagtcagttatgttttttcctgttactagtcaaacatcaactacagaataaggttttaggtaattcacagtctttatgctaaaaagtccatatagagtaatgcatttaaattttattattcataaaaaggtacaatgatatagtggtttcctggaaagagttataatttcatgagtttgtaattatatagtaattatatattatgtggtccacattgattttccattctcccaatttagaactacatctcagagaatctgataagccccctctctgcattacagtaatctgttgctgagcattttgtgggaacctaaaatttttagtagtctgatatttgttatattagtgggtgtctaatgattacttgacagctgcatattaatttctctcgactattctgttacaaataagcaatttaggaagctgtgtttgacttagtaaaatggaatattaagtttgccatattgtgtaaaaataatgatgagtattttaaaataaagagataggaaactagaatgctggttataggtaattaagatacaggttaattttattagatgagtgatgccatggtagacacctccagtttctaccactgaaccaagcttcttaaaaggaaaatccctggattgtgaataaaaatttacttggctatgtataaagagatgaattattttactggtttgaatagtgttccccaaaattcacgactcctagaacccatgagtatgaccttatttagaaacagaatcttttcagttgtaatcaagttaagaggaagtcatgctagattagggtgcgccctaatccgatggttggtgtccttaccagagaaaggtatagacatagagacacagagacaaacacagaaagttatggcccctatattttatggtgttcaccatcttttaataagattaactccttcctcatcacttttattcctatccagtggttttctactgtctttcttttcctttcttgtggaaacttttgctacaataatattcttacacatcttttcctctccggtggtaatcatgtatcttttaaatgaaattattctttttcatcggctcgttttatttccttttaattttttaagtccataatatgcctaatccttttggtttttaaaatgtttttgattgatactacaagatcctagtgctcaccaatgaatgttgaaatagtacagagatttttaatgactatgttgttagatgctgtttgaacatttgtaccctggaatggagtggcaaatattaatacccaaaggtgttaaccagtagtgtatatgagagttaagttacctgtgataagatgggcagtatgtgccttatttagctttagctgatttttgtcttgcaggaaaatggaaaagtggtaatggagtcttactcttaacagatctcttaatttttaggggaagatggaaaatccaagttcaacaactctgaaagtctgaaattttatcctacttacaagttaataggcattagcttgctgcagttttatctatgccggcagaagacaggaaactcctgggtcagagacgaaggacttcattactctggcattggcaatagccagaatagcaacattttcttaccctggtatcttgagccttaattcccagagggtaacagaggaaagggccggctaacctgagcacacagtgcattgtgttacaacaaagaaattccgaatttaggaaacctgaatcctttatagtgggaagtaaacatgcctgccctttgctttgaagggagattgtctccatcttccaaagctgttccctatgcaaacatcattgaaaggatagtccagaagaatctcagacattaaggggttctagatacttattatagtgaaatattactgagtaatctttcagaattcatttccatatgtaacattaaatattacattttaatcatttaaattaagcctgatgatgtagggtagttgtatttttaaggcttttgaaaacctatagtgctaagttaaagtctaggaagtattcatttgtattcttggtcttatacttttatatttcatagatccatatactaacaaaatgaattttgaggatcaacatagggttgccatttcttctattttgccatatatgaaaacaaccctctcaaaacatctaaatactattactattgctaccaattttaaaaaaatgaacctaaccactaatgcaatatggcactatggattggatcctggaatggaaagaaaaaattaaaggaaaaactggtgaagtctaaatgttcagagtctagtaaatggtaatataccaatgtcagttacttggttttgacaaatatactaaagaaatataagatattaacaatgggaaaacctgggtgatatactatacttctctataccatctttgcaacttttctgtgtatcagaattattccaaaataagtctatttaaaaaaggaaaacagttgatattttaaataataaaggtaaggaagtaaacatagaacaaatgacagtttttcaaaaattaaatacatttagctttatgaaaaattaagtacactgtacttatttttatttttttgacaggaactgataaagattttgagatgcattagtatagattcatggattattggcatttgggaaccatgtgatagcctcacttaattttaatttactgtaaatgagaggaaataatcttttcacttttcttagcctttagaatcagatacttttagaatcaattatactctgtacctgaccagatatttagcctatgtcctttttgtgaatccagtctgattctgtacagtcacaggttatgagttttaatcgggataggttggtggatcatctttaacataaaatttagcttttttaagaatttccattatgcagctggccctaaggagacttactttgttatttgtttattttcttattttaatttgtattagagatgcggtctcactatgttgctcagacttgtcttgaactcctggcctcaagtgatctccctccttggccttctaaagtggtgggattacaggtgtaagccaccatgcccagcctcccaaggagacttacaactgggaaggtggagtaaagattggaggagggcaggttcctgatgttgatgccagtcgagagggagttgagaccaggcaagaaatgtggttttggtaggaaagcacctggtggaacagactgcagccatgcagccaccaatgtgtcaggacagtgtatacacttggggggaatctaggatgcagtagggttcaaggacaggccgttagttcctgcaaggtggtatcagctagagcagaggttcccaactatggtagcatattggaatcatctgggcagatttttaaaatacccaggtcccaccctctagagattctggcgcagttggtatggggtgaggctgtgaattttttaaaagagcttcccatgtgttacaatatgctgccaggttggcaactactgtgctagggtggggtgagaaagggtcccacttgtggaagagggtgactggcatgagcttcccaaactgcatggcagaaggctggttctaggaccagtgcccatggagggggagaaggctatgattcagtgaacagagcaggagaacaagagttgcaggggcgggtgtttggatctggaggtgcctacactggccctgacccttttagcatgaccaaaccattcctatctgcctgtgactttcatagatgtagcactgaaataccagtatcctgggaaacccctttgtcccaggcaaactggaagtttggttattctagcccctttgatccaggccaaagcatcctgcatgatatcctatgaccagcaccaacaaaaatacagctctgcccttccttgatattcttatctcaccttttaccttccattatgtttctgataaagccaactcttttttgggaaacaagaaacagagtggagtactacattctgtatcaggaagggtcagctcaggaactagtgtaagatttcagtgagcttagcagtgaggagcttcagaatcagaaacaggagtagtgtaaagcagttgttctcaaactttagaatgcagtaaaatcacctgaaggtttggctgaatcacaggtgggtaggctgcatcctccgagcttctgaggaagtctatagggaggcttgagaaatttgcatttctaacaagctgatgcttttggtctgcaaaccactctttgagaaccactggtgtaaataaccttgactttgtagcaggcatacctgggtgtggatgatctctctcagtctatggtttctcacttgtaaaaggggggaaataatactcacctcatcagtcatcatgaactatcacataattcactaaaaaggatgtccaggatatggtagatacttccattctctgaaagatctttctgtatcctttgcatggggacagtttggtattgaatatttttagagttaacaattccagatttgatcatcaaaatcatgtagaggaactttttacaactataagaaacctggggccctacctccttggagattctgattcagcaggcctgagggaaggcccgggcatcagttggtttagaaagcctaccatggtacttctgagagtcagttctgggaactgctattttgaggagcatttctcttgtacaagggttctcaagcactgaatttgtattcagtcatttggaggattttaaaagatgctgatgcctggaccccagagattgtgatttagatggttgggagtaagtcatgggcattggaatttaaaagctcccgggtgattctgaagtgcaaccaaggttgagaacctcccctctagggtattcctggaacaagaaaaacacggagtatttgttacaatgcagattcttaggtcttacctcagagctgcctgcacaaactctctgggcaagagacagtatctgcattataaattgatgtcttgaattgttattcttaacaaagtttgagaatcacagctcaagggacattatagcatccctgaatattgcctgactacacctccctcacctgtttatatagcactttacagtgtactttacattgttatctcatggaatctcctgcatatccttatgaaacagctggagtagatgttatctctagttaattggtgaggaattggatattcagggaggttttctctccagtagcacgtgtgggtatataaacataaatcaggcaaatgtgcttctctgaaaggagacaatagcctattggagaagtaagacagaaacaggcattcaggtaggaagaggttgcagtatggttgaaaaatactatgaaaattcagagaaggaggggttagcaggaagtcatttatgagaagggaatttgagaaggctatttggaggaggtggttctggcccattttagagctgtcaaagtctagtttcctttgaggagcttgatagagggcatgtgactatggctttacagctgtgctccaattgtttctctttattaggttttcctcattttatggcccaggctgtgtaacttcctttgtgttatcatcttgtcatatttataataaattctatttttcctttgagattttgctatctgtttaataaaaatgtggtatgtctttgaattttataaataaatgattattttgatgttcctagaataaaaaattacaataaatttttctcccattaggaagataaaccaataatagacatataaactatcgtcttcatttttatagaggtagattttttttagctataactatgtagctaaaaataaacgtttgtacttttatggctatgttattagatcaaggagtatgaagaaagtttcaaggacaatggatttatttctggaacaaaagagacaataaggaataaagctatgactggctgtctgataaagagcccaactctgataggaaaagcccaaaaggcttttctcttttcctgcaacatctgtctcagattattgtatataatacttacttccatatagcatacttttgacttttcttcaaaagtcatatgaagacatggagaacctttataattgataagatttgagaaagttggtttgttagtggtctttactgaaatagataatttttaagtaaaatgcagtttatgattttcaaatgcagtgtatattctaaaacatgtaagtgcaaaaaatacaattatatctgtcccattagttattaaaatttaaaatacacctattctttgacctcccaggtccatgtctagtactctatcctgcatatatactgatagaagtgcgcaggaatatatgaaaggatgtttgttgcaacattatgacagcaaaaaaggagattatctaaatgtccattagtacaggactgtttaaatgaattctggttcacccccgtaatggaatagtatgccatcattggaaaaaatactgtattgatgtagaaggatgccaagcttaccttaagaaaaagaaagtcaagtggctgaacagtgtacacagtataaaactatttgtgaagtgaaaaggatatatggatatatgtgtatgtgtgtatgtatgcatctacttgaatgtacatagactattcttggcatggtacacaaaatgtgtcaaaaatgcttaccatttagaaggcatctacagcttgaatagtatatgtgaagggagtatttttattcttcactatgtaccctttcaattcttagaatttttgcaccacatgtgtattattttaaaataacacataaaataattatttacaaaataaaatattaaatttatatttaataatatagtttatataaattaagaaagccctttaacagcctaactcttggactaaaaaacatttctaggcatgttaaaggaaataaaagcttcattacttcttagtttaaataattattgacttatgattaatagtccctgaaaaatattacagcacaaaaatgaactttcaccattattgctaataattacatataccaccagttgagacctcaagatttgaattgtagtaatgcaaattgagatttttttttttcccctggtgtttatgcctctgctgaagtgtcatggaaacatttaataatgattcaaccatattgagctctttgcttcatttgccacgttaggcttttgtgcagatgcatcctgatcatctgctatttttggcttgactcctatttttttcaaatcagagattagtgaaatattgttttccattattgaatcatctatataactctccccaatataatggaggaatgcttttaaaaaatgaattatttgtcctttttatgatttaatataacatgtttccagagttgcgtttttgaagaaaactgtagtaatttataaaatagtatgctttgacattgacatgtattctcatgactatcaatttccattgttttctagtctgataccataattctcgagaattttttttgtttctacttctctttatttatctttgtttctactatcttcatgtgttactgttcactatgaggctcagacttctaagagaagaaggtctgattcggttagtcactgtccaatataaggaaacacttatagacagagttctgtctttatcaggtcatctgttgactgttgaccttttatgcctggccaacacaaagctagaactttgatctctgatccaatccgatgtatccaggaaatcacgggcatctaagtgataacatcctctcatacactcagaatctgatctgtggactgttcaccagtccaacagcccaacacacattattgtaacttttgttaaatttactcttagccctgatgacaaagtagaatacaacacaacagaataaaagaataaaccagcctaggggaaagtttagatttgccttgcataactcacaggttcgaggttcaacattggggataggacacaggccttgtatccacataaagttttcatccctacttggcaactccccaggtagacaaccataatctcagagattgtggttcctatgtagaagagggataagaatatttctttgtaggattgatatgaagatttagtgtgattgtgtatgtaaattgagtagaacagtaacagacacagtaattataatagcagcaaacacttgttgagtacttcctatgagccaagcattactctaaactctttatgtctattagctcatgtaatcctcataacagccctatgagataattatctccaattgacagatgagaaaatggaggcacgggcagtctctgtaatttgcttaagattacacagctggtaacggaaggcgccaatagctcacattgttaacatctacactacactggtgctccacatgaagtcagtgccccatgttctagtgtctaggacttgtttcagcccccaagactctgtggccttctgggttccattccctgtacaacccagatgtgaagtaccaccctatcttctccattaaatgcaaccgcaaccctcagttcatgatgatcagtggctcccctgggaatttggaggtggtttaaggtccaggattgcattgtgtaccattttacctgctctccaccccctccccaaagctgagagttaccagcttctgtgggattatctcacaaggagcagtagtctcaggctaggctggtttccttggaatttcggtgaagaaaatgtcttcagtctgttacatctccatgtcatcctgttctctctcctccatttgtgaaacactgaacattttaagtagtgtcagtccttaagtcatactgtgaagtaggtaacatttgcgcctttaaaccacccatcctatcggtcctttctgtttcactctttcgtatctcagtgagtcaatttaattagaagctttcagctactgaagaaatagaagattggtgacaggatggaaagaggtcatttagagaagagcttctcgaactttaatgtgcatatgaatcatctagggacttgttaaaatacagattctctacagtaggttgggggtggggcctgagattctgcatttttaacaacctcctagtgatgtcaatgctgcttgtctctgaactgcactctgagtagtaagtatttaaaggtgacatcctaagatggcagaagatttaccttcttacctttccaggcacattgaatccaaataaatgaatctctcttagtagaattttattaatgcaattggatgctaagaaaaacttcacaatttaaaaccccgcccataaactgcttaccagttaaagccattgctggtttcagaaaagaatagtatgaacctgtttatctggtaatcaatataaacactgtaaaaacaagcatttcctccatcaatataatttagtgactctcaaatgatttatattcatttttacttagttttatgtaaaagagtattgctttgctgctgctcatgattgaatttctttttttttttttttttttttttttgagacagggtctctatcgcccaggctggagtacagtggtgccatctcagctcactgcgacctccacttccctggttcaagcgattctcctgcctcagcctcccgagtaactgggattacaggcatgcactaccacatccagctaattttgtatttttagaagagacagggtttcaccatattggctgggctggtttggaactcctgacctcaagggatccacccacctcagtctcccaaagtgctgggattagaggcatgagccactgcacctggcccatggttgaatttcttataactaggaaagcagatgattaaactttggtgcaagggtcacatatgtatttcctttcttttctttttttgtcattttttcttttgagacagaatttcactctttttgtccaggctggagtgcagtagcacaatcacagctcactgcagcctcaaactcctgggttcaaatgatcctcctgccttaacctcccaagaggctaggaatacaggtgcatgccaccacatccagctaatttcaattttttttttttttgtagagacagggtcttgctatgttgcttaggctggtcttgaacttctggccttaagtgatgctcctgcctcgcctctgaaagcattgaaattgtagacatgagacactgtgcctgactccccatgtgtatttcaatatctctttctttgttcctctaatatcacctacataaaagaaaggtcaagtcaacttttatttccctgaattttgatttagagtcagctcactcagagtgtttatgaataattctgttagaaaagatttgataatgctaatctgaataatgaaatatcatgcagagttctagatgtggaggtgcattgtgagtagaaacctcctgtgaaatgaagcagctgattctccttgtgatgcaaagacttacattctttatttctgttttcagggaggagagcactgttactaccagggccatatccgaggaaaccctgactcatttgttgcattgtcaacatgccacggacttcagtaagtgttcaaaaagttatttttactgtttgttttttcaataatttattttctttattatgaatgcactatagtagatatccctattttgtgtcaagaaatgactttaaattggtgatggatctgattttttttttctcttttgtattttataaaccaagcagatttttaaattagggttgcaaatggtcgggcgtggtggctcatgcctataatcccagcactttgggggggtctaggcaggcagatcacctgaggtcaggagttcgagaccagcccagccaacatggtgaaaccctgtctctactaaaaatacaaaaattagccgggcatggtggcaggtacctgtaatcccagctactcgggaggctgaggcaggagaatcacttgaacctgcgaggtgaaggttgcagtgagccaagaccatgccactgcactccagcctgtgggatagagcgagactctgattcaaaaaaaataaagaaagaaagaaagaaagaaaagtcctacattttgcaaaagaaagaaaaaatatatattgtcaagaaaaaagacaagcatactttaaggagatgctagactccatctcaaaaaaattaaataaaattagagctgcagaaaacagaggcttttgaatttcacaatgataccttaaaatgatatttgaagcatttttctagtttcatccaaattcagacaggagtgatttgggttaacttcggtgtctgtttctgtggatgtttagccccttgatattcttccctactccttctttatattagtttttatatttttgtcaaataatagcagtttcagtaaatggaaacgcctgactccttacacaaagagaaaaggctgctagtgatctcaagagctcatatgtctttgcccctttttttcagcctgaatcccacctaattcatagcaaatctgtgggagggtctgtcgtttctcagagatctccgaggaacaaagttcatccttcctcaaggccttgcttcctttctcataaccttctctatcaaataatgtttgctgatgtttaacatgggaatacatccacttcctccatcctgtcgataatgataatgcacaggtggttgtttcttacttgttttgtaaccccttataaagctaccgtgtcattcctcagcattctcttttaactaaatcgtttcatttccttcttgtttgttttactttttggcacagaacaatccagcactttaattttgttaaattttcgttgagaaactttaaaataattcctttttgttaccatcttagagatgtggcttttcatctaacaagcagttactgggtgtctcctgtgtgccagccctaggaatattaaggcgattgaaacacaagtcctgggagctcacagtctcatgaggaggccaaatctagcccatttcctgatgtggaacatgataggtatatttgctttttttttgagagagagagaggaaaaaaaaaaaaacaaaactgggaaaaatgcaagctaagcattgtcaccgaagaacaggtggcacctaagggctctggaaacatgccacctgaagacagtggagtgcaataggttggaatagcctatccaagggagagggttacactgacagatcttaaatctaggaaagagagctaatggacacggccagaaaatctagctagtctgcctgagtgacacctctggtcaggatctgggaataagcatattaggcagaaaggaaagaatataagtgtaagttaaataaccagagacaggaggccatgtgtctgagagcatggaagacttccatttccttgtttgtgctaaaagactactgtgaataaaggtgtacatttatttactttaaatacattatttgaagaaagaggtttttacaaacatggaatccatgcttaatatcagacagtctctgttttcttattaggaaaaagaaacattgaagtccttttcagcagtaaaattgttacatctgagctcaagacaagcacatctgtcacctaggaatagtacagtgagacctgttcacatttgtgacagcaagtgtatattgggggtaaaaaatgaagtgttttttttccccttttctctctcttaaaatctcaatccaaagtcctagtgtcagcatctttctcagtactcgttccagtctgccttctggttttccaaatggactcaatgttgtgagaatcagagagaagatatttgtgccttctaagggctataaatggacctgagaacctaagaatgatacctgttactaatcctactatagtcttgtaaagaaggattgaaaaataacttttaggccgggcacggtggctcacccctgtaatcccaggcatgagccaccatgcccacttttcttttttcttttcttttcttttttttcttttctcttctcttttctttttcttttcttttgttctttcattcattcgttcatttgttcgttcgttcattcattctttcttttgttcattcttttctgtcagagtctcactctgtcccacaggctgaagtgcagtggtatgatctcagctcgctgcagcctccgcctcccaggttcaagccattcttgtgcctcagcctcctgagtagctgggattacaggtggctgccagcatgcccatctaatttttgtattttcagtagagacggggttttgccatgttggccaggttggtctcgaactcctgacctcgtgatccgcccacctcagcctcccaaagtgctgagattacagggttattttaattaagtaaattttatgtctccttttaagaatgtttttatttaaaactaaataaaaataaacagaaaacctatcgtgtgtcttggaacattgtcagaattgtgtatgaccattttaggctttcttagacttttatgagcacataggataaatataaccttgtatcatcttgttgtttagtaattattgcttctcatcttgactttactttctggaagaaatattttggggggatgttatgaaatattgaataatgtatgttgtcccaattacagtggtttagatatgagatatattatgtcatccatgactcatcctttataaattaccaagtgcgtactgtttttttttcatttttgatttattaaattcagttcaataatataaataagggaaaatcagattcgtatatctttcccataaagaacctgcaaggtcacatttgtttggagtcaaaggactaataggcaatgttttgatcttggtgtgtttggtgttaatgcaaaaatcttgttactgtgggaaccttaaagcacggagttaagtttgagtttattgccctcttgtggaaatttgtaagaatggctttttcatttcaaaatcttattttgatacaaccttttgaaattttagctcaattggtctgtgacgacttggtcttagctataggtttttatcaagtatactgttatggactcaatataaaaattaggatttatataagtaaaacaaaaatatttcagttctcaaagcatataaaacacatgtattttttcattattaaggaattaataatggcatattatcatatagcaatctagagtcttctgagatacagatagtgtcagaatctgttgtcttcatattgcctacatgatgtttaagtccaataaaaaaatgactttctcattggacattaacctagtataaggataaataacactcagtactattttaagaaaataatctgcttgctactttgttggtgttgccacgtgaattttggcaaactatgatggtttcatatgactttctggatggatatggctagttctcagcaagggtagagagatactccctgccatatttggtctacgtttttgaaaggctccccctctgactccttgggcacatattgtcagtaatgtcttacaaactgcatctgtttatgtttaaattccaaatagaatgtcatccaaattcagaaagtacatgtggctgaaaacagtgcagctgtgagaataatcattctgtgagtatatagaagttgaggacatgtggaagatgttatagcaggaatgaaagaatttggatagaggcagaacttggaggccattataattatagctcatggaatttcaccaatttcactaaatcttcaatgaaagacaaatactagtttatgtttaggagcttggctgtcacataatcatttctaccaaaaactaaaaaattactacagctcatagctttgctaccctcagatgcctgaatgataagacaagtttctttaacatcataaagggcctgatctcagtaaaaggatcatgttcttctaaaagcagcagctatcagaatctgtctgagtgggagctgaggccatttgtatattgaagtgctctccagaggatttctcagatggctggtagccacccccagcctacgaggtccaaaatggaattttttatttttaaagaaatatagggtcttgctctgtcacccaggctggagtacagtggcacaatcatcaatcactgcagccttgaactcttgggttcaggtgatcctcccacctcagcctcccaagtagctgggactacaggtgtgtgcatcaccaggcccagctaactttttaaaaattttttgtagagagagagtcttgccactcactacgttgcccaggctggtctcaaactcctggcctcatgtgatttccccccgccttggccttccaaagtgttgggattccagatgtgagccccatgcccagctcaaaactgaactcttaaaggatttgcatccttccctctgcttcctgcttccctaggcccatcccgaaaagttctttctgcatcccccctgcctgccctcttttttttttttttttttttttttttgagacagggtctcactccattacctctttttttatcttgttaaatgacatgtccatttttccagttgctcaggtcaaaacttggagtcttcactaactcttctctgttttacgtactttgtttcaaatccatcagtaaatcctactggttgtaccttcaaaatatatctggaatttgaccaattctcaccacctctactattactgctctgatctaagccagcatcttctttcgcctggattattgcagtaacttccctgcttctatccttgctgtgctaaaaattattgtaacatagtatctggcatgatcattataaaacttaagaaagattgtatttcccatctgcttagaactttgcagtggctcttcatctctcttagagtaaaagccaaggccctaggaagtgcccacctagtatggcccccaagaccctctggcaccatttattgcccttcacctgattattttcttccctagaacttatcactgtcatatgtatgtgtatgtgtgtgtgtatatatatatataatatatatattataaataaataaataaatatatatatatatatatatatatatatatatatatagtaagtcctagaatacttatgagcaccacaaggacagagaattggtctgttttgtttgctattgtatccccagcacctagaacagtgcattgtaggtgctctgtaaacacgctgattgaatgaaggaatgcatgaatggaggtaggtagcaggttgcaaatgggcagttcgtggtcccatctgtctgggctctgttcctatttctgctcttactggttaaataatttggcaagttactttatctctttgggtttcagtttccttacttataaaataaggatagtcgttgtacttctcttgtagatttgtggaaaagattaaatgagtgtaaagtatttagcttgtggcaagttgttcaaatgtgttagctcttgttactagagcatcttccatgtttatggtaggtcgggcgttctcagtatagtccctgaaaacctgcatcaggatcacctggagcttatttaaaatgcaatttcctgggttccagtccataaatctgaggagagtcctgaaagagctgcgtttttactagctctccagatgactttttgcatatgaaaatcttggaattctatgttagaggaagaagtgatgggcaacagctagagcatggcaatcctgagcatggggtcaggtgaggatgaggtgactctacctataaggaatcagaaggaggggccttccctctcagtggtgtgtgtggtgtgtctggaggtgatggatgggactgggaaatgggcattgagaagcaaatgggccctctggctgctgctgattttaaaatgatcttgttctgggatgagagtcgatggccatgcctaattatttttttgtcgttggcagtgggatgttctatgacgggaaccacacatatctcattgagccagaagaaaatgacactactcaagtaagtgctccttctgtttgttgtggcaaatggaaatgtttatgctgagagcttttttcctctcctttttttaatttctactttatttcatttttatattttttagggttaagatagtaaacatatgtacagatgctcctcaacttatgatgggtctatgtcctgataaacctatcataagttaaaatattataagtaaaaaacgtatttaataccctgataaatgcatcataaagtcaaaaacatgtatgttggggactgtctgtatattttaaactaaatattgagtaagtcaaaaccacaagtgttttttaaaaaatttcttgccaggtgtggtggctcatgcctgtaatcccagcactattggaggcagaggtgggcatgaggtcaggagttagagaccagcctggccaacttggtgaaaccccgtctctactaaaatacaaaaattagccaggtgtggtggcatgcgcctgtaatcccagctacttgggaagttaaggcagaagtattgcttgaacctcctgccactgcgctccagcctgggtgacagaatgagactccgtctccaaaacaaacaaacaaacaaacaaaaaatttcttttgtttctttctcttttatattggaaatataatactttccctttgaggtgttctgaaatctctatttccatctcaaccctaatgtgttatgatctgtcttagtttgacttggctaccataacaaaatactgtagactgggtggcttaaacaacagaaactttatctcagttctgggcactgaaagtccaaggtgccatcagggttgacatctggtgagggctctttgcttgagttgcagatggctgccttctcactgtgttctcacatggcagagagagagagagagaactctggttgtctccacttgttataagggtaccagctatactgaataaggatctcacccttatgacctcatttaacatttatcacttcctcacaggccttatctccagacaaaattaccctgggtgccagggcctcaatatgagaagtctggggacacacacacattcagtccacaacaaatcaaatccacagagctgtgatttttcacccctcctctcttttctagattccagatttttctctattgtctattgcttttaaggctctatgctgatgaagtttagagaaacctgagtcatcttaatcctgtctctcactttagctgaaacattcatttcccacaaattagaagaagttgaattaatattatagactacacagaaacataatacactttcattctagctctgtacatacaaatgttcttcctcgtattacacaacattgcttaagcagagaggcaaattcttccaagaaacatgcatggctttgtcacccataaaccatcttgtttgggaaattctctgtattgtgtattattttatgggtacccactgctgcctgtcttgtcactttgcttgacagtatgatttttttaagataatatgaaaccggactatgacattctaatttttttttttagtaattggatgaagccagatgaaattatatttgagtgtttattaactttttagaagaaaaatgtgactttttatctcttgctttttcatatagcttgtatgacacttgaatttcagaacagggtccactttggacatttacttataccaggcatcctgctccccaatactatgaagattgttagctctgtagtctgcctaccaaagctctctgacttttaaaagggtgcagggatccgtgaaaggaatcagtaataaaaaaacattaagtcattttgccaaatgtcttatttgtccttgggggaatagattcattcatttgttttccattactgtaggctttggcttctctgtgaaggcatttttcttctcattggatgttgctctggtgctgagagaatacaggagtgaataggaggggttgggcaatggttcatcacctctctaaacccaggagaatgcataggcaagctgtggttcttttaagggtctccagctatgtttgcctaaggctggagataatcctgttgtacatgcttaatcactgttgcttgtgtcatttcaggaggatttccattttcattcagtttacaaatccagactgtttgaattttccttggatgatcttccatctggtatgatgttcatatagtgactttttatctaaaagacaacttcagtaatttatttaatgccttagaactaatctatatttggaatatcattagcccacatctgcttttgacatttttagagggagagccaagtcacgtcaagagggagaataaaatgcaaactgtcctcacagatgagtttggaaagatgtggaggaaaactttaaaacattttaaaattaaaaataaggcactaaaggagaaacaagattagagcaagaattggtctgtgagacaaagtacatacaaattcactctttgtgaaatactggtcttgtaaacatagggatgaactcttaatcatttccctatttattgttttccttgtctcttttttgctctagcattttaagaaagaactattatgggttaacttttattatcattatgtgttatttgtgaaattagtcatttcttctcatctatacctaaatggatctaggttaattttaagagtgtttgtctcccaagattacttatgatttactataataagttagaagaaaacaagaaatagacaaatgtcaaaaatacaaatttagtgaaatattttcaaaagtaagctaatttattttaggttgaataaatggacctagcaacctatgttgctttgagagtcgcttccaagtcttcacatgacaggaagggcagtgcatgcatactttgccctccttagtggagcagtgattatgcagggtgagttagcgtttgtctttggctgtgctggactcatttgttttcttctgaagacagacagcacactgaatatctttattcagaagatatctggatatctggtatggagatgcttcctccactatttagtgagccttattttaattttttttttttttttttgagacaaagtcttgctctatcgcccaggctggaatgcagtgacgcgacctcagctcactgcaacctccgcctcctgggttcaggcaattcttctgcctcagcctcccaagtagctgggaccacaggcacacaccattacgcctggctaatttttgtatttttagtagagacaggggtttcgccatattgggtaggctggtctcgaactcctgaccttgtgatccacctgcctcggcctcccaaagtgctgggtttacaggcgtgagccactgtgcccggcctgattattttaatttttaatctcgttttaatctttgcagcagccctgtaagattaatgttattcccggtttgtagatgaagaaacagagctcagctagtttgtcttttccagggtcccacagctagcaaggggtaaagttgagttttgaattatgacactatggtagagaagcacagagggaaacggagtaatcctaaactaatgcttagataatcacttagaagtttacattgtctcttcatcagaaaataaatgtttcctaatgttcctttctctctaaatgaagtttgtaactccttgtcctcctgtaattttcctaaagagaaatgaacattctctccccttctctcctgctgccagagggatagaagatttaatagaatttactattttgaaaaatcttcaaatgggaatatagatgctcttacctctcacagactttttagactgttctttcagtgatcttataaaactttttaaaatccctattctgataagaaaataagtcatgactagctgtgtgggaataaagctataatttaatgggtattactgggagcagtcaacattaattaatatttaaagtaataaataaagatttttccctaaagacttgactgtaggcttgctaggatataaccttatatatatatatatatctatctatatatatatatcttttttttttttgagaaaatcattcagggtttctttccagcagaaactttgatggtgacttggcagttttgctgttattaaaatgatttttagacacattctttaaaaactcaggtctgtttcaatcagtttctagttttcttttctcatcagaagttggcactgtcaattttgagagagtttgtctcccaacattacttatgatttactgtgataaatgagaagaaaacaagaaatggacaaataaatgtcaaaactgcaatttctgtgaaacagtttcaaaagtaagtttaattattatagattacataaagtttaactgggttgtagattatcaacatcatcatcttgttatgttttatatatttcccagcgatagacataggatcagctgttccccaaacttgctggactgtggaacatttgctttacatggcatgtacctgtctcaggactagtgtttctgagaacatattctgggaaaatcttatttcctgtggacacttatgcacccagttaaaaaaatatgcaatgaaatataaaagtcttgtgtaccattcaatgactttttacatacctacactcttgttgagagatagagcatgtccattaccccaataacttcctttgtaccctttgtagtcagtgcctcccacctctgccattccttttgtctgttgtagaactttatacagatggaatcatgtactatgtgcagcttcttttgtttagcacatgcctgtgaggtttatgttgtcaagagtagcaatagttcattcttttaaattattgaatatgttgtgtcctatgaatataccacttttttcaggggtgggggatggggtcttgctgtgttgcccaggctggagtgcaatagtgcgatctcggctcactgcagcctctgccccctgggttcaagcagttctcctgcctcaggctcccgagtagctgggactacaggcatgcactatcatgcctggctaatttttgtatttttagtagagacagggtttcaccatgttggtcaggctggtctcaaattcctgacctcaagtgatccacccgccttggcctcccagagtgctgggattactggcatgagccactgcgcccggcctataacacaatttttaacttattaagttgatggacatttaggttgtttccggtttttgactattatgagaaaagcaactatgcacgttattgtacaagtcttttctgtgagcacatattttcatttcttccagtaaatacctaggaataaaattgctgggccatagggtaggtacatgtttaactatgttgacagtgtcctcaaaccttagcatgcatcagaatcatctggaggactggtaaccacagattgctggccccatcttgagagttttaattcagtatatcttgggtgggattggagaatttgtatttccagtgcttcccaggtgatgctaatgctgctggtgctggaatcacactttgagaaccactgtttttttttaatatatatatattttttattatactttaagttctagggtacatgtgtacaacgtgcaggtttgttacatatgtatacatgtgccatgttggtgtgctgcacccattaactggtcatttacattagttatatctcctaatgctatccctccccccttcccccaccccacaacaggccctggtgtgtgatgttccccttcctgtgtccaagtgagaaccactgttttatgagaaattgctgaaccctttttccaaagtgggtacactcttttatatttgtgtcagcactctatgagagttttaattgttccacatcttgaccaacatttgctctgtcattctttaattttagctattctagtgtatgtggtggtatctcactttggttgaaatttgcatttttcttgtgattaatgatgtgtagtatatacttactcgccactaatcagaatttctgtcttttttgttgttaagttgtaggagtacttacatattctagatagaaggcctttgccaaatatgccttatgaatatatttttcccagtctttggcttgctcatttacttaatggcatcttatgatgaacagatgttttaaatttcatgaagtttaacattagtttttatcattattgctttctctatgctaagtaatttttgctagctcccaagttttgaagatattctctagtgttttcttctaaaaactctatagttttattttttatgtttagatctaggatcctcttcaaattactttttgtgcatggtgaaaagtaggggttaagttttattttattattttgtatgtggatacacaattattttaataccatttgttgaaaacagtttcctttcatcaatgaattgttttgatgtctttgttaaaaagtattaaaagtatgaatatgagtctatttcttgactcttattttatttggctacccttatcacactttgttttgcttactgtggctttatataagttttgaaatcaaataacgtaaatcctccaattctgttttttccaaaaatttttggctattctgggcccttcacatttccctacagattttagaacctgcttgtcaatttctataattctgggatttttattagaattgtattaaaagtatgggttaatgggggaaaacagcatattattagtagtgagactaaaatttctttcagtgtttggtcatttttagtgtagatattgtattatctattgctgtataagaaattactctaaaacttagtggctttaataaacaaatatttattacctcataatttctgagaatcaggaacctgggtgtggtttagctgggtgcctgtggcccacggtgtcatgagtttgtagcgtaactgtcagctgggactacagtttcatttgaaggctcaactgggaaggattagcttctgagctcactcacataattgttgtcaggcctcagtacctcaccacatgggcctctccacagggctgccccccaccaacctggtagctaacttgttccaggagatagtgagagaccaagagaagagagaatgagacagtatgcctaagacggaagccacagtctttttgttaacctgatctcaaaagtaacatctgatcacttttgctgtatagtatttattagaaatgagtcacagagtccagccttctctcaagggaatgagattatacagtgtcattgtattagttatctattgctgaggaattcatttttattatgtacagaaaaattagaaagtagctgagtaataaattaccacaaaatgcacctcttaagacaatacacacttattatctcacagtttctgtggatcaggagtccaaggatggcttagatgggttctctgtttcagagtcccttacaggctgcagtcaaggtgttttctaggactgcatctcatctcaaggctcaactgtggaaggatatgcagttgtcgttggcagaattcagttcttcttagcctcttagaccaagggccttggtttcttgctggcttttggctgatggttgctctctttctcacataggcctctccatagggaagctcacaacactagtgctcatgtaatgaaagccagtaaggaagagagtctctagcaagatgagttacaatcttgtatgatgttatcttgagaaatgacagttcatcacctttgctgtattccattggttggaagcaagttacaggttttactcacactcagagagagggcattacaaaagggcgtgagtaccaggaggtggagactattagaggtcatcttaaagtctgtcaaattcttctctttggcccccagtaattcctgtcccttttacctgcaaaatacattctcttcctccctaggtctctaagcatttcatcccgttatagcatctgctcaaagtctggaatctcattatctaaatcagatccaggtgtggatgagggtttttgggtgtaatttctcttagtccttctgtgtgtaaaactaaagagacaagttatctgccctatgtagtcccaggatccagtaatgggccagctatagacattcccttacaaaagagggaaaattcgagaaacaagaaagacactgacattgcagttctgaaattctgctgggcaaatgttgaccctttcttgactgggtttcaaggcctagaaataattctccatgactcttggctctgtgttctcaactcttaattctgctcatccttccttttccatgaaaggtagcacatatttgcagctgagtagttttatcagtctgctattctagtttgctaagagtttttatcaagaataggtgttgaattttgtcaaatgcttttctatgtctattacgggatcatataattttctcctttaatctgttaatgtgatgaattgtataaattgatgttttgaatatgaaactaatttgcattcttaaatgggccccaattggttatggtagattatatttgtgtgtattactgggtttgatttgcctatgttttgttaagcatttgtaaaatataggttcagaaagcatattggactgtagttttcttttctggttttagtaccagggttttactggtcttataagatgtgttaggaaaagtttccaaactcttttttttttctaagttggtgtaaaagtggtattatttcttccttaaatctttggtagaattcatcagtgaagccatctggccttgtggttttcttggaaagtttaattaagaattaaagttatttaatagatacaggattattcagattttctatatatacacacgttcaaggaatttcatctaaattaacaaatttattggcataaagctcttcataatatcctcgtattatctttttagtatctatagaatctgtagtgatttgctttctttattggtcaagccctgctgatcaattttattgatttttgtgtttaagttttgagtctcacttttttctatttgatttgtgtttagtttgctcttatttttctgggctcttaaggtggaagattagatcataatttaaacttttttttttcttttctaacataaccacttaaagctatgcatttcccttcaagcactaaatgccttacctgcatcccttgtattttgccttgtcatatttttatttactttaggtcaaaacattttctaaattaccatgtgatttcttctttgtcccatggattatttagaaatgtagagctcagtatcgaaatacttggttatttttttccaagcacctttttattatagattttttaatttaatagaattgcaataagagaaaatactctgtgtcatttcattttctttaaataaaatttattgggacttgttttatgatctatcataatgtctgtcttggtgaatgtttcatgtattcttgaaaaggatatgtattcttcaattattgggtaaagtgttaaaaatgccaacttagttaaattggttgatagtgttaagtcttctatatccatatgattctgtttactttttttttctttcaattactgagggaggattgttgaaatccttaactataactttgaatttgtctatttctcctttcaggtctgtcactttttacttcatgtattttaaaactctgttattaggtgaataaacatttaggagcattgtgtctttttgatgaatcatcccatttataattaggaaatagtttcctttctctcagatacttattgtcctgaagttacattgtctgatattaatatttccttcacagttctcttgtgattaatgtttgtaaggtgtatcttcttccatactttaaatttaaagtgcccctcttctaaacagcatgcagttaagtcttgcattaaaaaaaaaaaatccagtctggcaatctttgccttttaggcacaacatttagtctatttgcatttaatgtaattattgatatgagatgggttacttttgtaatcttgtttttctgtttgtcctattagttaattataaaggagaacttattccctttctcaacaaatcccttgtatgcccaggccatagcattctgaaaaatgacatgatgggagaatatttgaacatgaaataaagagagaacactaatttccttacccgattttattattcagcttcttggtcacaaatttctctgaccatgcttatttctcctttatgaacagtatccaaaaataatggtaatggttcaccttgagtgttttatagtattatttgtataataagccccttcaggttgctcaaccatcaaagtcttaggaaatctgtaccctgtggaaagattgcagctttcctttcactttgtagaaaaatcctcccttataaataacctaatcttatatttggagatgaatctatacgcataaacagttgatgtataattttcacatctgctaccaagagcagataaatcctgagatcaatttggttatgggcaaagaagaatataaattaattggaaaaaattagctcaaaactttggtgtcctataacaatttcttaataaattatgaacttgggaatgtgtgattatttattctacttctcattgctcctcttctttattttgctgcctctagaaggttagtaatggaggtgaaagtcaagttggctttttggaagatttccagtaaataaagtaatgatatttataagagaaatatgaaaaattttccagataaattagaacagaaataatgttctagattttgcaaattatattcatcctttatatgtttatttagtattaatatactacagttacttaatggtttgtgtgatcgttaagtgcaacattatgtattataaaattcataagaaggaagggcaggtaaaactttgccctgtattgaagaaatctgacaaatgcactaagttaaattaaatttaatttccttttagaatttcagcaagtaaacattactccatcaaaatttattttgaagccaagaccaaaaaggagtaaacggcaggtatgtattcacagtggtgtgtcgtgttattttaaaacaattgtcaactgccagtcatttgaatctacagtaagtctgtgtgagagggtgagtattagtttgggaatttgtcagggtgtgataaaccgtaagggtgatggatctgaagaagcagtagaaagggggccatgttgtttcacagatgcaaaaaggattcaagatagtggtgataatatgtttcttcatcatattatgggttatgaggctcctgcttgtggcaccttgggttctttctaccataggcttctttccttgcccagatatgtaccacatcgtggaatccacttgtatggtttatatccttgtatttattccctggaagataaccccttaggaatgaatcaatcaggttgtgaagccacagaatgcttttgtctcacttgggcaaaactttggagtccaggatataaaattaggtcatggactttatgattgtttgactggatcttggactagggaataataactgttgatatgacgctttaaaccaaatgaagtcggtactattattcccctttcactgaaagaaaaatgatgactctgtgacatgtgaaaatgacttactcgaatcatagagctggtaaacagtttagacaaaattaagagttgtggccatcagaatcaagatatcaccactgtggtggtgtgggcaggagagatggttattaaaaacacaagatgaagggaatagatctctagtaagatcaagaagttgaaggaaccaggtatcttctttttattaccttgaaataaaatatatgtttacagacagatttttattgtgaataattattgctaaattttattgaatacttaccttgtacctggccctattataagaattttaactatattaacacatttaaccctcaaaaaccttaagaggaaggtattatcacaggttaagtatcccttttccaaaatgcttgggaccggaagttttgcacattttgatttattttttggcagggggaggatttcagaatatttacattatacttagtgttttagcatccctaattcaaaaattagaaatctgaaatgctccagtgagcatttcttttgagtgtcctattggtgctcaaaaagtttttcattctggagcatttgggattttggattttcagatgagagatacttaacctataatatcctcattttactgataaggacattgagcataagaggatcaagaaactttcccaaagccacatagggtgactctgtggtagagctgggattctgacctaggaagcctggtctcagagaggtgcttataaccgcatatacgccatatattgcctctcagacccatgtgttccatgaattactactgtgacctttataagtgttgtgaatgtttatatatatatactcatatataaacatatgtgtgtgtatatatatatatatgaataggtaaagacatacgtatcttgaggcccagttagataaaataattaccatcaggatttaatgtgaaacagtatttttttgaattatggactgaaagaataggacaatattcttttgacatgtaccctgaagttcctcataaacatctcagcatctaatcatttgctaagtagacaaaaccttgatttctctttctgagaaagccatggacccatagaggtgaagtactataaaactgtgtggctaatatggcaactctttgacattaacaaaatgttgggatttgttgaaaaatttgctgtattaactagtctctcacaagtagcaaagcagctcctgttgccctaaaaacacccccctcccttaaaaaagaaaagaagactctcatcattggatgcactttagtgttattctttggtttccaacctcagaattgtatctattattccctatcaccttggtgttataatagttttttttttttaagtttttaagtttaggattgcagttagcaatgacaaaatccatgtgggagcatttttaaagttggttttaactgcaacactcaaaacaaacatatatgtattgatttaagtttgattgtatacccttatcgcaaaaatggaccttgggcaagtgagcaaaacgttttctggaaaagtttatattgaactatggcataaaggaaaaagctagctttacaaaccttgttaatgattatattataggctaactgtagagaacaaagagaatagctgccttagtggcttttccttagtggcttttccctgtaactttcattggtcattatttcgaaagagaagaaaacttgttggtgagcagagaaagctagctgtaatagataactcaagactgcctgggagttctcaaagctattctaacaaagaccccatgtcatttggggatcccctgaaacgtcctagatgaaggcacatgactcactcccagtttggagattaaataataaaagtgccaatcactccagtccctgtaccctctcggagatcctcagaggacctgaaattaaacccaaaagaatgctcttcatatgttactattttcaagatagactgttaaatgaaaatcgctggaggcagaaaggagtgaaataaacggaagtacaaaataaaggacatattcacatttagttttatgtgcagaagtatttttggaaggaaccagtaacttgctatatccattgtgggggaaggactaggaactgagtaggtggagaatagaggtgagaggaagacattcatcttctgcccttttatactttttaaattttctgagtcatgtaaatttattaccaactcagaaactaagcaaattgatgaaaaattttttaaatgctgaaggaataaaaagggaaaattttgttttgtcagtttcttccatattttttagcttttcgcagccaagtttagagggctgaattaggtgctgtttcctttcctgtgttacagcttcgtcgatatcctcgtaatgtagaagaagaaaccaaatacattgaactgatgattgtgaatgatcaccttatggtaggatttgctgttgtttttaagcctgtttgtgcctagggtaaaactggtgagtgcaaaaatatgtttagaaaaaacaagaagcccatcaagttgtaacctggagaaggtatttgtataatcaaatatatttgttaactagcaacaacctgcaattaggaaatattcataggtggaaataactagcagtaacttttgagttttcaaaaatactttgtgactcatagtatcaacttttgagtttgcttgattagtagaggtactaatatttgaatctccacttaataaaatgacaaggtttaaaaaaatggaaattccattatatattgaaaaagtgaggcaccaattatgagacattttagttcgcggggtacacctttatcttaataaaagaaaagcagcttttctattttggtcttactgtgcagaaatcatatggaaatgcttacatagctaaccatttagcttaggatgaagtttcttaggataagaacttgacaaaactttcatgttgttgaatcaaattattttgacccatagtgtttatattcagttaatgggcatattgcaggcagtatgactacattcatagcacagcaatgagttataatgctaattgttctatgtaaccaaagttttaaactaaaaatgtttaatgatgcatattgctgaattttacttaagttcaggtacaagtgcattttaatttactttgaactacttatttgaggaaaaaatgatcatttatttatgtatgattaaatacataatttagatcttaattattacagttgctaataataataataacaacacaatcaggattgagtgctgcttccttgttcaagctaggtctaagttttatctttccacctatttgaatccagtgaatgtttctgttccctaggatttttataaaataagttataacaacatatattttgaacattttagatcgtcacaaattcagatatccatagacatcagtagacatataacgtaagtgaaattaaccagatataagacagtattaggtgggtaaggcctgtggtgaaatgaatggtgcatggcctgtctaaggggagcaactgcctctcagtgtttgccagttattaccaggtgagaatgctaattttaactgaagccagaaattggattttacatgatatttcctgatttttaaaacacgattgagaccaaccaaagatatatgtgatccacatctgccctgtatgccacctcgttgtgacctttatcttagaggtttcttcttgctgaataagtcttgcagaacttttaaatttgtttgcttttagcagtgttcacatccactttactgtctatacccctacttagatttgtatgtcttgcaattcatagacaactttcatatgttttatcattttgaataacaatcccaataaaaataaacttatgaaatggatggattgggtattttttacttcatctcccagatgaataaattgaggcctcaatcctttaagagacttgtctcaggcaacacagcagataaagaacttgatctcagctctgactctgacattgttttacagacaacacatttttacagaaaagattttttttttttttacatttttagggatctttcaattgcaccatgttttctctgatgagatgattgttttctgatcactttgcaagaccttcacttgttttcttttgctttcagtttaaaaaacatcggctttccgttgtacataccaatacctatgcgaaatctgtggtgaacatggcagatttagtaagtatcaaccccgttcattattgccctagaagattcttatttcctaattgctaatagaatggataatatgattcttatagttttactgctctatgttgcacttcagccaaggtgtctagtaagttccgggtgaccttgcaatagactttattgactttgatgtctggctgggaagaggaactggtcgaagttatccatagatatgcttgaaattccatcctatgtttttcacactgtaaaaacaaaggttgtgtcatacccctaacaaaggtattcacagtgacttataacgatggagaaacagtacaatagttgtgcctttaagagtgcctggtgctgtggcagtgatggaactaaataattccactatacctccatacttcccaaatcttcccttgatgaggctgcgctagtaccttcttcacaagtctaatcagagccagtcagcttgtatagaaattatttctttggagagtcttcattgctccatttttggctaggggaactcaagcatgcatgaattctttttccaggataccagaaaacagattcaggtggaaccttgaatagggtgcaggtatttgtcaaaaagggatcttttgtttccaaaaagtgctctgttctttgggtattggtcaacaatttcattctctgttactcaagggaaatgcatgtaaattagaaagttatctccctttaactaaaactcaaagaagtttccatgaaaggagttttgtagtcctgttcataaactatttgattttaccacatgtacagctgatgtgttcattttattaatatactagatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgtacgtaacttctgtaatgatgtattactttttttgattccatgttaaatgctttattgtgactgaaatgtatcctttctgctacataacacaattaggatttgacatggcagatggcagatagatttggaaaaagttttcaagtatagattgcttaaaattgccatgaaaatgtaaaagttttaattttgagttattttattatttaatgtttaatttttcaagatatttaaatagagcatttactgagtaaaaatactgctaatactcatatatagtattcttaactacagataaattatattctttaaagttactgtcttttaaatgttaatgttttctctgtttttggttctaagatgagagcttagtatttctggaatttatttttaattttttctcactcttatgttctttttttgatagcatgcatatttgacgtaatagcaaattatatatagtagaattttaaaaatctatcatctaaagtcagagctgttgaagaaagttataaaaggaagaaaagatgtattttggggtaactttatatataattccaaatttagagaaaagttgcaagaatactacaaggaaattgcatatgccctctattcagattcatcaattattcacattttccccatttgtttcataattttcttccattctccctcccttccttccattcatccatccttcagttttttttttgtttttttttgttttttttcctgaacctcttgaaagtaagttgaagacacttactggggatttattattaaatagtatatattctctaagagtaaaaagacattctcttatataaccacagtaaattattaaaaccagaaaatttaacacaaacataatacttttatgtaacccatggtctatattcaaatttcaccaattacctcaataatgtcttttaaagctaattttccccatccaaatccaatccaggatcacacattgcatttaatcatcatgtctctttagtctcctttaatctgaaagatttcctcagctttcctttgtctattttgagtttaatacttttgaagagtataggccaattattttattgactgttcctcattatgggaatgcctgatgttaagatatgtatttttggcagaaataccagagaagtgattttgtgtctgtctcagagtacatcatatcaaccaattattttttaatagatatacttcaatttaagatatttattaatcttgcaagaaaacatccctcataaacctttttctttggttacatgtataaacaattttcacattcttcccttgcaatgtgaatatattgtatagaaatcttatgtatagagaaaataaatgtagtaaactaataatgaggggtgctatgatgtttgaactgtgaacagtaagcatttttcatttccttttctaaaaggggaagtcaatttgagagtagccggagcggggcagcttatattggtgggatttgctcgttgctgaaaggaggaggcgtgaatgaagtaggtgtgaacatctgtacaatacaaagtggtatgatggctgaaaatgttttcctcatacttaagagataatttctcagtattcacatactccagatgttagattgctatattacaaatcagtatggtggcctggcacaatggcttatttctgtaattccagcactttgggaggctgaggtggacaaattgcttgagatgaggagtttgagacaagcctgggtaacatggcaaaatcctgtctttatcaaaaatacaaaaataggctgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttggggataagaaaaatagagtaggttttccaaagggtttcttttactcctaaggcactaaacctactagagatgatcaaaaagaaaatacttgcatttttaagaggctgcaaattgaaaaagatatcctcagttcttcttaagtttctattggccgaagatcatcactacctcctgttactcatttcatttgttttctgaagctacattctattccacttgaggggaatttcaggattacaactggatacaaagatgaacaagttctaaaaaaatttacagatttaattttattttgtattatccaaaagacggatttaattatataccaatattgaatttttcaagaatgtcactggtgaaatttggactcagatatacatttccaaaacccaaaagctgtgattatttcctgacttctagtattccctgtaagacctaatcaaacatggatttttgtttcttactactttttcccaaatgcatattcagtgctggctacagtgtgttcagcctcttctaaagaaattgcttagaaattacttattttcagcgatattgtgacatttttctctggttctttgtcagtgacaatttggatttacatatattttatttttgtttttgtttttcagtttgggaaaactgatttaatggctgttacacttgcccagtcattagcccataatattggtattatctcagacaaaagaaagttagcaagtggtaagttttagtacatgtgtggttagttgtatttaaaatagactatttgtgaaatattttggagagtaaaattttttgatttagttgcttgatgaaaggaatttgaacgatagtaaaagataaacatccagcgcacaaactgttgttttccaaagtaatacaaagaaatatttacattataggtggaaatttctatgactataataaactttaaagccgtgtgataataaattcaagctgaatttaaccttataagggacaaaattagcccagtttgttcatcattaatggtttagtagagaattctaggcatataggtttcagacgtactggtttttttatgttttatttaaaacatctctgaacatggccacagaggtagagtttccctgtcaggatcagacctgataaaaagcttagttaatatatggacctagtaaaatatgctaggtttggtatctatgaagaatgtcttttctcaagtaggtaaagtcactttaccctgaatggtcaaatactatgtatttaccttaaaaatttgattatttccatttttatttcagtaacaaacatcataaatattatttttataatctggaatcccagcactttgggaggctgaggcaggcgggtggatcacctgaggtcaggtgttcgagaccagctttgccaacatggtgaaaccctgtctatactagaaatagaaaaattagccgggtgtggtggcaggctcttatagtaccagctactcgggaggctgaggcaggagaatcacttgaacccaggaggcggaggttgcggtgagccaagatcacaccattgcacttcagcctgggccacagagcgagactccatctcaaaaaaaaaaaaaaaaaaaaaaaaaagctattaccatgtatagagtacctattatatgccagatgattgagtgccagtattacttccatttagatactcatttaattctccaggtaattctacaggacacccatttttagccccattttacagatgaagtgactagctcttacaagtataatgtctctaagattacacatatatcaaatggcaaactcaggttttgaaccctagtatttctgattctgaaacccttctgcctaaccaataatatattacactgccttctaccagaaaccttggtgtgtgcagagactttcaaaaatggtcaagaaattataatagttctcataaaggcctgtgaaactgagatcctgtaatagtgccataaagttcttcattcttccattggtatttgattgtctttcatttaagccattttaaataaatggtttaaatatggccatttgttaaaatacaagggtttttttggggcaaaaattatataatcttgatagggtcaaagtatatttttgttgcatattacataaaaaaactattgtaagatgaattagaaagaagttactactttttaaaaggcattttaaggaataaagtggagataattattttaaaacagaaactactttaatgcaactgtgttcactttataacaaggcatgtgtattaattttctcttaggtgaatgtaaatgcgaggacacgtggtccgggtgcataatgggagacactgggtgagccacttgtatttgaaaataactcagtcttacattccctgctgtgctgttgtcttcttaggaatatgacactcaataacttagtgcatggaatctagcacttataaaatatttttgcaaaataacctcttatttataaaaacaattgatgtcaattaagttggtagacctcaaagatttttttttctttagccttacatctaggctataaacgtaagaaatgagggacaactttgtttttggtggcttacctgctaattccctttccttttatttccttcaattctaattaaatggtttataaacagtagtgtgctggtaagttaactcttgaaaacaaaaattagaaaacagcctggatttgtagctttctcacatttctgaggtgtaaatagtcccacaatggctgacttcaagccattactgatggcttcataatgtggtattactgaaaagggagttgggaagagaaatgtacaatctgctctcccgagaaaggttttcatttttatactgtcctccctttcacacgctcagtcatcaatgcttgtcttttattcttgtaaataaattttacagttattccttttattccaagcttatcattactgccctagtttaaactttgaccatcttttgctgttattattttaataacatttcaaatactgagtataaattcggttcagtgtttgggtgatgggcgcaccaaaatctcacaaaacgccactaaagaacttactcttgtaaccaaataccacctgttcccccaaaatctttggaaataaaaaaatttggaatgttattaaaataataacagcaaaagatggtaaaagtttaaactaggacaataatgataagcttggaatcatcatcattaaaaatgtatgaagaatagaacagtggatacttatacacccattatccagcttttaaaaagtaaaatactgcatttgtggttaaatctcccttctgtcctccattattaattcccagccccagccaaggtaaccaccatctaagtttggttcctatcattctcaagtcattctttatacttttactgtatagtatgtatgtgtgttggagtaaaacatagcatttggtttgcatgttttcagtttatgtgaaatacatcatgctgtatgtattcttctgtgacttgctgttttttatcaatatgtttgtgagatttatccatcctgttaatatacaattcttgttcattaaatgccattctcctgctgagaaattgtgtgagtctctgatgtctaaagaatgtggttcataatcttaacttcattatttagatgcccataatctttcttcattttcatttgcaatctccttttcccctactattcatgattggtttgcttaccataatagtacaggagtttctagttttttcaatttgctaaccataatactacatagattttcagcttcttaaatacttgctcaccataattgtacattaattaccaacttcatttgatttcctcaatatattctatttatctggaatgcctttcccttttttctctatctaaccagatttctaaccatctgagatttgttgtaattttaacccctgcattagaatttaatcatgtgtacttatgcttcctttcacaaattagttataaatttttgagggattacttattatactaacacatatttcagacctcacatcataatcctttgtacaaacttgattttcaacaaatatttcttgattgtgtttgaattttgaactcgcaggatatgtataacgaggaaaataaatgatagaggaaatatatatgcaaacatctgtttaaaatatttttccagccaggcatggtggctcatggctgtaatcccatcactttgagaggctgaggcaggcagatcacttgagcccaagagtttgagaccaacctgagcaacatggtgaaactacatctctacaaaaaatacaaaaattaaccagtcgtggtggcacacacctgtagtcccagctacttgggaggctgaggtgggaggatcgcctgattccagggaggttgaggctgcggtgagccatgattgtgccactgaatgccagcatgggtgacagagtgagatcctgtctcaaataataataaagtaaaatatttctccaaaaatctttggactttttgtttagtaatgacaggaaatgataaaagttctatagttgcagtttcaacaattacgaaatttcatactagagattcttgtcttttaaatcctacatagtatatttgattatcctgattattaaaatgtttaatagataatctgcatagcactaagcataatatacagtgaagtcaaatggctaccttcagatacgtacagctgtgtacattggaattcttcttaaagagatgcaagcaagagaaaagccgtttgtataaaactatgggatatgacgctataatttgattgcaccaaatatcaccaaacagcagtaattatggacatttgttcccatgggtacgttccctaccatttctactttctgaagttctgtacagctaaatattagaaagcagggttgaaatgaataccttcagtcctatttaaaggtatgaaaattaaaatttgaagaatgcactgaatacaatagctatattattctgtgaaacagaagttgtggggacagaggcaggagagagacatgatatctgccttcagataattgaaggggctatgttaaggcagaggaataagactttacatagttaagaatacagaactgttcagaagttagaggtcagatgtggcaaaataaaggtaagaacaatccacaaatgttcaactgttcatatattttaaaagcttccctgttggggagtttactgtcactgccaagggttggagaacagactgagcttcctcccagctctgcagtgggcaggagggtgggcttggctgtgacccctgagggtgcttttacagagaggcctctttgtaggaggcttaactagactttgacttctaagagtcctacactaagagttagtgactttttactttggcagtatggatccaactcaggttttgaccagtaggataaagagggactttggggctgggcatggtggctcacgcctgtaatcccagcactttgggaggccgaggtgggtggatcctctgaggtcaggagttcgagaccagcctggccaacatggcgaaaccccgtctctactaaaagtacaaaaattagctggatatgatggcaggcgcctctaatcccagctactaaggaggctgaggcaggaaaattgcttgaacccaggaggcagaggttgcaatgagccaagatcatgccactgcactccagcctgggtgacaagagtgagactccatctcaataaataaataaataaataaataaataaataaataaataaaaggaggggctttgaaaaaagacctatttaaatttgataactctggcagagatatgttggatagattagaggaaaaggtgataaaaacattggctggagtaaaagcattgcaaggaaaaaaggaagtaatattgttaccatgaaacagatggcttggttggtcacttactgggtatcaacttaattatcataaccaaggaagattaaatgaaagggattttattacttttaacaagcaagtagaataccatggatagttcccaaagcagtgtatccctgagctggaggctgtgtcaggttttataagcatagggtaatgaggtgtgatctgattggatcttgcaatgaggtggtgctgggaggcatgatcggactggatgccagagctcaatctgattggatactggatcctgtcattcagtgtatattagtttgtttttcattgttataaatgaaaacctgagattgggtaatttataaagaaaagaggcttacttggctcacagttctgcaggctgtacaagcatggcaccagcatctgcttggcttctggtgagatctcaggaagcttttactcatggtagaaggcaaggggaagcaggtgtgtcacatggcaagagagggagcaggggagaagggagggggtgctaggctctttttaacaaccgaatctcgtgtaaacttattaccagccatttcctcttggagggcactaagccattcttgggaggactccctcattagaccccactctcaacattggggtcatattttaacatgagattttgaggggacaaacatccaaactttatcatcgtgtctgctgcttgattcagtccctgcttctcagctgagcacttaggttcctcctgtggttgcaccattggttcatctgagcatggtcaggctatgtgacctaagggtccacggcaactgaaaaacaattcataacattattacataaaagttgaaccagattggtctgatgcagccacaatgtgtgtaagaaactttcaaatgaagaataaagtttgtcttgtcagaatttgttacttgaaaaaaacctggttcctttgcctggcaagaacaaacaactcttcacaggaatgcaagttttggctggcccagtggctcatgcctataatcccagaactttgggaggatcgcttgagcccaggagttcgagaccagcctgggcaacgtggggaaactttgtacaaacttaaaaattagctgggcatggtggcacatgcctgtagtcccagctactcgggaggctgaggtgggagaatcacttgaccccaggaggtccaggctgcagtgagtggagatcacaccactgcactccagcctgggcaacagagtgagacccctgcctgaaaaaagaaaatgcaggttttgatcagtgagagttttattactagtcacaagtaaagagagctctgagagtattcactagacgagtgtcttcctgagggaaagcaacaggagggttttatggggaggtggaggggggagagggtgtgtcattgcatgcagaggaggggtcccagtggtgcagatgcagtgaatcattatgccagcacataggtttcaagttatagtaatgaagctatggttcctcccgtggtggagactttagcatggtaatgaggaaagtttacttgggttcatttataaattgtcagtgtttgtcgggagctggttccagctgactaggtgaccacattccacacaaagtgtgggaaagagcaggctgcaaggcaggaggctgtaaaacaggctgattgctcaagttgattaaattcctgtagtatctggaaaccctccttgtctgcttagaggaagtggaggtgaaggaagtaaaggagttcagacaacttaaacccaagacagctttatttggagagtttggcatgaagccctttaaaaatgagtttagggtaaataatcattataaattccattaattaataacaaagtattaactactgtgtttagaagaagtagggatataaatggacagtttttgcaggctactgggaaactttataaaaactactcattcttaccttgttttttttccctttttatcaaagctcaatgtaaaacaatatttaaaaaatatagaaaataaaatcttggtggcttttctccagtaataaccatggttgatattaaaatactgctgtattttaattcagtatttaacactgtatagtcagcatttttctgagtctgttcttcaatactatgatcattaataactacatggtattctgttttattaatatatatcacagtttagttatatatatatcacagtttagttaacagttcttactgttgaacatttaggttatgctttcgttatatcctgttataaattgtgccaccacaaatatctttgttcgtacatctttgtgcacgtagccaatcatttcctcaagaaaaatttctaaaagtagaattactagatccaaaggtgtgctctttttgaagattcttaatgcatgttgccaaattattctctaatcaagatcttttttctattgaccttttattagtttttttaagaatacatttttttaaaaaaaacctcaaacctgaagaagagttgcaagattaataacaaagaaactttttgtccggtggatcataaattgcttagtatgccattactcctaaataccttactttgcattttctacaaagaagtacatcctcctacataaccactatacaaccagtaaaattatctaattcttagccatcattcaggattgtcccaggtttcaatactgtcatttgtagcaaaaggaatcacatttggtttttgtgtctctttagcttctttcagtctggaacagctcctctttctttgacttttaagacctgacatatttatattataggtcagttattttgtggaatgctctgcagtttggattctagctcagttttaatatttagggaagactcattataaaataaatttttcccaactctccttgatttaacttgaatgcacatgcaaataatgaaaaacccacagcaactattagtcaccaaatgaggaatttaaaaataatattgattggccgggcgtggtggctcacacctgtaatcccagcactttgggaggccgaggcgggcggatcacaaagtcaggagatcgagaccatcctggctaacacgatgaaaccccgtctctactaaaaatacaaaaaattagctgggcatggtggcgggcgcctgtagtcccagctactcgggaggctgaggcaggagaatggcgtgaacccgggaggtggagcttgcagtgagccaagatcgtgccactgcactccagcctgggcgacagagctagactccgtctcaaaaaaaaaaaaagaaataatattgactgaacaaaactcttatagattgaatataaatgtcatacataagtagactttattccctcattttaaagagtaatatacaattttaagtcttcagttttcagacattcacaaatgagaaagatgagttgaacccagctattgcttttcttctcttttatagctattatcttcctaaaaagttcacccagtgtaatattgaagagtatcatgacttcctgaatagtggaggtggtgcctgccttttcaacaaaccttctaaggtaataagtgtggttaataaggtttataatattaattatcaacctttctaaaatattacaaatacacattttcagctattgaatcttagagagcttttcaacttgccctgtatgtacatattctagatatgctatatatctgcatattcaaagtcagctttaatgttgggcattttgggctattctgatgggaatagaaagcaggtagaaataagtgtttgctgtctgaaaaatttccactttctttttatatagccaagtgatgattcagagttagtttacaaaaatggttttattacttttcttttttattttcttgatgtttattttttttggttacctaatcacaactcatacaggtagaaggtgggggcttatctaccctcatcactccctatcactgcctttctgaatgagcagtatgttaaaattacaagtatttctcagtatgaaaaacaagtcttcttaaagcagaaatggagaaagtcttggactttgtcacaggcttttacaacttgcagcacatcctctggttactgactagaaagaaggtcttcctcctgcattttgaagactttgcatgttaaaaaagaatgctttgtccttgcgaattatgtgaactgtgaaatgcttctgtgcaccacagggatatgcaccattgcctttgtaatcatttaatttacctggtttaattttctgttcactacagtgtaatttagaaaatgtatcatactgaattgcgaagcaaattgacaattttaagactcttcgaaagattggaaagaacatttgaactgtatcactgctgccataaatactaaacagttcaagtctttttaccaaaataattgattattataaacccagagtaagagaataagtgtggttatcatttggataagtttccatttttgctgttttttatttgttatgatcagtttcgaccaaaaatgaaatatagacaaaagttgactcatttgtagaagagagaatatttaaaatcaagtgggttttgttgttgttgtatatattctttattttgttgtttttttcctctaattagttatgaaagtgtatgtgtgcacgtgtgtatccatctgtttactggtgtgtgtacattttcattctataatacgtaaactttgattagcttttgaatgaatattaggtatctggcatataacaattatttactaattttgcctgtcaccataggatacattatattcaaaagagaacaaagttgatgaagagctaaacaataaaacagacctaaaacatactcttggacaggccaaaatttgcttcaatctctggggaaaatttaattttagttcgctgcaaaactatcttaataggaggagctgttttttttattaagtcgatcaatggatatactaattttttgatgcttttctcattgtctatgaaatagtttcctgtatcagaaggagatatagtaataaagggttttttcacagatgactaaacttaatcctcaacaattttctgatgtggatggacaactattattattattattattcctgttttagatattaagttctctgagatattaaatagtttacccaacgtaagtacttgagccaagattttaatctagacatctgactccaaattcccctgcttccagtttgaaatgaattttcaggagagactctggcttgattttagtgaatggttagatcatctttaattttgatgacatttaccagaccctatgtggtgtgtatgttatatatataaatatataggtaaactatttactatgtatattaaatatgaaaaggaaacagaagtagacacttctgttttaaagttccaagttctgagctcatgctttctagtttaggaaaataaaactatattttagaatgactggcagggcaggtatatttgggtatggcacttatggtctctcaaagtctttgatgttgatttttctatattttagttcactttttggttttcctcacagcttcttgatcctcctgagtgtggcaatggcttcattgaaactggagaggagtgtgattgtggaaccccggccgtaagtctctggttgttttgatgatattttctaggtaattcagggtcattccaggtccacacactgagatgtatggagcaaatgtcatgcctggaattttataggatttgtggaagaaaaattattgtgagtttgtacatttattttagaaaatatcctgttactttcaggaaagtgacaccgttttctgatgttttgaaaatgtttatattccttaggaatgtgtccttgaaggagcagagtgttgtaagaaatgcaccttgactcaagactctcaatgcagtgacggtctttgctgtaaaaagtgcaaggtaaataaacattaatgaccatttgacagaaaaaaaggacatacttgattaaatcattaaggctgggtaaatataatctaataacagaaatagtatctaacatatattaaatgagtaagtgccaggtgctttataggatcttcacaaaatcttgtgtggtgtagttgcttattattattcccatctaaaagatgagaatactaaggcttgtagtggttaagtagtttgcccaaggtcttacaccaagtaagttggggaactagggcctgaaccctgttaatcttcagaggctgtcctttccatactttctgtggagcatgcacattaaatgaaaccaggtgttactaatgtttaaatgatgtttacctttcttggtaaagccaaggagactttcagtagatcttttcttgttgctcagcttggtgtatctcttgcattagctgctgaggaaacaagggagtactttgagacatgataataccatgcatatattattggtcctgcaagtttagaatgcatctttacacactttatgttttcatcctcccagcagcatcctcatacctatctccaaatatttaagcctttacatcaatactaacatttgaggcttacttcccctaaagaaatctaattcttgttttctcatacaaaatctggtgtaatagtctacgttatttctatctgtctctcactttactctgtacatttcatggagcagagccaggcacttagacagtaattggtatacattctcagtaaatatttgttgagtgaatgaataaatatgcactctcttagtgataatttgctgattgagtaactttaaagagttaaaggaggatgggatatgaaactatcatagtaagtatctactgtgtgccagagattatgctaaggacttttgtatcatcttatatctgaatttctcaactctggcactattgacatttttggctggataatcctttgttgtaagggtatgtcttgtgcattgtagaatatttagcagtatctctgcattccacccattaggtgccagcagcacccctcctagatgggacagccaaaaatgtccccagacactgccaaatgttcccttgtgggtaaaatcacccctggtggagaccactctctgagataatgctcacaagcacacttttgggatgggcattattatcttgatttttacagttaagcaaactcagtctcaaggaagttaaataacctctatacaggctcacttagccagtaaggaatagatgtacagttatgccccagatctgctggcagcagtttctgttgtttccactctaccactgtgtctcctggcagctttttaagacgagcaggcactggcagagatctctgaaagcactctgttaaaaagaagattaaaccaaatgtgaaagacattctttgattttggctaccacccctgtttattctgtcagctttttccactgccgtaacaagacatcctgaattatttatcttaatcctcaatgttttaagtctgcccatctacaaaatgcatttaattacactgttttccctttgatttatacaactaggctccctgtgatataattatttcaaggaacaagtagaaaataatactattaaaatacataaaataaaatggcatgactgccatccctcaaagtaagttatagctgtaccagtcaagagtcaagtgagatcttttttgccactttctttaccatcctccctaactctcacctgccaccctagactcctagggcagccagaggcaggacagtgaatggaggagggagaatagaagaaaaagataagaaactgtgtgtatctctatttttttctacctgtatttataatagtgtatctataagccagcattggcatgctttttctataaagagccagatagtaaatagtttaggctttgtgatcataaagtttctgttgcagctcagctctgcctttgaaagcagcctttgaaaatacagaaacaaatgggcatagctgtgttccaataaaactttatttataaagataggcaatcagtgaagtttgacccatgggccacagtttgcagaccactgctgttaaagagtgcttgtttacttgtttattacttttcttctcccattataatacaagggtatttattggcaaggattttggttgatttatatactgctgtatcctagcacttagtgcaaatcctccctccctattctttcttttagaagtttcctggaacttcttgaacattatgcactcctctaaactaccccaaatttgctcatatttctaccctagatattctaaaatgttggcttgtcttagtcccaaggaagaagagaaacgtgaaattaaattttcttatttccttatttttaacccacattaagatgcaagttcctgatgagcagggttcttgtgttttgttctccattgagttcccagtagttagaacagtgcttggcacgttattaaatatttgatgaatggatgaatgaatacatattttgtttgggtcttctaaaaaaaaatacttgttgaaatccagattggagtttatagtgggcagtgcatgttctaggaacagcaggagactcaaatgcctgtagagttctgagcagctagagaagataaagcttatctagaaagtgagggaagcagaataacatgtgcctttgtgtgagcagacacaaagcatgtaaggatacagccctgaatgctaacattttggatagagaaaaagagaaggattgagaagggaaggggaagtactttaactatatatctcaggtctgtttcattttaatgagtactcctgcaattcacatttttaacctaatgaagttaaacatttatttgtataactctcacacttgcaagaagtatttgagatgatggaaaacagaaaaacaaaaatgcctatatgaagacttaaataatagaaacactagaaaataataaaagaccaagatctaaatccatgtaaaaatgaggcaggggagaagaagggtagaagaaacatgggaggaaatagctttgtcagaaaatctaatttttgtggttcaacccaaaatgtaattttttgattcttggtagataaggcagaaaaggataatgtgataaaagtgtcggtgagaatgaagagtaaagggtaaattcaaaagctattagtacagaaaaattactagaacctggactaactggcctgtcttgtggaatttagcagtataatataaggcttatgtgtaatgactatggaaattacatcatacacaagaaactgtttcttaaaactattaaaataaaatttttttcagtaactgtggttttgacagattaccatcttacagtagtttaaggtatttctagccaaacaattttcattttgttttttttagatgatattgtaagatttttttttctccctacagtttcacacgttgatttttgttcattttagtttcagcctatgggcactgtgtgccgagaagcagtaaatgattgtgatattcgtgaaacgtgctcaggaaattcaagccaggtaatttacaaaataactgctctaaaacttatgggaaaaagtgggggtatctttagtgcactgaccctcaaagagaaatgtaaatgaacaagatgctcgtgtctctttcacatcatttctccattttttttaggaatttaagtttcagtgattgaagcttgagcagattttgaacataattttgtcttaacgttgaactaacctcagactgcgtgcatgccttaactattttgtttttgtattaagtaggtagtacaaggcattttcttttcatctacttagtaaaggaagaaacaaataaactctcttcagctgattgaacaagaagtcagtggaggcagggactcacaaacacactggattcttagagaggacccttttctttctcttgactcttatctatgatagcttgcatcgcctcagccatcaatagctgctcttgaattttatagcacttagttatagatagacaagctagagaaattgaataaactttggtgggagttcacagatttcaaaatggtcactgtacatacagacggtcctcactttgaagggtagtgccaaaccataaaaatgaccatgcaagctgagactatgcaaagtcattttaataatcaaaggaaaatactgcacttgttttgcagtcctcaaaaaatgctgtcagattattaaaaactctcttactgttggttttaaatggataggaaggtgaaagaatagtatttatttagcatactgtacattaaaagagaaacattgagaattaaaggattttatttctttgtaaaaaccttaggagtagtttgaatagagcttgccttcttataagctttatgatatagagtgagcatattttctatgccttgttgaactgtcacacccttttctaagtttggatcagctttcaacattttacaacattttattctttgtgctttcaatgtcatgagatatccctgagagatgtgaagatgtgaatgtgaagtttcttgctggcgttaccccctctgggacatcgtcacctatatgtcacaatcaccttattcaccgatgtcattaagtcctccttcagcaagttcctctggttgcatgtctagaggctcttgaacagcaatattgacattcccacagtcagcaatttttttctgtaactccatttacaagttcaatttgcatttcacttctggtgtcatcacttttctttgctgcactttcatctctgttggccagtttcctctcttggtattccgtttttgcaaaatggcacatgatatcatcagaagacaaagaggcaacataattgcatgctttgctgtctgtttatactcattcaatattgccttataatttttcataattgctgcaaggaaaaaaggattataaagtgtgcccttttctgacattcttaaagtggactttggcttgaaagtcattatttttagtataagggctatgtttcttctcatggcaaaagaaaggaaactagttattgctccatttatgcagacttactctttgtttattgtccccttctctttcttgctctgaaaaatagtatatctgtatgaatcaagatacttttaaatgtatcattaattgagtctatggtagtcagttctttttatttgctgctatgtaatcaactgtttttgcctctggtagattcatattttcaggggcaagtgtacccattgtttttcctcttgctttctcttttatttttttaatttattttttaccaaatacccagacttcaaggacatccacttgctcttgacctcctttgcattttgttttatagatggtataagggactagccatattaacaaatatgtttttaaaagtgaaaacattaaagggtttagctcagccttatattttgcactgcatttcattcatagttgttctctttttcctagtgtgcccctaatattcataaaatggatggatattcatgtgatggtgttcaggtaggtcacttcatttttacctatgtttttcacatgtaccagcatgaaaggaatactgaaatcttatcaaaataggaagatcaatttaaatgtttgtaatcaattctgaagataaaaggcctctctactattcatctattatttttcccaatcatagtttctttttcagttatctgacataagcagatattgcatcgctaatgggtatttgcttttccgttttagggaatttgctttggaggaagatgcaaaaccagagatagacaatgcaaatacatttgggggcaaagtaagtaaatagtgtggcttgatcattgttaaagcatgatgtcaggcggacttctcaaggacgtgtgtgctggaagtaaatttttgactactttatgactgggggattctcaaagctaccacaggtcttagcaggggcatgtttctggaaattagagtaaggcacccctttgagaagcagccccacacatcttggctagttggcagtgcctgtggacgagacagaaagtgcctttgctgccaggcagatggagcccatgccagggtgcacagcttggagaatagagcaaacctggatttcagctccatgtatactcttctcagctgagtgccctgaagctaaagcttcacaaccatatgggatggacgtggaccctggacaggacgtccttaacttagaacagcagcattttatctagagtcatttttttcctccttggatatttttcttaaactctagttggctttcctagttacgcacttctgctaaagtggctttgctgtatcagaaagaaatgttaatgtttagcctttaaagtctgtcagattttcaaaggaaaatatatgatatttagatttaaattatactctatttaaatgtttatttaaatgttgagtaatgtattgtttcctagaagtactactagcccaaacttttggaagcagtttttgttttaaactgtttcaggagacaatttgtagtaggaaaaaggctataaaaataatgataattcttaatagttataagtaggtgccacaatccttttaggaggggaagtgtatgctctctttaagcaattggaaacattgggatgggaaaacatttagtcaggcaggtttgtactccgaaaaaagatatcatttttgttttatccacttgagcaaaaatagtagctgacaacaagaagtaggaaacataactaccgacataactattgttttttttaaaaatataccaacaattatcctttgattagtttgcattttgtcctaattcttagataactctatcaactgtccctggttttagaaaagataaaagcctgaaaaagatactgatgtaccttaaaatgttatttgacttccagagatttagcatgaattcaagcttgtcttaaagcaaagtaaaattgcttttgatagctgctaagaagtggggagcaaggtagaaattgtaccactgtttcttgaatctaattacaggatataactattataataaacttgtctttatgattaacaaaatatgctgaatgagaaattcatgtattatatttagcactgagattaaagaatagagtatatattcaaggaaatatttgttattgccttccctaattattggccaaattcttttgttgttgttgttgttgttgttgagatggagtcttgctttgttgccaggctggagtgcagtgatgtgatctcagctcactgcaccctctgcctcccgggttcaagcgatttccctgcctcagcctcccaagtagctgggactacaggtgcacaccaccacacccagctaattttttttgtattttagtagagacggggtttcaccatgttggccagggtggtctcgatctcctgacttcatgatctgcccgaattattggccaaattctaaggagtgtttgtttttgtagcctacagcctgagtcccaacagagaactaaatacatttgtttactaaatttcaaatgagctttaatgaaaacctatctgagtcatggatatatatgatccatggtaaaactgtgaaccgttcgttggtaacatttttggaattgataacactgtagtgatgaagagtccttatattacaatttttcttttctgcaaagcttttgagcagccaaatcgtacttccctcactgatagaaaatttttttctgccttagaggtgacagcatcagacaaatattgctatgagaaactgaatattgaagggacggagaagggtaactgtgggaaagacaaagacacatggatacagtgcaacaaacggtgaggtggagacgtcagcccagaattcatcccttggtcaattacaagtgtacttttttgagtgactaggaagtttctgctttctgcatcacacaaagtgtgctcttgcctccttaacctcatctcttcccagtgttccagcatcacctgtgcagagggcttccaaatcttgaacatgtgtgctcacctctctcctaaggcccaggtcatacttgcccccacctcaggattttcttacctagaagacaccttttagcatctcaaaggcaaaagaacttaaagccaccagaatatgcactgagtgctgttgaattgaattaactggctctaactttcccaaaccaccccctttttgccaaaggtctcaatatttcactgtccttctgtctagaagccttaaagtgatccttccctctacacattgtccaaatgctaaattacatccattcttccctttgctttgccaccatttgtctttaattcatgtattcacttacgttcctattaccattacctgaactaagacctatattaatccttcaactattacaaaattcttttaacagttttctgtgccagcattccctagtgtactactatcagaataatcttttgggtcttttttactgtcaattctttgttgaaagttcactggttccacatgactaattaatagtgagaacagtacccagcactgattgagtgaacactgtgtgctaagcactgtatcacactttacataagctatgccatttaatcttcatggcagtcctcccattttatggaggaggaaactgagacacagttaatttgtccgaagtcatgtatatgggatgtaataataagcagaattagaatttggagagtatgatttcagaactctctcttcaccattttgctgaatgtcatagtcttgttaacaaattaaatggaaccttagcttggcactgcacctattcaacaattgtccccaacctacactttttgtcatttcatttatattcttccaaatctagcaaaccttaccattccgaatatgtccctacctccatgcctacatttatgctctataatcctccagaagcaccctttaactcataccatcatcagccaaaaatatacctattcttcaaagcccagcttgggaaacactttctatatataaatttctttatgatttactctagaaataaattatctctctcttctttgaacttccacagccctttgtacttatttgtccgtaattttgttttataagttgtttatgtgtgtgatttatcttcttatttagagtataattttcttgtgaataaagatcatatctaattgtctttatatatcctgattacataggttcatatacataaatgacattcaaaaaagttttgaatgaatatctcttctctgttgagaaagcatttttgtttatgatagatacagtaaaatgataacataattttaaaaagcatttttaaagaataaagtaatacattcttttctatgttggtgaaaaatacaggttctaatttttcttttttctccatgtggtaaagtctgatacttttgtatataatcttgctgacttactaattactcttcacaagatattttaaaaatatgtttattgttatctctactaataattaaaatgtgttggatataaataatatgtaagatagtattaacaacagtaaagatattttataagttaagttagaatcatatgtaatagttggggaagtactgaaatatattgaagaaaggataatgagcctttgtagttggcagtctgtaaaataaatgcagcctataatttcttctttaattctagggcaacaggttgaaaaaaacatctgtattccaaaagaatgctcatccaaatatcattcaattaccaattaaaaaaaaaattgtctgggcacagcatctcatgcttataatcccagtgctttgggagggtgaggagggaggttgcttggggtcaggaattcaaggccagcctgggcaacatagtgagaccctgtctctgtgaaaaatttaaaagttagttgggtctggtagcatacacctgtagtcccagctacctgggaggctgaggcaggaggaccactggaatcaggagtttgaggctgcagtgagccatgattacaccactacactccaacttggacaacagagtaagaccctgactctaagaaaaaaaaaaaaaaaagaagaagaagaagaaatagattagtatatccagtattgtgttatgggaaaagagatttcaatataaaagaagccaatttgatggattctttaaatacttgaactaatggacagtaaagaaaaagctagaaaacaattgagattttggtacatcagtaagagtttcagtgaagacactttttagagcaggtggcacactaatttggacttattttatttcacttggcatatgagtagataatatacttgatgaaaaccaaatgctaaaatgagagaagattattctaactgtacatggtttgctatatatttgggaaaagaagtaattggtaatcttttgatacagggatgtgctttgtggttaccttttgtgtaccaatattggcaatatcccaaggcttggagaactcgatggtgaaatcacatctactttagttgtgcagcaaggaagaacattaaactgcaggtaattatctaaccattctgtaagaatctgagtcatcttatttctcaggaatgcagtttaggattccttccgttttcaattaatgtacatgttagtaggtcgaaatataatctagtctatagagacgattgagtaaatcctaacagagaagagataaaaagaagataaaaaatagttgaatgaagaatattgtgtgattactagagttaggtttagattggtcagtaaagtcttatagagtttggtttccaaacttacagaatttggaaaatgaatgaggacttctaggtaaatcagtgtattaaatatatgcatctacttttgctcccttatgaaatctcactaaaatgataccaaatggatctttttttagagttcatatatccacagggaggcatagaaagagagaagagataatagcaacaatattttgttatgtataaagcaaatggatgtgtggcacatgacttatcaaagctgagaaagctgaattcctaagtcagtaatgaggaaaactgagaatcaatccaagatatactcttacttccccacaggctcagaaattggcagcatcatctactttaggaagagggagggaaggagtggagggaaggggctgaaatacagaaaatagatgaaaggctgttaaaaaagcagttagatactcagattacttccccaactcagctaaacgggatttgccaccctcccatggaagattggagctttatactctatagagaataaacgaggaggtttctaagctggaggacagcaagcaatatttatataagggttgtagggaagtagtccaacctcagtggtaccgatttccagtcatctatttggtctcctaattcaaatatgagcagattatcagagatgtgaaaaaaagtctgtaacatgaaaaaaaaaagacaaaaacaatgagacaatgaaggggaaaaaaacaaaaccacttatcaatatttatgagagataagagacttctataatgaaacaagaaaatagggtgctgtttttttaaacagggaacattcagaaagaaaaaatttagtagttgaaattatcttccagaaagtagggtaaaaaggcaaagaaatggaacatagagaaaatcttacacattaggatagcaataacaacagaggaaacagcagggaggaaattttcaatgagtaactcaagagaattgtctagaaataaaggacttgagtttccatattaacaggctcaccaagtgctgaatacaatgagtggaattagaggtacatctaaacatatcattatgaaattttagaaccttagaacaaagcaaagaattctggaagtttccagagaggagaaaaaaatcaaagacttaagaattaaaatggtttaggatttggcaacaggagccctgggagtcagaagacaatagagaaaattatttccaaactagaattttgtactctggcaaaatatcaaacaagtgtgagggtagaaaataaagacatgtttagttatgctacaaatttctcaggaaagtactagaaattgcactccaccaaaacaaagtaaaccaagaaagagaaagacagggaatataggaaacaacataccacaaagagagaccgggcaatccccaagttgatagtgaggcgaaagtcaagatttacagcgctacgaaaccggcacatgtggacagtcagcacagacaacagcaggccagaaactccaggagaccttcataaataacaaaagaatgaattaagagtagaaaatggttttcttctaggatgagtatctggaagaatatctagagaggcagagaactgctttattgtgtttaaaaacaatttatctgttgattctttaaactatatgcatatgtaattttgataaaaataaatgaagtgaatggggattgaatgtaaatggcctaaataccccatttaaaaggcaccagagtgacaagttggagaaaaataagaccccaaggtgtgctgtcttcaagagagccatctcatatgcagtgacatctatagactcaaaatgaaaggatgtgggaaaatctagcaagcaaatggaaatcagaaaaaaagcagggttgcaatcctaatttcagacaaaacagactttaagccaacaaagatacagaaagacaaagaagggcattatgtaatggtagagggttcaattcaacaagaagagctaactaccctaaatatatatgcacccaacacaggagcacccagcttcatcaagcaagttcttagagacctacaaagagacttaaactccctcacaataacagtaggagacttcaacacttcactgatagtattagatagatcatcaaggcagaaaattaacaaagatattcaggacctgaagtcaatattggaccaaatggatctgatagacctctacagaactctccacccaaaaacaacacagtatatattcttctaatcatcacatggcccatactctaaaattgaccacacaattggacataaaacaatcctcagcaaatgctagctagagcactaaaatcataccaaacccactcttggaccacagcacaatacaaatagaaatcgagacttaaattttttttcaaaaccatgcaattatatggaaattaagcaacctggtcctgaaatgacttttaggtaaataatgaaattaaggcagaaatcaagaagttctttgaaactaatgagaaaaaagatacaaaatacaagaatctctgggacacagctaaggcagtgttaagagggcaatttatagccctaaatgccctcatcaaaaagttagaaagctctcaaattaacaatctaacatcacaactaaaagaactagagaagcaagaacaaaccaaccccaaagctagcagaagacaagaaataaccaaaatcagagctgacctgaaagagactgagacatgaaaagccaggtaaaatatcaacaaatctaggagtttattttttggaaaaattaataagataggtcactagatagactaataaagaagaaaagagagaagatccaaattaatacatcagaaacgacaaaggggatgttacgactcaccccacagaaatacaaacaatcatcagagactactacgaacacctgtggcacacaaactagaaaatctagaagagatggataaatgcctggacatgtgtatacgtttccaagactgaatcaggaagaaattgatttcctgaacagaccaataacaagctccaaaattgaaccagtaataaatagcctaccaaccaaaaaaaaggccaggaccagatagactcacagctgaattctaccagatgtacgaagaagagctggcaccattcctactgaaactattcaaaaaaattgaggaggagtgactcctccctatttcattctatgaggccagtatcatcctcatacaaaaacatggcagagactctacaaaaaaagaaaatttcagcccattatccttgatgaacattgattcaaaaatcctcaacaaaatacttgcaaaccaaattgagtagcacatcaaaaatcatatccaccataatcaggtaggctttgttcccgggttccaagtttggttcaacatacgcaaattagtaaatgtgatttttcacataaacagaactaaagacaaaaaccacatgattatctcaatagatgcaaaaaagggttttgataaaatccaacatcctttcatgttaaaaactctcaataaactacgtattaaaggaacatacctcaaaataagagccatctatgacaaacccacagccaacatcatactgaataggcaaaagctggaagcattctccttgaaaacttacacaggacaaagatgtcctctctcaccactcctattcaacatagtattggaagtcctggccagagcaattaggcaagagtgaaaaataagggaaatccaaataagaagagaggaagtcaaactattgctctttgctgatgacgtgattctatatctagaaaaccccatagtctcgacctaaaagctctttcagctgataaacaacttcagcaaagttttaggatacaaaatcagcatacaaaaatcactagcattctcatgcaccaacaatagccaagctgagggtcaaatcaggaatgcaattccattcacaattgccataaaaataataaagtacccaggaatacagctagtcagggaggtaaaaaatctctgcaatgggaattacaaaacactgctcaaagaaatcagagatgccacaaacaaaaggaaaaacattccgtggttgtgaatcagaagaataaatattattcaaatggccatactgccaaagcaatttacagattaaatgctattgctatcaaactatcgatgacattcttcacagaactagaaaaagctcttaaaattcacagggaactaaaaagctggaggtatcacgttgctcaacttcaaactatagtacagggctacagtaaccaaaacagcatggtactggtacaaaaacagatacatagaccaatggaacagaatagagagcccagaaataaagtcgcacacctgcaaccatctgatcttcgatgaagctgacaaaaacaagtaatggggtactgggtatatacccaaaggattataaatcatgctgctataaagacacatgcccacgtatgtttattgcggcactattcacaacagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactaccacaaggacaaaaaccaaacaccgtgtgttctcactcataggtgggaattgaacaatgagaacacttggacacaggaaggggagcatcacacaccggggcctgtcatggggcagggggaagggggagagatagcattaggagatatacctaatgtaaatgacgagttactgggtgcagcacaccagcatggtgcatatatatatgtaacaaacctgcacgttgtgcacatgtaccctagaacttaaagtataagaataataataataaaaaaccaacccccccacccaaaaaaaatcacttcatttctaattctcaaataaattcaacatatttggaaaaaaaaaaaaaacaagtaatggggaaaggactccctattcaataaatggtgctgggataactggctagccatatgcagaagattgaaactggacccctttcttacaccatatacaaaaataaactcaagatagattgaagacttaaatataaaactcaaaagtataaaaaccctggaagacaacttaggcaatactgttttggacataagaatagtcaaagatttcattatgaagacaccagaagcaatcataacaagcaaaaattgacaaatggaatctaattaaactaaagtgcttctgcacagcaaaagtaactatcaacagagtaaacagacaacctacagaatgggaaaattcttttgtaaactatacatttgacaaaggtctaatatccagcatctatgaggaacttaaatttacaagaaaaaacaaccccattaaaaagtgggcaaaggacatgaacagacacttttcaaaagaagacatccatttggtcaaagagcatgtgaaaaaagatcgatatcactgatcattagagaaattcaaataaaaaccaccataagataccatctcacaccagtcagaatgattattattaaaacgtcaaaaaataacatgctggcaaggtcgcagacaaaggggaacatttacacacctttggtgggagtgtaaattagtttaaccattgtggaaggcagtgtggcgattcttcaaagacctaaaaacaaatactattcgacccagcaatcctattactgggtataaacccaaaggaatataaatcattctaccataaagacacaggcacacgtatgttcattgcagcactgttcacagtctcaaagacatggaatcaacctaaatgcccatcagtggcagactggataaagaaaatgtgtaatacacacacacacacacacacacacacacacacacacacacacacacacacaccatggaatactatgcagccataaaaaagaacaagatcatgtccttcacagggacatggatggagctggaggccgtcatccttagtaaactaacacaggaacagaaaaccaaataccacatgttctcacttataagtgggagctaaatgatgagaacacatggacacaaagaagggagcaacagacactgggacctatttgagggatgtgatgaggaggagggagtggatgagaaaaaataactattgagtactaggcttagtagctggatgatgaaatattctgcacgacaaaccctcatgacatgagtttacctatattacaatcctgcacatgtacccctgaacataaaataaaagtttaaaaaatggtgacttttatagtagcattgacatggccccatatgaataaattgtgaatatatattttcaatgcttaccgaggttttaaaaaacatttctaaataatatatgcaggtttgctatattgaatagtgatatacaatagtttagtcattctcaaatgtaattggtacatatgcaatctttttgggtcagccaacttatcaaattacatactagtaataatgccttacttaccttttgcttggtagcccaggtgaaatgataaacctgtttcaattcaggccccagttatagtaattacattcaaatcctaaactttatcaatttctccaaaaggaattagatcaaaagattcaatagctttctctgagattgaactggcttatgctactggtctttaataagtaataaatagaatagaggaagcaatattgcctgcttttaagtttttgagcatattttcaaaatgaaggtgaattaatagattcattttttgctctcaatttgtttttagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtaagtatccagtaccttgtcagaatctatttcttttatatcacagaaatagacaggaccctaaactatttatttttcttaattatggaaaaaaatgatttttcatatttctagttggtatataaatactaattcaattatagttatttgaatatttctgttgtataatctgagaaagcctggggataaggaaatgaataatctttctaaccaaattctcccatccttcttttctgtgttactatgatctcatataatataatgccaactttttacaagtgaactaggagataaattttaacaaactataatgggattttaagaaagagaataaaaattggatgtgatggccacagtatttaaaaacgatgtggtctgggcactgacaaatctcaacagacttgtcagattgtacacactgctgtagccacaccagcgtgtacaagctgaggataagtcctagaaataaaaacaataacttagggaaatgtttcttacagatgagtagaaaaaaacggcatttgaaagacttttaattctattctttaagttatatattctttcagttatatatcagataatgtgtatcctgtacaggtaagtttacaggttaaatattcatcctctactagggataaagttttgtcagtttcaattaggaattcctataccatcaaaaaagagtttgttctatttctttcagcatgtgctatggcattctttttatttttgttccagattctttgcttgaactgttgtattatccagttaagataaaggatccctgttttggaattgtaagccttcattcctggtctttccatgcttgtcctcagggatattccaagaatttatttagggaagtaactaattgttacttcttgccaaagcataggaattctcatggcatataagagtagagcagacatgtactaagtagctctgctcctatgaaggagtcttccaagtcttcttttcttaatctaagaggatgttaggggataagaggaaaagaataatggaatttttcttgatcatccatgctaatgaataagcatgtcttatccatcttaagattctgaaacaaaacacaagagaccaaacatagttgtgcttggtaaacatttgtttaattaattagtaaaagaataatcaatgcaaataaatcagatggcaaatcaacatccagataatttacaataattatgcataatataattatgtattcacaataattatgcataattatatttggggtaattttaacttacagcaactctatatttgtgtcaaaaaattaatataagaaaaattaatacaagtaaatattatttttgtactatatatcatgtagttaggagtgtgggcttgcaatcatatagcctgggtttgaatcccaactctgctttttattagctgggtaacattgggcaaatttcttcgcctttgtgactcaatttcttcctctgtaaaatggagataataatagtgcccactttaaagaattgtgcgaagaaggagttaacttgtaaaacacttaaaacaagactgggatatggcaagtgttcaataaatgtaagctatgctatttattatgattactgtatactgggcatcattgtctgttcttgtcactatatcgctgatacctgacatatgatatagcaactgatgcttgaagaagccaggcgacctgattaaggtcccttagtaagacaggagtgatatggtgaatcaaatccaggccttttgattttaagcctaaacctttttcgttctgcctatttgttaatctgtagctctgattgaggctgtgttatagttacatttagatgtggatgtatgttatgttcctgaaaattagatcagacaagacagaaacccctgtagtaaaaacctgtctcaggaggaactttgctcatcttcaacctaacttaactctctcctgcttctctattcaaggttgttttgaattagatttaggtgtatattctgtttcctgagtggactaatgaagagagattattttcctataatataaaaaaaaatggtgtcaattttatatgaatcttttttctatactcaattcgtgggagttcttagttcccctgaccctgacatagctagtatctacagcatgggttgaagtgctaaggttgtatagccttgtggaactttcttctcagcccactgcaaaacatcaggtctcccctcttcatcagacttttatttcattttgcttcctaaaaaatgaataacatttttgcatgaagacccttactatggaaggaaggaaacctttgtattagataattgacagatgattatatttctgcttagctttttaaatcttccttataaaatttaagttagtgaaagtcaaaacaataatttctttgattttttttttagatgtagatcaatttctctgttaaaattcatcgttccctttgggtcagttgttggtctctaggaaacatttgcttgaggtactggagggagaaataatgtaattagtattaagaagaacatactaataattttttggaattaccacattctaagcatataataataagaaattagtgtttatttttcatgcttctgtaccagagagttgacatttactctagcttgattttggatctcaggtttgcagtaatgagctgaagtgtgtgtgtaacagacactggataggttctgattgcaacacttacttccctcacaatgatgatgcaaagactggtatcactctgtctggcaatggtaagtacttaatttggtaacattatgtagtctttatacacaaagagaaagctgctctctgaaaacttttatttgagttatttttatgataatcagaaatacattctcataataatgaattatacaactggggtccattttatgaaactgattatgtccattaaattgtaatgatatgtaatattacgtataacttagtctatttgatttagccttatcttgtcctacttcattctgagatttttctgaggctgtcaattaaccctaacatttctttcaaatgtggaagtagtcataactcttaattgtgtgcatttagaggaataattttatatttttgaactgaataaagaagaaacaattaaagaattggttttaaaatattttaatattctttattatagaatctcattgttgttcaaccccagttctgtagcctgaactggctacagttagtaatcctggccaaggttcctggtggggctttaagaacatggataagaaataacaggtgcagtcctaaaagctagggtggcccaaatgggggtatagaaatcaaatgcagacagttgaaagaacttatacattggaggcaaatgtccccctttaaaatatttcatcatttcattattgagtattcttttatacaagataatgctcaaatcctaaagttcagtcactttcaaaggatgagaaaaaaggaatatgttcattctaatagtccagaaagggtaaacagttttagctaatatgacttttataaagaaaatcataggatgattaagattttagagtccctagtcttagcagtggtagtgtggagcttgttccagtaattaattcaaagacaataatatttagatagatggatttaaatgacgtgtcaaaagccataccattacttagaaataaacaagactaacatctaagtttattgatccctgttaagtccctggaaaaaaaggaagggggggcagacatgctaggtcttgaagtaagaaaattctagtgacccaaggaatcctctggcatttgcatctgtgcatcccacagaggacctggcaggttggagtccactagtctgctcagatgacctagccctgctgtctgacatgaattctgagggctcccagacagagagactgccactactatcatggagaattgaaatcttctcaagtagcccatgactcctgacctctgatgtataaaaggatgcctcaggagtggagcaggcaaagatggatctaagctactctggatgaaagctctgcagttaaccatgtggcacaaatcattatcagcaaaacaggccttctggtgtcagagccaggcctcattcagatcagccttttctgcctttgagccctcatttgagcttattgaccaagcctttgactcatggtgccattctgctgtgatgatccccttaaagattatatctcagcctgcctgacaatggatactggcacaacaatgccatcactgtgttctgagcttcaatcccgccctggattctgcctgcctgtctctctgccagtgtggtgctgcctctcctgccacatcagctccaatcctccagctcactcaactctttttcctctggggtttccttctctagaatgccacagccatcattgcccagacggggaattacaagcccagtgtttctatcacctacatcacctgggcagtaatcacagaagtctgtggacatgttttctcccttaagaagcttgtattcactttgagagagacaaaatataacacacacaaaaccgagagcagtaaggaccttgcgttagttgtcaaaatggagtgatatgcacaataacatttctagaatttctgagaaagaggtaaggatcaaaaggaacacagattttctacaagttcctccctaagtttcattactcttccctcttttagtttaatgacatcatggtttctggaaaatacaactgtgcaaaatgcacttggacaagaattaaaaaggacatttgccaaaaattatttttaaaacaactgatatggattgctgaattatggttgattttttctttcctttgaaaaatactcatttttgaaaacaaacagtgttgttagtgtgatgattacaaaactgaacaataaagtttctgaaaggattttataccactgatcttccttctttcttttttttcctctcaggtgttgctggcaccaatatcataataggcataattgctggcaccattttagtgctggccctcatattaggaataactgcgtggggttataagtaagtgaaatgtctcagtcttgttactattgaaatatacttctaaacattttgattacatgaaaacatctagaaagttttgtatcattggttgaatatacttgcaatgaaaatcagcttggctcagcagccagtcaatgcttattcttggcatggcgagaagtgataataacatcattttttagattttgagacaacttccttctattgtaaaagaactgagtattatttaaaaatccttgaagtgaattgaaaccagtctaaatttgtaaaaactggtaagttgtaacttttgaagagaatttaataaccttaaacattttgctcagtaaaggccttcaaacattgtaaacttatttatctatctaatgtgttcaattttcttttcatgatttatataatctgaaaagaaaccagagtattcaatttcctttttaagtgctttaatcttatgatgtgaaaaatttctttgtattcaaataactaatttaagtttaataagttaaaatgtaaatatagtaaaccttaaattttctttaatatttcaacttaaaatcatattctgctgatccttgatgatgatgttccagtccacaggcctggggtttttctccatttggaaggcctgcagcttgtgctaggcattctgggcattacctcatttcatagcacatttttcctcatggatcaaacttaggtaactcaaagttttgggaattagaatcaaaattttagacatttaccccatgccttttaatggacttgcctttgttccataagttaatatatgtcaaacactcaaagtagtacctggcccacagtaagcactatgtaattgtttgctattattatcacttaacatggtcttaaaccaattgcaccaaaggaaacatctttatagtgtacatggtaattgcttgtgaggtcaaaaccatcaaagagtttctttggctaaaaagggagagcagttagtttactggcaggataagctttgtatgctgcaagcattaataatacaggcatttgtggaagactatatattaatgagtagcgcagagagcatattacagtttggcaaaacattacagtttgacatggcatgtcatagtgaaggagagtacagcacagtagtaagcttttccctgattaaatgagcatctagccctgtaccatgtagtcttccacaaattcttgtatcattaatgcttgtagcatacaaaacttatcctggcagtaaactaattgctctcccttttcagctaaataaactctttcataattttgacctcacaagcaattgccatatatacttacaaaagtgttacctttggcgcagttggcttaagaccatgttaggtgataataataagttcatagcagatgcttaaaacctatgggcctctttggtgtgcaggttactgggtgtatttcacctcagcataacatttggagttatcaaatcatatatctgataggaaggcttctctttttgtcatttgatttctcctcacaccagaagcaaattagctctgtgttggaatcacaccatttctccaaattaatgcatgatttaagtagtaattgtcatcacaagcattattgtgttgaagtagctcagttgtttcatttggctgtgtgaaaatggaaagaaaaaattgttccttctggagtgtgtgattttctgccacctagtgatggaagtggatatttcatttttacaatcttggaaaaacctaccttttagaaacctaaacgctcatattacttattaaattatgtgtctatttgcctttattgattagaatgaaaatcactttttttctgcaggtgacttcttatttttatggcattcttttgagatctgttcattcctcaatatatacactttgcaactttaataagatccacttagctggaaactcatttaagttgattttagcttaaggaaaaagacacaccttgtgcatactacagtatcttctttataaataactagcccaaatagctaaagttttaatgtttctaaaattattcagaatatgtttaggaatatagtgggaatgtagatattttaatagaggaattaaattcatgaatatgatgttttacttattctatttgcaatttaaaaccccatttagaacctgagaactcattttctcattagtttgtccagttaaactttctaccccttctccaagccttggggtggagaatagcaggaattaaaaaaaaaaataaagtagaatgctcatttggaaccgtatggctcaggaaatcagattgaaggaataaaaagcaaaacatgttgaatagaaaaataccaggcttatttttcccccatctgatagtttccaggatgaaaaataataacaaattggcacctttgccgtcatgtgcccgttatcaaacgtgatatgtataatgtggatgaaatagactggcaagtaaagatgttaccaatgaaatccatatgaaaacattatccttgatcttagaggaagcagcccaaaactactcacttgcatgacctttctaacgtgtctccaaaatattaacacttaattatgtcaagatagaaagttagcagtgaactcttgaaaagtcactggtactgtactaccacaccctgtagagcaattttttaataagatccacttagttggaaactcatttaagtcgattttagcttatggttaaataaacacagagactaaacattgaacaagtatttccaatgtgaagcttcagcgagtaagtagtaatcacttaggagatccttaacagtcacgaattgactcactcctatttatcatacctgatgaaataaaatgttctggtattcatttatattcccctatttgaaattcttaggaataactatagtttggggtttatattccattaggaatgaattataattttatttctgtaaaaagttatttatataagtaacttgattcattaatttcattaagtcaatgtatgtttgaagacctgtgtttgaaataagatttactttagagcagtgattgatgttgagaaaacaattactctttaatgactgcagcatatttatgtttttaaaagtggacaattgtttgacaatattgtcactgactctttgttgcttctcctgatgatgaggtgacatttttgtgtgtgcattcccattttaattctgtaattcagaatcctctagtgaagacttttcaatgaaagctagagcttttatgtttagagctccctcttgatgtccttccagaggtaactaactcttatgtttttccctctttctcttcttgtccatgaaaagaaactatcgagaacagaggtatgtaatacaaataatgtgaacataaaactgaaaggtttgactcatattagcattgttggaattcatacatgcaattataattaagttcactttgtttttatgtataataatcatacactaatcgatttttcattatcttgaggtaattttaatgatggtgctgtgaaatatagcaatttaaaatagatctgtcatttaattttaatggatcttttatccaacgatactacaattagtggagtcttgcttattttttaatagtaatatatatagaaattgattttttccatctaaaacaaacttcctctatgttaaggtgtcccatttgtttacattaatattagcttttcttcatgtttgtaacactcttattgcctaatactttctgagggaatttatttattactgtttttatattaataatatccattcataagtgacaaagtttatttgggcagtgttgctgttgggaatgttctagcatttcgtgagcctgtttatctctgcataaggaattttttgtattgattaggtaactgcacatttaaagaaagaatttgcatagttggaataataaaaatgcctatattcttgagaaagtcagacaccctgtatagcataaccgtaaaaatctatgtttaaccaacagcttaaaagagatacaaaatgttcatgttgttctataacaattgcctattttatctgaatctaaattagcacataatattggaatgcactcttcacttttcccacttaaaaagttactagtgctgttagctattgataaaaaatattaaaatattatcctggaaactgataacctagaccaggtcttacacatgataatggtatttagttctatactcatggtatttatgcagattcctatttacttaaccttttccattgttgagttgcatgcttgtgacaggttatgaataaggtgtataaatgtggtaatttgtcatgctccatcacaactttcatttttttcacaaatcaaaaatttaaactttactcttttttaaataaattaaaattcccataaggctttaaccataggtatctgtagaatctgtataaatatatagtgcccatgggttaccatttgaaatcctggtcagtttgtgtagacaacagaaaatattgacctttccctagagtgactaactcatcattaatggaaaaagtaaaactgggacaaaattacaatttaagaacaaccagatttcttcatgatgtgttttaaactcttgtgtccaaaagcgcttgcttagagcaggagccgccgtttagactttctgttgggtagaggttgattgatcgtattagaaatctaagtttggtgagtttctttagtggaaaatagaattaggcaaataagattaaaaagttaatgattcagcttcatttccacaggaactaaggctataatgtaatttaatattgctgaatatatgaaaatgaaagtgaaatgtctcataggcaacataagcaaagctagcacagtgctctaagatgtgttctcattagggattctatccagaataagggaattgcccacactttaaaaaaatgattaatattgaaaagtatgcacaaatttcttgttctaactcaatatgtagagagatatcgttaagaacattttcacatgaagaatctcctttatgtgcctgatataatttcatgtctcctggtgttactgagtcatcatttcattgatctggctactcttttggaatctagtccatcatattttgagagttgtcacatcttcagtggatatttattttatatattttgatatatgtcaacacaaccttttttttgtccttgcccataactaatgaatattaggtttgtacagtaggtctcaaagtggagaaatggcaaagaatagactttagatcaggaagttgtgaatgtataagtgttttctaaatgagtttcctttttgagaatatatgttagtgattatagacaaagtggtaaggccaacagaccaaagcatgcattaaaaaatattcaatcttataaaaatatctatagacattcaagtaaagatcttcccaattccaaaatataccaggaagtaaaattaaggattttgagttgttattgattttaaatgaggtttttctttgaggttccatggtagggagaccagtccacaaggaatcagaaatctactagtatgtggtattggaaaatcaaactttcctcaactctgaaatcaagtaaggttctttgtaatctgtaaagcattatggtgacgggaagttattagcatgtggtcttggaagactgtatttctctgatctttgaatgaaagaggtgaatgcagttgttctcaaagaggaaggcagcattcattgacatgagtgaggctcacacatactggttgaggtggtggaaatgtcggtgaatgtaaacttttgctttgacactaaatgcaagacctaataagtataatagcctgttatcagattcttaatactgttgtaatggctcagaagtaccaaaatgggcataactttccaattcctggagaggacaggcaagtagttctgtgagtgaatttgataaccagataaattttctcttctgagaatgagtcctcaaggttttcagtatagagaaggattatattctatgttttcttgcaagtttgacaaacagatgtgaagcagacccacgttttttttctttttgttcacaaactttgtaatagaaagaaaccggaagctccattctgggtcatagtgaaggcagaactccacatatgtgcagcatcactttaaatctgccagtgtcttataatgggcagaattgtggaacaaaggagccatagccttagacattaggtaattagaatgatggttatatttatcctttcatttaaaatattcaggaaggaaaacttccccaattttttcagttgatattattgtttatattatagcacaattgctttaggtcttagaagctatatgacttgtaatgagaattataagtggattttagtttttagggtaagtttgcaaatagcaatagaataagaaacagtaactgaacttagatacataaaacattcatatttagctgaaatcttattctcttcctttgtctgagatgaacacacaccattatgattgatgagaaatataaaaaataattagattatatctttttgatttatggtttcactttaagcagaatgccctccccttccccatttcttttctctctcacctgttttagccactttattttctacttgtgaacttctcatcttttttccaaacctttcttagtttgtttttatattattattattatttcggtgatattcctgcatctgtcaatgttacttggtacacattatacagtatttcttaaaacagtaaagtagcaatttaataagagacagcccagatgccaaccaagcattggagaaatgcctccttcagcactaaagttaagagttggttaaatggttttttcctccaacattttaagtatgcataagaattattaagataaatataattcaattgatgcttttaggaaagattagacttctctcataacaggaccattagcctaaaggttttggggtgatcaagaaacagtcttacttgatgtttaaatttagaatgctaacataacaactagatgatttataattatgaacacattaagagttgtcttctgaagtggaataagaataagcaagcaataagcatagtattgtagacctggagagaaataattgtataaattagctcccccagagtcattaagttacaggggttgatccttacctagagaataggaaataccttcaaaagaatgttatttaatgggatgtatcgattcaaaacacaaaatgaaatgccaaagttgtacagagaagaaaaagacaacatgtaattaatgtggggagagatacgttttgagggggaaaaaaactagttacataagtgtttattatattttggctattgttcactaaaaatcatacatgtctaaaatatttgcatgtaatatgagaaatttgaggtaattttcccattataaaatttagcactaatcaggccacctactgtggtgatcacttttagtttccaaaatttgatgaaataagaaagcactcaagatttaggaagaaagccgtaaagataataaaggactggaaaaagaagtttgatttaaaattttaaaaggatcatttacttagtcatttatgacaacaaatgatgaaaagttattttatttaccatgggggcttgatattctctgttaaagcaagaagaattagctttgttatgatatgtaattaataattgtaaaaaagacaaatttctaaatgaaggatgttaaacattattattagtagtagtattgttattattatttttttgagatggagtttcgctctgtcacccaagctggagtgcagtggcgcgatctcggctcactgcaacctccgcctcccaggttcaagcgattctcctgcctcagcctcctgagtagctggcattacaagtgcgtgccaccacacctggctaatttttttgtatttttagtagagatggggtttcaccatgttggtcaggctggtctcgaattcctgacctcgtgatccgcccacctcagccttccagaaacattattcttaagagatctttaacgaaattcataacctatcactgacatttaccatgtgaagaaagttacatgcattccttatggaattttagggaaaagccagtgaatttccatcttttggagactttgcagtgtgatagataagaatctaatctgctcaacctaatgaaaacaaggtggtgctccagaagtacattgaactgaaactgactgaaacccacagtttatgatgtatttagcatttagggtgtttgggcactgtgtaaaaaatgaccatggacttcagagaagttacattgaagggataataaaacgtgttcagttaaaaacacaaaacaaaactgggccccatccattgtgaaacatagtccatctacatcctcagtgtcagctaagtgaggccttacttaatgtttaaatttaaatgttaaagagaaggcgatttgtgggatagaatactgggaatggtcaagtgtagttcagtgctcttgtataatagcttgtctttattttttacttattttatttattttatttattttttgagacagagtcttgctctgttgcccaggctggagtgcaatggtgcgatctcggctcactgcaacctctgcctcccaagttcaagcacttcttgtgcctcagccacctgagtagctgggattacaggtgtgtgccaccacacccagctaatttttgtatttattgtagagatggagttttaccatgttggccaggctagtctccaactcccaacctcaagtgatctgcccgcttcggcctcccatagtgctgggattacaggcgtgagccaccacgcccagcctggtctttaattgacttgaatttggtgaggcacatctcatcagtttataaagattatcagtaaagatagtagtgataaatgggatttgttaaccatagatattattattggaaatgtgttcatgggattcttttacaaatattaatgtaatacaaaagggaagttttctccccaaggcaaaaactagaactctgattttattgacagcattttttttcaagcactaatggaatattttactgatacaaggtaaaatagaaaatattaataaagatctcttacaggggaagatatagctggtgtcatgtaacaatataaatgtgaagtttcatattattatcctataaaattaatgttttatatactggggaaaagaaagaataactattatgagctgaagtcatttacagaattaaaaatattttggaggaatcatatcaaaaagttataggtggaattaatcctacattactaatttcatgagaaattctactttctttagtaaacataaaagagagtagattaaatcacacaagttaaaatatgtgcttcatactaactgaaaaatctttcagattcacagacgtgtgtaactaaatagcattaaaataatatgagagtattcaatcattcaacagaatgaatgaccaagtattttaaacatttacaacaatatggcaaaaatttaagcaagcaaacacctgaaaatggcattttggggggattaaattcagcatcagcaaataatcaaaattataatggtaaataaggagaaaccaaataagaaaaagaaaagttagcaaatttgtgcttttgctagagatttaattaagcatagctttgttaaaaattctcagtccagcactagtttgtggcacctccaacaatagtactgaatagaaaagaatcaagttttaggtgcagttggctatttggaggctacactactgacaaatgaccagattagctattgcaggaaggttaactgggggccttatctaaaattttctatctgattacattaggagaagtaataaaaatctgttccaatcttaatttattgaaaatcagatgacttgggtcaataacagtgcagattaaatacattttcacttgggcactcctactacagtagagagagagaactaaggtcacccaccaactacctataaatatacttctatagtttcagcaaaaattcagttatttttttcaaccttttcttgctcttgttaaattatcttccttcacatgttccactgaacagttataaaattacctttttgatttaactttgaatctttccatttcttcgtatttctgttaaatgaataatgaagctctaaattgaacatcaaactctaatagtgatttatttggatgaaattctagaatagtttaaaagtcaatcagttcttttcagaccaaatccaggttgcattatgtgatgtttagaaattataaatagtttattcaccacaaagaaaaagaaagctatgcttaatctgggtagggactatctgtcctaacacaccttcgacatattttttttttaaaaaaagacaaaaatgcacttaacattttcaagtataatgaagttaccatgaaaacactcatattttcatatttttccccaaagcaaggctttattcatccaaatgataaaagacttttgtaattgcatttctggcctctacagttagaatgactttaacttgtctcatttattgataattttatgtgttgtgatagatttgattcatgtagatcattatccctacctctcttttttcctgaaataatatttgtatatgtctgtgttcatgtgtgtgtcttgttttctgactctgaaatgtttattatgccttagacagttaccccagggagattatgtaaaaaagcctggagatggtgactctttttatagcgacattcctcccggagtcagcacaaactcagcatctagttctaagaagaggtctgcttttctgtcgcattttcagatttctacctgttccatcacacattattccattagtcagaacatttcattattttgcagcaggtttgattacttcttccttctttcttgaatgttaaaaaatagtatcctttgttctttgattactctacttcaaaatgccatatgctcagaaccactcattatacaaatcaggccacaaaatcaaaacaaagcaaaccaaacaataactctgaatctatatagaaacctcagggtttttcagtcttgctttatatggcttaagaaactatacatagtatttaataatatttaaatggtgagctttatgtcatgtttggtagtcaaagaaaaaggttactgtcatgcttcaataaaagcaactgttaaataaattggtgatataagtgctgcattgagtattttttaattttatatatatcaaagctaagctcgctatgaaacaaagattgcttctctgtgaatcatatatttgagtattgtgattttgccttttttggggggtgattatttctagactttataagttacaacttagttgacaaattaagtgtgcttaattttgcctgagttttataatagtacaggtgggattaatatattatttatgtcttagacactgatgctatattcttattctagcatcttaaggtgtatgacaccatttaaaattctgcatgctttgtaactgcttaataaaataaatgaaaagaagaaataaatagttggcatgttttaggaaatgagacctatgttcacattgaaggaagcaaaaatattcttgtgggagaatttatttatttaaagttgccaataagagtataatggacaggaaaaaaggtttggtagccctgctcatgcctttgggcacattagctacttttcagagtgaaggggaagatgctagtttattggaggaaacatgacctgttccggagttctgtatagagtggatcatctgtaaatattctgcaatgtctctcagtctttgtaaatgttaatcaggaaggagaatagaaggaattagtgagacctgggaactctactttatgtggaactttcttaagcatgaaggataattttcacttagataatgtagcttccagcaaaagtagaaacactagttgtcgccaaaggagtatgtttctacagaataatgttttaaaaaatgtattcttttaatttatggagggcttgttggctaagagaagactagggttctacttgaattctctgatacaaatattttcttgatagaatattaaattttaaattaaacaacatggtaaattagtggagaaattaatggtttccagcagaatttctgttgttcttttgtacaaaatatgagtcattctgtgagtagcaaatgatgttgagaaattccaacctagggaattcatatggagtagttgtgctgagttccatttattttcactgatcagtagaaggctttttttgaaatagaaattatttctattattattccattaaccagattccattaaccaatattccattaaattattccattaaccagaataatatgtggaaaagatttttaagtatagtgctattttctaaagttcctataaaagagtttaaaatatccatttgaataattcccagattttagaaaaatctcagtgggttatgattcttaagcagttaaaagttcttaagatttctctgaagtatatgtagcttgttaaaattcttgtgtggtacaaggtaggtgtgtaaattttgcttcttttagatcattcatttaaagatggtaggacacaaatagcaggtgggctcaatggtacatgggctttgtgagaggcactgtcatgataaacatctgattcagttcagttattgaacagttagccaacatgtactacacttttttggaccatatttgtggagaaaaatgccaattcttagaaaataattttattacttaagaaaatctaaataatgctttgataaatgttaaccaggttcacttgagcaaatctttatgtaatctcttggaagtccatgttctcataatatttgagtggaaaccattgctttacaattaagaaacatctatggtgggaccccattataactctgctgctggggtgatgctgaaatacatagtgaatttgctctgtggttgctgtgttctggggaatgtaaattggcttgcattgtgtcttgatacttttcatttatatactattgtaatggggttccattgtatttgacttttcttaaattggatgttgtgtaattctgccttcttcatgaagactttcatgttctcttcattctttcatttcagattttttctttcttgatttattttatttaatgcacagtaatgcttagaagttttgcttactgatctcaaaacattcatttggttacatttttgaacaatttatcaatattttcaatttcaggtcaaatgggctctctcattcttggagtgaaaggattccagacacaaaacatatttcagacatctgtgaaaatgggcgacctcgaagtaactcttggcaaggtagaggctggcattctgaatctgtctgtccacataatcaagttctatattctgtggcccctggttgtaaagacttttatttctttgaagctctttagctcttctcccaacagagaggagaatatgtagaatgagagcctagtttttatctggatgggaaatgatgggattcggcagcaccaggacactagacactttgtgaaatttaatttgagaaagctgtacagtgtgacaaacccggtgttccacagtggtgctgcttatcaattatacccacttgaaatgcctcgtaattagacatagggcaatcacttatttacatggaaatctagctctaaaccgtctttttcaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgtaaaccatgtctccggtcttggttttgtcttttaaattcttttttgccctttaaaaattaaccatggcttttctctcttacataggcatctccacaactgttcccataccaatattcattgatagtgggggtctcacctgcaggctttttcctccagtcacctgccattgtggggtcttggttctatatgaagggaatttgataacattcctttcttctcatcatctgggattcaaccatttcaaagggtcacccttcctctccccaatactcacacagccttgtaagcatcggggaaaaattcccattgtactagagcatgatactgctcatgatctaaaaccaccactatgaggtcttcatggctgcaatctaagcattctctcagactaatggaataagtttcccttttaaattttctatctgagaacatttaaaagggcattttcctaaacttgctctttaactgaatcattgtcactaaatgcaacattatccgttttaaatgatagccatgcatttactttttttttaaggggggtgggtttagaagtcacatttaaagtcatttataatgaagtaaataatgtatttgttttgtttgtttctccacttaagaaagtacaagcaaaacaaaacctcctcaaatctttatctcccttcatggaataaaacacatccttagtatccttttggactgaacttgccacctgactttttttacccattctattttatccttcctaaaattttttacttatttctcactctagcgatagttattatttccaggatctctattgcttcttcatgccttaatatttggaaagtctgaatagcaggtatttgttaactgcttgtcaaaaacttatgttagcttttccgtcatataccctgcctttttcagtccaggaataataacattgccctgaaatttggaccttccacctgaatggtattgtcttgtaagtggcttgtcaacatggatactttatagacacagtagacaatttcaagtgataccattgcatggtccagaatggcatcatagaattccatcataaataactaatgtgttagagtttatcttatatattcccaaagcgcttggatgctttagggctcattgttgataaactcttcttggaatgttgtttggtttgttttgcatgaggtcacctagtaagagctccttaacttattttagttgctcacaggtgtacagataaaattgcaaaatgttctttagaacttccttgtttactgtttagtgttctaacagcatttcctataacaagacttcaaaaactcctaagttaaaaaaaaaatcagtattatgttaaagctatgagcttaggacctaacgcacatttggtgtttaacaatattcatacagtgttttctagagcagttacttatttttttaaatgttgtgtataatttccactcacattgtatgattaaaattgtaatactacagatggcctttgagaaatcttgcctatgagataattaaattataatatttaatatgacattataataggatcatctttatgagggagaagtattaaggacttcctcagatttttcagacttttctgattttggttacatgactcatgttaattaaatggatccaagtctgtaaagctgaccataattctcacataccttcttgtataggaactgtctctctatatatacacatgtatatatacatatatatatatatatttatacatacacacacacgtatatattttcttacaaggattcctgataggtagcatatcaagaattatgtttgcaaacttttaatactttccatatttaagtaatcccatttgcttctgatagtataataccatttgtgtgactacaagaggagcagaattaccacagacaaatatatcttttatttttttcatataagaggtgtttcaggtccattactcaaaattccctttagtacctcattattccaaaagatgatgaaaa

SEQ ID NO: 13186 - DNA, 251769 bp, Human; identical to SEQ ID NO: 13185

SEQ ID NO: 13187 - DNA, 266748 bp, Human
cttgcacatacatgtttatagcagcacaatttacaatagcaaaaatatggcaccagtcaaaaggcccatcaatcaacgagtggataaagaaaatgtggcatatatataccatggaatactattcaggcataaaaaggaacaaaataatggcattcgcagcagcctggatggaaatggggactattattctaagtaaagtaactcaagaatgaaaaaccaaactttgcatgttctcactcatatgtgggagctaagctatgaggacacaaaggcataagaatgatacattggacttggggactcaggggaaagggtgggggatggtgagggataacagactacacattgggtacagtgtacactgctcgggtgatgggtacaccaaaatctcagaaatcaccactaaagaacttattcatgtaaacaaacacaacctgttccccaaaagcgattgaaatacaaaaataaataataaacactcggaaaaaaaaaatagcctcaagtaactactggctacagtatttgaaaggcacacctctaaatcttaatttttttcctttctaaaatgggagtaggcatgtgcagtggctcacatctgcaatcccagcactttgtgaggccaaggtggagcccaagagttcaagagcatcctgatcatcatggggagactcttgtctctacaaaaagtaataataataacaaaaaatagccaggtgtggtgtcacatgtctgtggtcccagctatttgggaggctgaggcaggaggatggcttgagcccaggagcttgagctgcagtgagccgtgttctcaccacttgcactccagttggggcgacagagcaagaccctatctcaaaaatacatacatacatacatacgtacatacataaatataaaatcagagtaatagttataatcaaattcttgaccaaaggatcagataatacatgtgaactttgaaaaactaaaaaatacaagtattactttatgtagataactattttattattgttttatactcaagaatttctatcattttgaatcagaggaaaatggaataagcagcctgagaaaactgagttccccatatctggtagagttttgaggctgtctggcaataaagaacaaaaatatcccgtagagttaagctaaatcatccctctattacctgcagagaccttccctgggaggtcctctttgactccctggactgaattaatggtcctctaggtataaccatgacacttttcacactgtattgtaaaaaaaagtggtctgtctgctcaactttacccaagaacaggtgcctctgatccccgtgtccttccggttgtcaaccgctgggtacatagtatatcctcaatctgtatttgttgaataattcactagcactgtattcgtgagggtatggttctccggataacttaagtaactactaatctgtggtaaacagaacagctctttaaggacgatgcagatgaatactggctgctgtaacggcccagttggtgcatctcggatgccaggaggcggtccagtgctgatctctttcttttgcccttccctcccgcccttccagtctgtgggatatagaggacctcacagtcacgaggtcgcgacggtccgtgccgtcgtggagacaagcgggacacggagagagaactacatttcccagctgactctcctgcgcgcgcccttgcctgcgcgcggggggcgagtgcaccgggcgctcgctccctgccgagctcttgtcgcccgcccgagcctttgccaggggatgaggtgggaggcgctagaaaccacttagctacagccaaccgcccaatgcagcactcgctcgctccccccgccagcggaagcgtccgcgaagcacaatgcagcactgagccgcggtggaggttgcagcgccacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggtaagttagccgtcctctgtgcctttgggccataccatttcccgggaatctttggagccctcaggcgtattgaaaagggggcatccccatttcccgagtgcgcggggagattttttttttttttttttttaattcgggagggtggtgagaagtggagcaaaaatatatgtgtggaggcgcgcagatgcactggaagccttcggtcaaagcctgtttttctccttctgaagaggaatggggagaatgggaaaggggtgccctgcttctgggccccgctcctggttgctctcggatgagctggtccaaggctctcgggctggtgtctctgcgtccttcccagttgggttccgagagggagggggcggtggggattttcgtaggggagacgtaggactgcaggatggaggagtgagggtcagggtcattattttcgccttttctctccactccctcctttcccggttcctgcctggaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcaggtgagaggctcggtccgggaggtggtcctccgcgcctcccggcccacccgagaccccacgattgcgctcggttgccctggagatcccatgtcttcttgggtgaaatgagttgggtcccgatgcgagtcatgcatggcgctccctgtgcaaaaaagaaggggaaaagggtacaaaaaagaaccaaaataaccacaggccgagggctttgcccgaggggagtttgtgcggggtgccttcagcagtgcggtgagctgagagaacaggcggagagccctctgacatctgtcaagcaaaagccaggcatgcacagcgagaagggaggtagtatttgggcagggtttgaatcatcattgttgttgttttactcctcaaagagacttcataagtgatttaacccaaggttgacactgtaagaaaaaattggaaaaaaacaaggctagacgttcttaagaaacccaactgtaaaaacaagctgaactttaaggttctattcgcacacatttgtggacaccagagatatgcccattcacccctaccttctagaaaaggtgtcctcctccgactttctttattggtagcagttctcttggtttaattagggctgtgctgtttgttgagcatttataaattatgtttttaaaaatctagtttttatcactgtatctgtatttaaatcaagatcacacattcacagatatgcctgaaaattactgtgaatttattgacaaatttaagtaaatacttctggggctgtgtatttttttatttctacacatcagctgatcaggcagttcacccacctgtaagtccatattaagataggacttgttcatgtacttgaaaatttttgtaaactttactgaagcaatggcaagccaaaccttttcacatgtataaatatattcatcagtgctttaagatatatcttgatgatgtgataattatactaacttatctgtatgtgtgaaatatgtaaaaatagaaaatattacttaaatctgtatttgtagccaagtagttggtactgttaacattttgttaatagaaggtgggaaattagcttaaagggctacataatatccatcaaagattattttagtagaaaatcccaatatgttaagcttttaatgatggattcttttatgtgaattaatggttggtaaatgcctattttccttttccattttgactcgtttcaatggtaaaactgaagaagcaggggccatagtttccctatgtcatcgtatttttcaattaattaagattatttctgtggaaggatattttcacaccatttgcaaccttttattataaaaaatttcaaacacaaaagagtaggataaattaatgaacccccagctccaacaattagcaactcatggccaatcttgttttgtctataccctacgtatttctttttctatttcctttccctctctatattgtattgaagcaaatcatatcatttcattcataaaaattataggaatttaccactaaacagtaaggattcttttaaaaatgcaaccatgttactgtattttcaaaaattaggagtaatttcttactactatcaaatatcctgtttttcaaatttccagttctcgtaaatatgtatgtatatatgtatatgtatgtgtgtgaatgtttatatgtgtgtgtatatatattatatatatatatatagagagagagagtatatttagagtatatatttaagtaagtttgtctggaccaggacccagataatgtctgtagattgcaattagtttatttatttattttttgtgacagggtctcactctgtcacccagacaggagtgcagtagcacgattatggctcacagcagccttgacctcttgggccccagtgatccttccacctcagcttcctgagtagcttggattacaggcatgtgccaccttatctggctaattaaaaatttgtttttgtaaagatgggatttcaccatgttgcgcaggctggccttgaactcctgggctcaaatcatctgctggcctcggcctcccaaaatgctgggattacaggtgtgagttgtgggggcctagcctgtttttctgttttctaaaaggtcttttaatgtgtggttctttcccctctatttcttttttttccccttgcaattttttcagtgaagacatggagtctttcatcttgtagagttgctcagagtcaagattttgctgttgtagccagtgctttaaaacaattcacaaagactttctaggagaggaagagagactgagggaagaagagatacagaaaaagaaaatgacaggattgaacctggaaactcacagaatctctgactcatgctggaaatgtctttgggtacctcttgccttttctgtgttggtgaaagaccaccacttttgaaaagtggaggaggtcagtcctccttttctccccatttatggagcaccacttgtgcagttttttgattcacaggagtcttgacttggggtggaaagctattttgggttcatagagcttctactccctatagcaataaacatcacaatagagaagaatgactggtttttggtgaagtatgaatgaattggtaggatttaggtttaaaagtatgaatagatgattaattcaagtcagaaatgaaagcaatgataccatcttatagtaattattacaaaacgttatcccagtgcctgggatatgtgtacatagtaaggtacacatagtacatgttgatgtctctatcacttgggagccactgcactttaccatgctgcttaaactacaggtggaaatcattgacaactaggaccaaatctgacaaaattttaaagacctgtttatcttaggccaacttttcctacagttaggaaacagaggagttttcttgcactattggcatttctagtttccctaagagcaatcattggattgaaaaacataagttgattttttatggcccttgttatttctctaatacttaaatagttctaatttatggcattttaattttagatacccatagatttttttttttttttttttttttttttgtgagatggagtcttgctctgtcacccaggctggagtgcaatggcgtgatctcagcttattgcaacctccacctcctgggttcaagcgatattcctgtctcagccacctgaataactgggattacaggcacccaccaccatgcccagctaatttttgtattcttagtagagacagggtttcaccattttggccaggctggtctagaactcctgacctcaagtgatcctcccacctcggccacccaaagtgctgggattacaaacatgagccaccatgcctggccacccatagatatgtttatcaacttcctttctacttcataaataaaatcagggtgattttctgtgaactcaaaaagcttatatagatttgttgatttgtttctttaaaaggcatttatttatttattttatttatttttttcttttgagatggagtctcactctcttgcccaggctggatggagtgcagcggcacaatctcaactcatggcaaggtccacctccctggttcaagcgattctcctgcctcagcctcccaagtagctgggactacaggcgcgtgccaccacacctggctaattttttgtatttttagtagagacagggtttcaccatgttagccaggatggtctcaatctcctgaccttgtgatccgcccaccttggcatcccaaagtgctgggattacaggcgtgaaccaccgcggctggcctaaaaggcatttatttatttgtgctcctactctgtaccaatttttatgcaagactgtgggcatttagagataaaagacacagttttcttttaaggaattcttaaagacgtggaagatgagtgggtgaataaacagttatactttgccttgtgattttctggaggtgatcacagaggccagcggaggcagagaaggctagtacttaacccaggtgagcagtcagggtgggatctctggggaagccgtgtttcaagggtgagtttggaattgctgcattaaaaggaagggtgagcatatccaaccaaagaggcagtaagtacataggtacatgggaatcagggtatgtttttgttaattgcaaatagtaaagatttcagggacagataagataaaacaggaaagcaaagagtagatgctgtggcactttcatgacttgctgaggaatttggaatttgtcctgaaggcagtcaaaggatttcagttaggagagttaactgaccagattcatgttattgtcagataatcctaattgttagaatgaataattttaatttcaaagagcacgtgactgtagctgtgtactttagttcactagtaaatgttcacataatctttaagaatcataagaacttagtaaatatactgaaaataactataaatgagttaatatttataatgcacttacaacaatgctgggcatagagtaagcactatatgagtctttgttaaataacattaactccttcaggctgcttgagtactatttagatattttatgacatcacttgaatgcaaaatggtgccttaattacctgagtttaacatagtcccagaagtatgttagaaattactcaaatttatatttaactaagtggaatcaaatagtcctagagatagaagagaacttataggttatctaacctaattcaggaattacttttcacttgttaagagcaagccattggctgggcatggtggcccacacctgtaatcccagcactttgggaggccgaggtaggtggatcatttgaggtcaggattcgagaccagcctgaccaatatggtgaaacccgcctctatgaagggtacaaaaattagcctggtgtggtggtgggcacctgtagtcctgagcctgaggcatgagaatcacttgaacctgggaggcggaggttgcagtgagcagagatggtgccactgcactccagcctgggcgacagagcaagtctttatctcaaaaaaaaaaaaaaaaaaaaaaaatcaagccattcaccaagatggatatgctgattaccctgatctgatcagtatgcattgtatgcatcaaaacatcactatgtaccccataaatatgtatagttattatatgtcaattttttaaaaggttaaaaagagtatggaaatcagcaatgtattacttaatgtttcagaaagcttccaagaactacaatgatataaaccacattaattttactcttaatgtgtccttgtttcaattttcatccccaaattgggacagaaaaattttagaagaaattttcattgtagttcttttaaatgttgacaatttgattggttttaaatagtaattctgttgatataagtacatattgtaagtgatttctttactgtatggttacttgaatgcatatactttatttttatcacaagtgggaggatcagcccactactgaaagcttattatgccacaaagtcctagaaatggtagtcaaagtaattatatttgactgtgggtagccttgctatcttcaaagttgtttacctagtctaaagtaatttcattcctggaaaatagcattcaggcctagaatattcaaaatattgagagcctttcttctgtcttgaaattatttgtgctgaaagaattgtatgtttgcaggtaaaaggataaaacttatacttttacctggacttctgtgtaggcaagatatcacctactgagtcttattgatggtttgatactactcattgtttgatacacataattgctattttttgaataagcaccttaatgattcttttttgtcaactaagcgtcacagatttacatccaggatgttattttgtggtttattttgttgtgttttcaccccatacatttttaatactttgttttttacccagtgattatatatttctacaaggagcaaaatttctttttgttggaagcctttgttgtcagtgaatagacgggctaacttttttcctctggctctttccctaggaagtgttatagcttcccaagtactaaagtgccaaggacatagatctacagtttgtcatagttttgataaccagtaacaaatgggaaaaatgccaaatggcagcaagatggcaagcagtaggtgtgctccatttttattgatgtacttatacatattcctgtgcatggatgagctgtactttacattgtgctgtttcattgaggagcactgagtcagcttgatggtaaattgtctgcagtactgcttccgtggcggaaaatggctcctaggaattacaactttggaagtattttgcgagggtagcacaaactttttttttttatactgtgcatttgttaaagtaagtggctcaatattgataaccttttgccaccaatcagaactttgttctactgctataaataggagacatttcacaatgaatttttattctcctaccaaccatcttcttttccaattaaattgtaaaaaaaagtaaaattcagaatcgtaggagtttcccttagtcttgtttttatgctatgaaatcccaatttgtatatatatgtatttttcgtatctttaaaattctacctaatgaggttatggtgcacagaaggaatcagtctttcatcacttctgtatagctacacataggaaactaactatgaatgactctaagagcttataggttgataaaaaatgttcctatttttatttgctttctcatattgcaaagaatgccaagagttctcctgttgtttttaacaaatagagtcccttagaagaacttggagagaggcctgcttttttctcacaacacactgagaacaggaatctgtaaggtcggtagtattccctaactccagtggggctaattagatagggccatatttatcattaagtagcatggataagccccaaagggaaagaagatagatgttcataaaagtggggctgggggatggagcagaagaaaaggtagagtccttgaggggaatggtgagaaggtggaaggaaaaggaaatgataaaaagagaaaaatacttttaatagtgtcactatatatgttatatactaaaatagctaaatatatggtaacttacatggctaccttttatgtgccaaatggtcttctgaatacttgatgtacattaattcattgcgtcctcaaaaaaatcatgtgtgacaggtaatacttatctgtaaagtcacaaagctgataggggatttgaacctaggcacttcagctccaccgcactgcctatgtgcttaactactatgctagactggtcttatggaagggggccaccaacgattctttagatgccattaaatgttgctggagtcagatttcttacatttaccccattggaactatatatgacttttagtgcctgaaaaatatatacattttaaagttagacaatagtgaagaagcttgcagagcacaacaggaatgtttcatttttattatcttgaaaatgaaaatggaatttgtgaggatatctgacatttaaatggtgaaaaacacctcttgaaggacacgtgtcctatttgtttgtagatatgtacactctctgttacactcgttcatcgtaagtcacatattagtattcagcaatcaacaccaaaattgtatatgcctttttgtggtcaaagtttcataggtagaaacattaattgctaagcagggatccatattcatatatttttctccaaaagaaaaaatacaaagtatcttttatgccttcatagaactagcagtaccagagtcccaaacgtgatatcattcaggtaaaagagatatgtaatcaataataacaaaaaatgatagcttctgaaaacatgtagttgaatgtgtttactttgataataaaagcacttgcaagcaaacattgggggaaatagttgaaaaaataaggattagtatttattaacttaaataaatataaacatttataatatataagtataaatatataatatatacaaaatataaataatatataactttttttgtcatgtaccaggcattgtattgagtgatttacatgcattatctctcattatgaggtagatactgttatacccatttgaagatgaggaaactgaagttaattaacctgcctaaggttatacaggtaataagtggtagaagtgggaataggattctcaaaatgttagacatcaacataaaataatcttttataatctttactacttatttgacatgtggtttcccatttatctctgtgttggaacatacctaacgttatttcttggtctggcccaggtctcctccctagctaacttgcagttattttacatataattaaaatagagtacaacatgctgtattttttaaaatagaaatattttatataaaaatgatttttgacttctggctatcctttacttttgattttatcattagagttccttttaaaatagaagtttgttttgtttcccccaggacagactgttctctgtaacttgattttgaaaataaaattgaaaattttgtaccatgatccagaaatatcagcggttctaactggaaagagaaggaataaagaacgtaaatcattctcccctacccctaaatatgcttgttatttgtgttgaagagattttcagaatcatgtatcagcgaggttaaatgaacatttttcttctcctttttaaaatttaattttgtactaggggattttagcacttagcaataattgcccttttgttgcattttttgtctcaagtaaagattgttagataactctttgaagatgagaaatcgatggtgcttttctgcagataggccttgagagctcacattttgcaagtgattttaaaattttctagctgaggcagaactcctggttgagttgtgtgagaccacttattctgcttcacactgccccatgtctctagcttttacctctagttggtcaatttctattctgctttattttttttttttcaatttgccttttaagtaggtttgtttcggaggaattgccttcatttcctccactagtgaggttaggggatttgaacctaggcacttcaaggttaggatgaggttaggatgttgggggtcaggctggtacacacaatttgctggtacacacaatttggtcattgctcaagcttttttctctgtgtggttttctttctttggattaaacagcatgatgctacaggaagagctaccacttgacagaacctggttctgcagatttctttgatttccctagtggatttttaatgcctttgggatatcctgttagtgttctgttgaggaactcagctgtggctcctcagcaggcataagtggcagttgaggctacacatagcttggtggtattaatctaaagtaggctggagagggagcgaggcgagcagttacctgaggaatgatctaggatcatcagatatggtcaggaacaggctgtaggtaaaagggtggtggcaggtgaggctcagggaaatcagagagcaaatgatcaagagaagatactaggctggtcaggtcagtatccttctggctcaactagaaagagctacctgaaagagtctgaagcactttctgagtttctggctccacccttgatctgtgtcttaggtctttaaagggaaacttgtgttttttttttttttgtttttttttttttagtcagtcttgttctcatccacacatgagctttaagtattcggttcctcctccttccttcttcttcttccttcctattctatatgtgtgtgtttttttctttttctttttattatttcttcctcctctttctttaccttcttgtctttcacctctttcttcttcttggtctttgtaaaggtctgcaggctagtgagagaatgctttaaggggcttcacacttctccccattttacagtttagactttagacactgtgccttgcatggatcaggagatgagaccattaaatattgatttcctaatttatgcaggagtttttcatactctaaaaaatcagtttgtacaaaatgagcaacatcttattttgaatagcatgtggtatgtgttaaataaatgtatgttgtgtaaatgaagagtccctaagttagaatttggaaaattcgttcttactgagatggataattttggtgtcagtcatggtttgccatagattgtgaattttcaaggttggtattagctgcagcttacaaatagttaggaatgctttcatgtgccttccagaaaaactttaagtaagtgtttaataaggataggattttgaaaaacagatatatttacaaatttgccagtatgctgaagaatgaagccaattatttcttttcttttctttctttttttttttttttgagatggagtctcactctgtcgccaggctggagtgcagtggtgccatctcagctcactgcaacctccaccctccgagttcaagcgattctcctgcctcagcctcctgagtagctgggattacaggcgcctgccaccgcacccagctaattttttgtatttttagtagagacgggggtttcaccttcttggccaggctggtcttgaactcctgacctcgtgatccacccgcctcggcctcccaaagtgctaggattacaggcgtgaaccaccacgcccggctgaagccattatgtcttaggaagaactttattgactttggtagaaaccttaacatcatcaaagatgatgaaagttttggatgtatatccagtaatagactgctggattgaatggtagttctgttgtaagttctttgagaaatttccaaattgctttccacagtggctgaataagttcattcccaccaagagtgtgtaagtgttcccttttctccttaccctcatcagcatctgtttttttgactttttaataatagccattctgactgatgtgagatggtatctcattgtggttttgatttgcatttctctgatgattagtgatgttgagcattttttttacttgtttgttggctgcttgtatgtctgcttttgaggagtgtctatgtcttttgcctatgttttattgggattatttattttttgcttgttgaattaagttccttatagattctggatattacactttcattggatgcatagtttgctaatattttgttgaattctgtaagttatctgtttactctgttgatagtttcttttgctgtgcagaagctcttgagtttaattatgtcctacttgacaattttgtttttgttgcaattgctttgaggactcggtcataaattctttctcaaggccgatttccagaatggtgttctctaggtattcttctaagattcttatagtttgaagcatcttgagttaatttttatatatggtgaaagttaggggtccagtttcattcttccgcatataactagccagctatcccagcattgtttattgaagagggagttctttccccatggcttatttttgcccactttgttgaagatcagatggctggaggtatgcagctttgtttctgggctctctattgtgttccactggtctatgtatagccaaaagaaaataaatcattctaccaaaaagacacatgcactcatgttcattgcactattcataacagcaaagtcagggaatcaacctaggtgctcattcatggtggactgggtaaagaaaatgtggtacatatataccatggaatactatgcagccttaaaaataatgatattatatcctttgcagccacacagatgtggcgggaggccattatattaagtgaattaatacaggaacagaaaaccaaatactgtatattctcacatataagtgggagctaaacattggatactcatggacatcaaaatggcaatggtagatactggggactaagagagaggaagggaaggagaggggcaagggttgaaaaactaactgctgggtactatgctcagcatctgcgtgataggatcattcatatcccaaatctcagcatcactcaatataccaatgtaacaaacctgcacatgtatcccttgaatctaaaataaaagttgaaattataaaaaaaagattatgaaagctttgattcagggctacaaaaatgttctcactttttatgatcctgtatagctggtttagctgtaaatagtacatagctttttttctgaattatttcctcgtgaaagtaccttctaacttggacagatattgagtgataagaagataggggaaattcaagaagtgttcattcctgtcaccaaaggtgaagccattctggctaggtaagttactagaggtaagactatgtcaaaccacagtgtatagcagttttcattgactctcagaatcctctaaagtaaaaaaaaaaaaagtggtggggagaggatattggtgccgagatactaagaattttcacttaatttaatttctgagacaagtttagcatgatgttcttatagttcttaataatcttgaatagacaatgttctctcatagttaacgagggaaaagtactatttattcataatcaatttaatatgacatctacttgcggtctttgatgagtgttttgggtgttttcttaagtgttctgattatgaaatgatgaactttgcagttattgtagggttatggaataaaaattattttaatttaattacacgcaataacatggaatgaaggcatggaccctcatcttcatttgtatttctttccatcgttgagcacagacagagccttgtacataacaggtgctcaacaagcaaatattgactgaatgaaattgttgatgccatgacttatagagggccctgtttcttcattaatgctcccatacccccaacattacatcaggttttccctggacaattgtttcttctcttttttcttcttctctttctttcatcatccctcaatataggctctgtcactttcctgcagcctctttccattttcctgtgtacatagctttgctcttttctcattcggtatgacccttggtttattttgtatttccccccactctatttctgccaagcgtctctttctctatgcaactaaagtaaaaacaagtctctgaaaggttatttacattcagtgttgggaaccatccctgtagcacattgctggacttattttgggatttagaaaatgtgttataattcaacacgctttccattttactacttacttgtaaacctatattttgtgaggtttttctttttttccattcatttgtttctgttgtgccccttgaattgctcctcattcattctcctctgtggatgtggattttaatgtcccttctgccctttattgctggaataatctccttcctaaaatcattttcctagttctcactgctcataatcccctggatttaagctttaaattatatgcttagtttaccctctacatttgctgatcatgtcatttttcaaagtctttgacagtaatccattgctacaggatagggatccattgctacattgctacaggattcatattcagtataaaggaatgaccaggcatttttataggtattctaaaagtaaaatttgcctcataggcttggcataaagttgtgcatgcttatgtgtccattaaggaggggattggggcgccgataacttgggtgttagtagaaggtgttcttatgaaacagattgtaatgttgggctcacaattggttattcatattcactattgtttgtgcactgcttagcactgtgcctgacacacagttggtgctcagtaaatatttatggtctacttttgtttcaattttctttcaccaaaaatgcaggaaaaaagttctgtgaccatttgttagtgattgtatgtacttttgagatagttccaagagttacaatatttattttctctggattatgtaatgctttcgttgggatggcatggagaggatcgtggacctcattctacttttatggctaaagccctaaattctttcctcctcttcctgcacttatacccctcctggcccagcagagccagggcctgtgttggtatggccgggctctcaaggtgagtgtttgaattgaagtagctgtccctcttgcttcaaatctgagtcaggatttattaggaaaggcaaagcctattaggaaaggcagggccatgatgacgaggggagggagacagccaaataaaatgacaggaacttggacaatgattggcatactgacgttctaccacataaagtctccttgctgtcttgaggccactataatcactgtgacaaaatcattcatgtcactttatagccctgtcttttccaacaaaaataaattcaagctatttaacctttttgtgtgactttattcaccagactttgtcattcgctgcctggagctgcattttctttaagacaatgatgtatgtcttctgagagagtgacatctactatttctgatggatttgaattcatatggcatattcagccaaggatttcccttactatttatttttagggtttgatttttttaaactatggttttgaactaaggacaacaaccttttttttttcctatagctaagccccagatattttgtctaaaaattaaaaataaatttctagtttttatcttacttttatggactaacaacctaatctaaaatattcatattatttaatatggattaattatgttaatataaatttatatgtaaatataaaatatagataataaaatatgtaagtttaaacgtctattatataaattataacattgattaatatgttaatataaaatatttatattcttttataacttttttatttcttaggaggtggatgttacccatactccatgaaatcttcatgcctctaaaagatcttcatatactagtttaaatcagaaaaatataccagtagagaacaggcacattagtataattagcttcaagaatttatatctcagtgtaaaaggaggctgtgaaagtagctttgtaatgtttctttttttattattattatactttaagttttagggtacatgtgcacaatgtgcaggttagttacatatgtatacatgtgccatgctggtgtgctgcacccattaacacgtcatttagcattaggtatatctcctaatgctatccctcccccctccccccaccccacaacagtcaccagagtgtgatgttccccttcctgtgtccatgtattctcattgttcaattcccatctatgagtgagaacatgcggtgtttggttttttgttcttgccatagtttactgagaatgatgatttccaatttcatccatgtccctacaaaggacatgaactcatcattttttatggctgcatagtattccagggtgtatatgtgccacattttcttaatccagtctatcattgttggacatttgggttggttccaagtctttgctattgtgaataatgctgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcttatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcaaactttttgatggggttgtttgtttttttcttgtaaatttgtttgatttcattgtcgagtctagatattagccctttgtcagatgagtaggttgcaaaaattttctcccattctgtaggttgcctgttcactctgatggtagtttcttttgctgtgcagaagttctttagtttaattagatcccatttgtcaattttgtcttttgttgccgttgcttttggtgttttagacatgaagtccttgcccatgcctatgtcctgaatggtaatgcctaggttttcttctagggtttttatggttttaggtctaatgtttaagtctttaatccatcttgaattaatttgtgtataagatgtaaggaagggatccagtttcagctttctacatatggctagccagttttcccagcaccatttattaaatagggaatccttttccccattgcttgtttttctcaggtttgtcaaagatcagatagttgtagaaatgcagcgttatttctgagggctctgttctgttccattgatctatatctgtgttttggtaccagtaccatgctgttttggttactgtagccttgtagtatagtttgaagtcaggtagcgtgatgcctccagctttgttcttttgtcttaggattgacttggcgatgtgggctctttttcggttccatatgaactttaaagtagtttttcccaattctgtgaagaaagtcattggtagcttgatggggatggcattgaatctataaattaccttgggcagtatggccattttcacgatattgattcttcctacccatgagcatggaacgttcttccatttgtttgtatcctcttttatttcattgagcagtggtttgtagttctccttgaagaggtccttcacatcccttgtaagttggattcctaggtattttattctctttgaagcaactgtgaatggtagttcactcatgatttggctctctgtttgtctgttattggtatataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaagaccctttatttccttcttctgcctaattgccctggccagaacttccaacactatgttgaataggagtggtgagagagggcatccctgtcttgtgccagttttcaaagggaatgcttccagtttctgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatatggtttttgtctttggttctgtttatatgctggattgtatttattgatttgcatatattgaaccagccttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggattcttttttattggtaagctattgattattgccacaatttcagatcctgttattggtctattcagagattcaacttcttcccggtttagtcttgggagggtgtatgtgttgaggaatttatccatttcttctagattttctagtttatttgtgtagaggtgtttgtagtattctctgatggtagtttgtatttctgtggaattggtggtgatatcccctttatcattttttattgcatctatttgattcatctctttttctttattagtcttgctagtggtctatcaattttgttgatcctttcaaaaaaccagctcctggcttcattaatttttttgaagggttttttttttgtctctatttcctttagttctgctctgattttagttatttcttgccttctgctagcttttgaatgtgtttgttcttgcttttctagttcttttaattgtgatgttagggtgtcagtattggatctttcctgctttctcttgtgggcatttagtgctataaatttccctctacacactgctttgaatgtgtcccagagattctggtatgttgggtgtttgttctcgttggtttcaaagaacatctttatttctgccttcatttcgttatgtatccagtagtcattcaggagcaggttgttcagtttccatgtagttgagcggttttgagtgagtttcttaatcctgagttctagtttgattgcactgtggtctgagagacagtttgttacaatttctgttcttttacatttgctgaggagagctttacttccaactatgtggtcaattttggaataggtgtggtgtggtgctgaaaagaatgtatgttctgttgatttggggtggagagttctgtagctgtctattaggtccgcttgttgcagagctgagttcaattcctgggtatccttgttaaatttctgtctcgttgatctgtctaatgttgatagtggggtgttaaagtctcccattattattgtgtgggagtctaagtctctttgtaggtcactaaggacttgctttatgaatctgggtgctcctgttttgggtgcatatatatttaggatagttagctcttcttgttgaattgatccctttaccattatgtaatggccttctttgtctcttttgatcttggttggtttaaagtctgttttatcagagactaggattgcaacccctgcctttttttgttttccatttgcttggtagatcttcctccatccttttattttgagcctgtgtgtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatccttttattatgatgttagctggttattttgctcgttagttgatgcagtttcttcctagtctcgatggtctttacattttggcatgattttgcagtggcttgtacccgttgtgcctttccatgtttagtgcttcctttaggagctcttttagggcaggcctggtggtgacaaaatctctcagcatttgcttgtctgtaaagtattttatttctccttcacttatgaagcttactttggctggatatgaaactctgggttgaaaattcttatttttaagaatgttgaatagtggcccccactctcttctggcttgtagagtttctgctgagagatctgctgttagtctgatgggcttccctttgtgggtaacccgacctttctcttttgctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccaatcagacgcagatttggtcttctcacatagtcccatatttcttggaggctttgctcatttctttttattcttttttctctaaacttgtttcatttcattcatttcatcttccatcactgataccctttcttccagttgatcgcatcggctcctgaggcttctgcattcttcacgtagttctcgagccttggctttcagctccatcagctcctttaagcacttctctgtattggttattctagttatacatttgtctaaatttttttcaaagttttcaacttctttgcctttgatttgaatttcctcctatagctcggagtaatttgatcatctgaagccttcttctctcaactcgtcaaagtcattctccatccagctttgttccgttgctggtgaggaactgcgttcctttggaggaggagaggcactctgctttttagagtttccatttttctgctctgttttttccccatttttgtggttttatctacttttggtctttgatgatggtgatgtacagatgggtttttggtgtggatgttctttctgtttgttagttttccttctaacagacaggaccctcagctgcaggtctgttggagtttgctagaggtccactgcagaccctgtttgcctggatatcagcagcggtgtctgcagaaccgcagatttttgtgatccgcaagtgctgctgtctgatcgttcctctggaagttttgtctcagaggagtacccggccgtgtgaggtgtcagtctgcccctactggggggtgcctcccagttaggctgctcaggggtcaggagtcacacttgaggaggcagtctgcccgttctcagatctccagctgcgtgctgggagaaccactgctctcctcaaagttgtcagacagggacatttaagtctgcagaggttactgctgtctttttgtttgtgccctgcccccagaggtgtagcctacagaggcaggcaggcctccttgagctgtggtggggtccacccagttcgagcttcctggctgcttcgtttacctaagcgagcctgggcaatggtgggcgcccctcccccagcctcgctgctgccttgcagtttgatctcagactgctgtgctagcaatcagggagactccatgggcgtaggaccctctgagccaggtgcgggatataatctcctggtgcgccgtttcctaagcccatcggaaaagcgcagtattcgggtgggagtggcccgattttctacgtgccgtctgtcacccctttccttgaccaggaaagggaactccctgaccccttgcgcttcccgagtgaggcaatgcctcaccctgcttcggctggcgcacagtgtgctgcatccactgtcctgcacccactggctggcactccctagtgagatgaacccggtacctcagatggaaatgcagaaatcacccgtcttctgcatcactcacgctgggagctgtagaccggagctgttcctatttggccatcttggctcctcctctgaaagtagctttaagaccagatgaaaaagtgaggacttgtggtggagaggagaccctacattaaaagataaagatcaaatacagctgttgtgactttagctaacctaatgtaatcccaggaacaaaatagttcctatcttacttatatgtatttttataagaggtttattgagatataattcacacagtatagaattaacccatttaaaaatggtatacgattgagtttttggtgtatttagagaactgtgcagcgatcaccactgtcaattttgaaaccttttcatcacttcaaaaagaaaccttatgcccattttccctaactgcctcccaccctcagcctgggcacccactgatctactttctgtctctacagatttacttactcttgagctttcatataaatggaatcgtacactatccagtcttttgtgactggcttttttcacttatcataatgttttccagtttcattcatgttgtagcatgtatcagtatttcattcgtgagtagtgtttcattatcaatccattcattttgatggacatttgagttatttccattctttggctatttaaaataatggtgccgtgaacatgtgtgtaaaaaatttttgtgtggacatgtggaaacacacacatgaaagtatcgtaaaaattacttattcttattacatacagtggtatacatttcattctgttctgttctatttcattttctttaaaaccctgcctatggtgcactcaagtgatttcagagtcctttctgtgatcttacccacaactttaaaaactaccctacaggattcctcacaggtaagctcagtacctgtgaggcagccctttgtttagacatctctggctaaaaagattttagaaagttgaatcaacatgtgcctccttgtatgttctgtctgttactttttgtttcttgtagttttcctggcaataatattagggacatctggatggttgtgttacttatcccttagctgttctatggtatcagtgaaattgaccatgtgagggtgcttgtaaaactttcttcagtttgtttaatataaaaagcttaagttttgaaataattcaaacatacaaaatggtagatagaataatgtaatggacacccttgtacataccacccagaatgaacaaaatttagtgtggtttgtttcttttgcaagaaactaacgttatagattcagatgatgctctcttgcccttctgttttccccttccttctcagaggagatcattgtcttgcaactggtgtgcatcctttccgtctttgttttcttttcttcttcttttttttattgagatggagtttcgctcttgttgcccaagctggaatgcaatggtgccatctcgactcactgcagcctctgcctccagggttcaagcaattctcctgcctctcagcctcccgagtagctgggattacaggtgcgcactaccatgcctggctaattttttgtatttttagtagaaacggggtttcaccatgttagccaggtggtctcaaactcctgacctcaggtgatctgcccacctcggcctcccaaagggctgggattacaggcatgagccaccctgtctggtctgttttcatactttcatacatacatatatatccataacaatatattactgttttgtgtgtatttaaatgtctatcttttatagcatatatatccttttacccctcctcaaaattaaattttttgatctcttatgatgatataggtaaaagaattaaattcatttctttttattgctgcctgccttcccattttataaacatcatttattcattttcccattagtagtatttatagcgtatttattctgtttcgctgttataagcagtatataccatttgacatacacatttgacattggcatgagtttctatggagtatatatttggaagtgaaattgttgattcctagggcttgtacactgtcaatttccctgtatattgccaaatcaaatagtgatacagcaatttacactccactagcactgtatgcgaatttatgtatagtctccttttcatcattatctggaaccataagactttaaagtttttttaaattttttttattttttattttttttttgagatggagtttcgctcttgtttcccaggctggagtgcaatggcgtgatctcggctcactgcaaactctgcctcccgggttcaagtgattctcctacctcagcctcctgagtagctgggattacaggcacgcaccatcacgcccagctaatttttgtatttttagtagagatggggtttcaccatgttggccaggatggtctcaatctcttgaccctgtgatctgccctcttcggcctcccaaagtgctgggattacaggggtgaaccaccgtgcccggccgactttaaagtttttaacaatattgtgggtatgagatggtatctagttattttactttccattttcctgatgactgatgaggtagagcacctttggtgatctgtatttcctcttttgactggcctattatgcgttccccatttttcaattgaaatttttgtctttttcttgtcgatttttggcatttaaaaatattctggattattctctattatctgtatagcaaatatttatttatcttttagtttatggcttatttttcattctcatggtatctttggtttagcagatttaatttttttatgttatcctatttagatccttaatgattcttggtctgtctgtgtattactttatcactgtggaatttactatagttttagaatatcttaatttttcacaaaataaatctcaaatgtagttttttttttaaaaaaagcattatagaaaagtgattaaatgttaaaggacctagaattagactccatggatttaaagctcacctctgccactagctcactgtgtgaacttggcaaacacttaacttctttaatcttgggtttttacaccaatacaatgtgaataagaatagtacccagttcatatgttgtgaggattaaaaaagataatatacataaagctgtagctgggcgtttggcatatagtaagagctcaataaatgttagctcctttttttttaagctcctataattatcatttcttggtataaaactgatactcggtgtcatatatgcaaatcgctggatttctctgttttcataagagctgtgatttgtatcaaagtctccaggatggtggaacaatttgctctctggtgctagttttggatctagctttggtctcactgcaggtgtttccaaaaacatagctaccagattagaggacaagatgctccgttttaatagtctgttttaatttcctttttaaaaaacatgttttgcctgaaatacttcaatatgcaaatcaaaaggaacagacaggtgatctagaagaaagggcttctaaaattttatagatggtagcatttattataaaaaaagttgagtcttctgtgaaaattaagatgactttgcatttgaaatatatgtatggcaacaatactgatttttaatatagtttttaaaacaatagctttattgacatattcatataccataaaattcactcttttagaatatacaattcagtggtttttaatatagttttaaataaaagtttgtcattctgaattcattgttttttcctttctgtttggactcttctcttttaattattgtgctgtttttggtaccattgtagagtagttgtgatcttaaaattttcagcttcttattaatctgggcccagcattagatgtagccttcagatcaatggaaagaactgaagaacttccatgttcttgcagtggattcccatatttaataaatattttaatacttatcaatcaaccatgtgtttctgaatttctaacagttttaaacagtctttccaaaatctgttattctgaagttaattgtttgtgttatttctctttttcaagaaataattaggttagaagaagtccatatgctttcattttaagcatcatatgttcactgatgaaagtattcagtgttcaggaagaagagagctccaagtgcagatagtattgttgctgctggtggtagtggggtgtgtgtgtgtgtgtgtgtgtctgtgtgtgtgtgtgtagagtattctgcatctcatctccataaggccattgggtcactcttcgtccttatatttcacttgacaagaagagaaacagttatacttttctctgaaccttctggcccttgtgcagttgggtatttcagttatgttagagctattaatcatgcctttttatagctcctcttctctgcagtatgttttcactagaactagagattcttgatttctctttttatcattctatctttgaataatgagggaactgaggggattggcaaatatttaatagactttggttcttgttccttttcttacaaagtttaaacttgccagctctgcaattaaaatttttccattggttctatttcaggttaaggctcagtagctgttttgagtaactaacactaatgcagtttgtgtgtgtgttgcaatttcctgtgatttgatttgtgaactgacatccttttaactcactccaaaaacatttattgaggtcctactatgtggcactgttctgtgcctttgggatacatcagtgaataataaaaaaaattctttcttctgggcttatgttctagcacatagacaaaaatatagtaaatgatgcagtaatacattatatggtacgttcaaaggtgataagtactatggaaaataaaaaatatagcatggtaatggagactggtagtgcaggggagtgtagggggcatacgttgtaatttctagtagggtagtccgttaggcctcagagaaatgacattaggaaaagacttgaaggatgtgaggagtgagtcatacaggtatcttaggaagagcattatatatagagagaataaccagtataatgaccccaaggccagagtatatcggtcaaatatgaataacaagatgactgctccaaagaagattggtgatggaagatcttattggaaactgttctgggaggaaatatttggaatcatctacatttcttgtggtatttttggtttcatcctgtggtctcacagtattggattatcccaccaaggaagaacatacagattttcagtatggtgtctaaatgtaatctcttcccctcctcttcctataatcccacaatgtaatgcatttggattcttctttgcaagacagtattacttccatgcacttaaatgtagttgtattttatgtttagtacaagcatggttatgaattactccttttgcaggatgttttatctggtgcggttggcagatatttttagaattagcctgccgtaaagcttactaagtagcagatacttctactgtgcctaagagatgagcagcacacttccaagctgtctttgaacatgttaatatctagtttcacaaatgggagaaatagggctaaattgcattaagacagagttttgttagtgatttaaaaggaaaagtaagatgattcagcattggaacagactataaatgggggttgaggaactgtctcaagaacttataaaacaggttcaacaatcatttttcaaaatggttttgtgtaggtttgtttccttacaagtgagggaatgaatcatataactcatcgaggttccctgaagctcaaagttccattcttctctgtctgccttatagataatgctcatgcaagtcatgtagccaaatgaccaccaaactcactaacaaatgtcagatgaatataattaacacaggaacacaggtcaaaagtatttcaggagaattagtgtaatgcatatactgttgagagttacactctataaaacaatgatagtgcttgtaattactagagaactcacaaggaaacagtaaagtagttaaactatgtgaaagcaacctttattatgtgagtcctgacaactacttttcacttttggctaattacagtttgcaaaataacttttgttcatgttattgtcagattaacagttgtcaggtttattttaaatttgtaagtgagcacattctttgtgctaagcaaggtgccaaacattgggactacagaggcacttggtatagcgttgagagtggaagatggtatagctataagccatgcacctcaatgagagagggatagaggaattgtcatctggaagtgacaagggaagcaagaacaattctgattcctgaatacaacacgaaattctgttcacactgcttacacttttttttaatcatgtggcagaataatatgcctaacgtttatggagctagaacattctgtggacttttttttttttgaagatggaatcttgctgtgttgcttagtctgggtcaaactcctgggctcaagtgttcctcccaccttagcctccccagtagctacaacaacaagcaccagccactgcagcagctcgttctgtgcatcttacatgtattcagtcttcacagcaatcctcagaggttgatactgtttttcgcagttaataaatagtgaaactgaggcacagagagcttaaataatgcccaggatcattcagtttaggaaggggtggagctaggatttgaacataggaaatttgtctcgaagatctggagttttaaccactatcctatgcaacttttcataagcaactgctcacagttttaaaacagagggaaaactcttggacaaagcaattgagcatagcattatattattgtcttgtaagataataacatgtctttccagataataaaaatctgttggtagggccatatcttcctcagagtcccttttggttctcctggaggtacctgtgtacacagtaggggttcaggacttggtggtggtggtggagacggtgaggcatgcagggaaggccagggaaggacaaaaaggacagcctgaaagcagtttgctaaggatggcccttcagggaaagtttcagtcatgagtctttgccaggaggcagcttcccagaaacccagtgggggaagttcggagcgacaacccacccagttttcagaagtgaataagttctcctagggtatcatttgataaattaaataaaaagtgacctccgtgttactttgaaagtattcatttgcctcagagcaacaagaagtttaaaaaaaactattataaaatatagaaagaatgactgtgcctggcgtttttcctttgtaaaaaagaatcaagatatcttgtaggaaacctttctttaacccagcatgtcaaatgtacagaatcctcattaaactgcactgatttgtctccagtagaggcaagaattacagagtccgatttattcagcattgtatccaaacacatcaacagcacagaacatgaagaaaacagtatctgagcccctgtatgctcagttttgttaaggctgagcagctaatcagagggaaggaatgaatggctctcctctagctactggctccagagctccaccatcctgtgatggctccttgtaattttattcatcttttatgtttctgatactgttggggtcaagttcaatgagcctttgatatgaaattgtttctattaagagctgagttcatgccagtgaagaaagagttttgagagtaagggttttatttcttttaaatattcagatgtgaggctgtaaaactaattagatatcaccaaggttatattaatatatattttttcttgtaataagatatatttcagagctaagggtagtcttcatgtgattctgactttacatcactagacactgttactatgtcttaagtctgtaagacccttcagtggtgatctatatcctatctccctcatttagagtgcagttgtttctcctatttccagctcttctgagctgggctcagcactagaaagtttgcttgctttaagtggtaattatcttccaggttacagttggctacaagcttttcctgccataatgtatacacgtgcacacacaagcactgttggatgtataatggataatgtgacttgatttgtgcagtttttctatgtctcctaataatggtatctcttaggatttcctgctttcaaagatgatttggagtcagtgtattttaaaaaggcatttcacttttctagggaaagtttaatgctaaggattaggtgacaagattgatctttttttatcacaggggctaatagtgactagctccaataaataatagaagtataaataaaattaatttctagagtctcttttattacctttgtctaacagaataatttgattatttttcaaccccttaggttttttattagaacgtgtttgaaaaattgtactcatttaatttttttttagattcagatgtttttgaagtcagaatcccagaagaccatataccagatacaggtaatgcagtacctataacaaaaattttcattttggatgttagtattttctctcaaacatgaattgtggatggattctttcaaccttcctggaactcaagggcaaggagttactcttcaaagcagcttggagacaccagctggtagtatgtggaagcctctgagtttaagaatttgggggcagatttaggtcatactgaatcactgttaaagattcttgctattttctaacctatgtgtgcattgcaagactacatggttttaagacatggttttctcagagagggctggtagtctgttttctctctttctttctcttacagacacacaccacaatcccatcttctttctttactgtggtagttaagatagctataggtagtgtgttcttcctaccagtcttcattctagcccactggcaaacaaaaaaaaatgaaatatttttgcggtggttcttgtcgctagaattctcttgtttggtgtcccaataaaggaagcctttggttaaaagaaagaaaggaagaaagtctctggtgtttgacagtcaagtcataggtgaaaacctgtcgtttgcatatccttaacattagggacttaactgcttttatttttctcttcttttttagcaggtactttgctcttagagtatttcttgactatatccttggaaaacttttagacgagtgagatatgttagtaaagaaggcatatggtcctatgtttaaagtttgaaacatagttccatagtttattatatgtaaatgtgtgagcagaacatcctttagaattatatagtttcattccttagtcctaggagaaaaggcctttatacaccatgtgaaattgtttcccaaaggaaatgctatggaatttatttgtgctagctatttattatgggattttgtacaacattatttcctatttttctttcttcagacacttggagctagccctttagtaaaagtgagcctttactctcagatacatctaatgtctatataagcaaataaaatcagggaaagaaaaatccattgatattacagaactgggtgaagtaaaccttgatgtgaagaactcaccattcttagttttattatttggacatggcttactcctgaagttgcctccaggagagattgtgacccagctggcagagacaattcttatttctaattctgtttttaaaattacctgatttagagctaaactgactagttattcatgtgagagtgtagtggcttgacagccatttactcatttttcctcttctctgctttttaccttttgatagttacattagtctctgcaatgagcttttatatactctcttcaccataaacaaaaatgttgtgtttttctcacagcattctgtaattgtgactattttcagcttgcatatggggaaaaacaagatgaagatgaaagttttcctaactctactctaatgaaatatcaagccaatagtggggctgggaagagctcttgtctcatttctccccggccttttctgtaccagaaaagagtatccatttcccagggctgatttgtcggagggatttttgtctgctgattttgttgcatctaaatgttagggttccttgcactcagatttaattatagctcgatacaactatactatattgtgttgttctcagactactaaatatcttaaaggtctgctttgactttcaggattatgtgagtaagcattttcttgttcaggccttaaattgaaggcctagtaatgggcagttaatggccaagatgatggagagactgatttatcagaagatagctgaagcataaataggtaatgaggctgcctgacttcctgaatggagatgagaaaataggagctggtgccagtgtcagcatagtctgtctttttgtctttgcctctggtttgttggagcagggaccaccttggcagccagggaatcacaagagttccgggcttttagtgccttcagaactggaaatgtagcaaggtaaattcggggaatgcctctcaagagttcatcttatccaaggaaagccgtttttttttttttttttttttttttttttttttgtggcatgtgtagccttcatctaggaattcctgggtagtgagatctacatgatgtaatctctgtcctaggaaaatgcatcccaaaacaagggcaagaaattgtttacatcagttgtgatatggtttggctgtgtccccgcccacatctcatcttgaattgtagttcccgtaatcccaacatgtcatgggagggacctggtgggaggtaattgaatgatggggatggttacctccatgctattctcatgatagtgagtgagttctcacgagatctgatggttttataaggggcttttccctcacttcactctgtacttcttgctgctggcatgtgaagaaggatgtgtttgcttccccttctgccatgactgtaagtttcctgaggcctccccacccctgtgaactgagtcaattaaacctctttcctttataaattacccagtctcaggtatttcttcataccagcatgagaacagactaatacaagttataaattttttcatgtaaaataaaatcaacagcaagaatggaaatttgacttggaaagcaagtataagtagataagaattccatgagaattggccatactttagactcacatgaagtagctctttaaaaaatatgggcttggaggccaaagtagaaagattgcttgagctcaggactttgagaccagcctgggcaatgtagtaaggtcctgtctcaaaaagaataaaaataccatgggaattccaatattttgctccttttcatgcctcatttaaaaaaacagtataggctgggcatggtggctcatgcctgtaatcccagcactttgggaggccgaggcagtcagatcatgaggtcaggagttcgagaccagccttcccagatggtgaaacccgtctctactaaaaatacaaagaattagccaggtatggtggcgtgtgcctgtaatcccagctattcgggaggctgaggcaggagaattgcttgagccctagaggcagaggttgcagtgagctaagatcgcaccactgcactccagcctgagcgacagagtgagactctgtctcaaaaaaaaaaaaaaaaaaaaaaaaaagtatattgaggttctactttgtgacaaactgtgccaaggtgcttacagagatattggccctcaatttagctggaaagactatctgactgaatttctttttcttccttttgtctttctcttactcattccctccttttagaaaaaacttttaaaacttttattattttggttgaactcaacaccaaaatgtaggtagtaaattgtcataagaacatacattttacttttaagaaataatgcaggaatttagtaagtaaatattcagttttgaaagttaaacatattttgtcataaatagtgaaggcaaggggagagagctatttttattggacatctattatcacaaaggtctttaatccatttttatggctttcaagataaggagggcatttcttaggttggtttagaatattgcttttcaactgttggctataccttagaatgacattgatggctctttaaaaaatgttgatgcctgggatccactgcagaccaagtgtatcagaatcgctgaatttgaggcataggcactagtattttttaaaaagtttcccaaggtagtctgggtgtggtggctcatgcttgtaatcccaacgaatcaggagactgaggtaggagaattgcttgagcccaggagtttgaggctgcagtgacctatgatcgcatctctgaatagccactgcactccagcctgggcaacacagtgagattctgtctctacaaaaaatttaaaaaatagaaatagctgagtatggtggcacatgcttatagtcccagctactcagaggggctgaggtggcaggatcacttgagcccaggaatttgaggttacagtgagctgtgactgtgcaactgcactccagactgagaaaaagagcatgaccctatctctaagggggaaaaagaaaagcttcccaagtgtattagtctgttcttacactgctataacgaaatacctgaaactgggtaatttttaagaaaagagggttagttggcttatggttctgcaggctgtacaggcttttgcttctggggagacctcaggaaacttaaaatcatggcagaaggtgaaggggaagctggcatgtcttacatggtcagagcagaaggaagagagagagagaagggggagatgctacacacttttaaacaaccagagctcctgagaactcactcactatcacaagaactgcaaggaggaaagtccacctccatgatgtagtcactgtgcaccaggcctctcctccaacactggggattacaattctacatgtgatttgggtggggatgcaaatcctaaccatatcaccaaagaagtctaatgtggaaccaggattgagaataaccagtttagaagttctttgatgtctttacttccatcttgatcttccataatagatcagtaacatatagcgtgccttgcaatttcctgattgtgctgagctgtttgctgtttttgtgcctttgttgttcctgtttcctggagtgctttcccttacattgtcaatctgaggagcaccaatgcattcctcggtatccctacagttgaaggactgctgttgtattttatacatatacctactgttagacttacactcattttgtaataatttgtttagtaccttcctcttgtgactgtgagtttcctgagtgcaagagccgtatccaactcatctttctttcccagagcctggtatgatcagcactctaaaagtgtcgaatggactatcacttatttaattattacagcaaatctacaaagtgtgtattattatttttgctctttaagagatgaggactttcagttcagaaacatgaaacaacctgctctagtttattccactggtaaatggaagacctagaattcaaatgtacctcagccctttaaagtttgttctttaaaaattgtgctattttgttttgtttcattttgttttaaaatgtcctgttgccaggcactgttctacttcttgtaatactaaatgcagatggttggatttcaagaacagtttggtttaaagataatgtgtaaattagatacaatatataatcagcttatgaaaactgtgggtgttactgagatggaaaagggagagtaacatggagtcataagtatagaaatacagacagaaaacactaatgttcttacatttatcataccaatttacatataggtagacctgttgggtagaactctctgttaacagatgccattgtaatacagttctgcttcacaaaattaatcccatatcttgatgtggccacaacaaattctagaatgagaaaccttcatctgaaatagagatatagtatcaatcctttgcagctcttttgccagaagttctcataaggctatggtgatttttcagttgccttttccgatgtagaaaagagggatcatatatacaagccatatatatatatatgtatttattaaactgaagatgttagacttccaagaattatacttgtagtttttttaaactgagctgaaagagtcaaatggcaaatatgtgtttaggacgcagtacctaaagtactgttacatgcattaactcttatttttaataatattaattactttcacagttatcttattgtatactaccatttgattggtaatattcccaccccattggtaaacatcaattcgttattcaggttggacttaattaaaaacctaaagtacctcatctttctccttgtgtcagagttctgattctactatgaatgttgtactgctaactttgctttaaaaattggttatcagtaaggcagtcttaaaaagttcctttgtgtttgatctctgggataggtaggttggccctggttcattgactctagaagatatgaggagaagaggacaggctgccacaaagcaaaatgcatgagaaacgagtgttatattaattccgcattttaatttcagctattgcccatgaataataaataggctccaatctggggattgtatcatgttcttatggtcctaaaattctgtgattcatttttgaatttagaatttagaattatctttatgtaattatactgatttattaagagttcctgccatttggagagttattttatatttttgcatttttcccttgaatcttttgtttcacagcttctataaatgtcagcctcactgcttgcctcaatctctaaagcacatacatactgcaagcacatactttaccatatccatgtaatttcttttccttaagtgacagacatatatatatatgtttaactataactctgagtttgtaaggttgttatcaaattggccttaggacatgtgctgtgtgtcagctatggtcatgttattaacttttagatggaaatggaattctaaagattgttttttatgttttgattttcttgtcatatcttctaaaaatgctctttagagtattttcatgatactgaaataacttctattataatatttattcattagaacccagtaaaacctgcaagtacctccaagctgtaggatgaaagcaaggagttgaaatatgatgaaaaaggcctaccaggaggtgagatgcctactctaccaccaaatatgtgactttggaagtgacttttgcccacactggcctcagtgtccctagttatatactaaggatcttgtattatgtgacctctaggaatctctcaatattattctgtaatacctgaagtacctgtttaatagtttttaaaatcacaattcattcttatgtagtaatttgaaagatggcatttctgcaaaattacgtttttccagtatctctgagaggtattactactttttcatcttcaacttaaagttaataaatattggaatttttccttgacagtaccttagcctgtgtcccccaccaaaggaaattcttggtattatactgattctctcttctcaaacatacctttttccttaaactaaaaaggcagggtctaagagtaactttctgagagccatcctggctcacttcagtggtgttgaataataagcctgataatatagcaactcagtgtagttcatttactttattccttctccaagataaccttaagaagcaaccatattggccgggtgcggtggctcatgcctgtaatcccagcactttgggaggccaaggcgggtggatcacgaggtcaggagatcgagaccatcctggctaacacagtgaaaccctgtctctactcagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagttgttaagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacgttccatgctcatgggtaggaagaatcaatatcgtgaaaatggccatactgcccaaggtaatttatagattcaatgccatccccatcaagctaccaatgactttcttcacagaattgggaaaaactactttaaagttcatatggaaccaaaaaagagcccgcatcgccaagtcaatcctaagccaaaagaagaaagccagaggcatcacgctacctgacttcacactatacctacaaagctacagtaaccaaaacagcatggtactggtaccaaaacagaggtatagatctatagatcaatggaacagaacagagccctcagaaataacaccgcatatctacaactatctgatctttgacaaacctgagaaaaaccagcaatggggaaaggattccctatttaataaatggtgctgggaaaactggctagccatatgtagaaagctgaaactggatcccttccttacaccttatacaaaaattaattcaagatggattaaagacttaaatggtaaacctaaaaccataaactccctggaagaaaacctaggcaataccattcaggacataggcacgggcagacttcatgtctcaaacccccaaagcaatggcaacaaaagccaaaattgacaaatcggatctaattaagctaaagagcttctgcacagcaaaagaaaccaccatcagagtgaacaagcaacctacagaatgggagaaaatttttgcaacctacttatctgacaaagggctaatatccagaatctacaacgaactcaaacaaatttacaagaaaaaaacaaacccatcaaaaagtgggcaaaggatatgaacagacacttctcaaaagaagacatttatgcagccaaaaaacacatggagaagtgctcaccatcactggccatcagagaaatgcaaatcaaaaccacaatgagataccatctcacaccattagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcgtgctgctataaagacacatgcacacgtatgtttattgtggcactattcacaatagcaaagagttggaaccaacccaaatgtccaacaatgatagactggattaagaaaatgtggcacatatacaccatggaatcctatgcagccatgaaaaatgatgagctcatgtcctttgtagggacatggatgaagctggaaaccatcattctcagcaaactatcgtgaggacaaaaaaccaaacaccgcatgttctcactcataggtgggaattgaacaatgagaacacatgaacacaagaaggggaacatcacacaccggggactgttgtggggtaggggtagggggtgggatagcattaggagatatacctaatgctaaatgacgagttaatgggtgcagcacaccaacatggcacatgtatacatatgtaacaaagctgcacgttgtgcacatgtaccctaaaacttaaagtataataataataaaattaaaaaaaaaaaaagagaaaccttgtctctactaaaaagaaaaaaatacaaaaaaattagccagccgtggtggcgggtgtctgtagtcccagctgctcgggaggctgaggcaggagaatggtgtgaacctgggaggcagagcttgcagtgagccgagatcgtgccactgccctccagcctgggcgacagagcgagactctgtctcaaaaaaaaaaaaaagaaaaaaaataaaagaaaagaagcaccatatttcttctctttggcctatttatcagccagaaacatggggaaggtaggttcctgaatattggaagaccacagaaaatgcaaagaaaccaggctcacatttattttagtgaccaccactgcaagtttggtttgggtgagaagtcctgtgttttgggtttgatccttgaggcctcatgagtttcagccctgctgctgaaagtgtcttggttttagccaaactgtggaggaaagtgacattgaatactggtgcaatgaactcattggagctgcttttcaaaatgttcagagacagtgtcagtgatgctgtattagtttcctggtgcttctataacacattagcagaaacttcgttgcctgaaacaacaacaacttattgtcttacaactgtggaggtcagaagcctgaaataggtcttacaaggataagatgaagtattggcagtgctttgctccttttggaggccctaagggagattcattccttgccttttctagtttctagaggctgtctgcattccttggttcctgccctcttcctcttagcactctgatctctacttccaccatcataccttcttctctggttttaaccctgttgccttccacttataaggactcatgtaattagattgagcccatccagataatccaggataatctccccaagtcaaggtccttaacaatatctgcacagtccctttttccatgtgaggtaacatgttcgtaggttctggatattagggtgtaggcatatttaggggtcattattttccctaccgcagattccttctagttattaatgttgttacctggatattacctccttctggaggccttctgagacacccttagacctccatcttccctggtcattctcgacagcatttctctgttttattaagtctgagaatactatgtttattttctaaacttatttttaatttaattgttcattttctgtctcctctactatcagataaactccacaggagcagaaacatgatcagttttcttcactactttgtcccccaaatctaaatagctcccagcacttggtaggctctcagaagaaggttattgaatgaatcaatctgtatatagtgtaagaaagcttgccttatattaaaactatgttaacatactcctgttcctattactatcaataatgcaaacattcttactaagcagtagttaagcattctgtcaatggattttcttttgaatttaagtacatgagtttctcattgggacataactgagatcaataaaataagataccagatgtaaaatggagctgcaggaaaaagaattataattaatgcagacagtaaataccttgccaagaagaattttaacattacctcaatccaagctgtaatcatgataccaaggtgaataacacgtggcccttgtgtttttcaccacaaatttgcaacattaatatttctgattcaaaggaaattgaggtaagagctttaatagtcctacaataaggatggaggagggagaggttcattttaactgaaacatcatttctggtaagcagaggctcttcccaaaacacagttgctagcactctaggaaactcaaagagctttaggtagagggagtgatgttatccattgacatcacattaaaagcaactctgatggaaagagtgtctttctataagcagttaacttatagctgttcagttgttgttcatttatacatccaggggattgataacaaccttcgaatgaatcaggcaatcagaagatcaactaagtacctggtgctggtcaagtactgaggtcttgatgtgatattgacctgtagtgaggaggagatgaggaggctagacgaggttggaaaggcttcatggaagaggggtgctatgcactgaattatgccctccccacatttaaatgttgaaactctaacccccaacatgactgtgtttggagatgggagacttttaagaggtgattaagattacatgaggtcataagggtgggaccctaatccaatatgactggtgtccttataagaagagaaagagacaccaggcatgtgcacttacaaagaaaaggctatgtgaggacacagagagaaaatggccatttccaggccaaggagacaggcctcaggagaaaccaaatctaccaacaccttaaccttggacttccagcctccagaactgcaagaaaataaatttctatttaggccacccagtctgtggtattttgttttggcagtcctagacgactataggtggaacttgatctaaatcttgaaggatgagtagggccgtttctgggaaacagctttggggaagtgtctagttcaggaaaggtctcagcaaaattaatgaatgaaaaagccacagaaaatgttggaatgaacatagcttttgaactaaagagcagaagagagaactgagtgtaggtgggctatgggtaggtgcttatgtaccattatgcctggggtggggaaggtgattatggaagatcctgaaatccagggagaagggttttttttttccttttttttttttgatacagtagaaaatctagggcttacatttggggttttgataaggagccaactttagaaagatcgggggatatgatgtatggcagaggtggaaatgaagggtaaggtgtggctccaagaactaccataaaaaaagaaaacagatttagttggggctgggtattagttgagaagagttaagagttatagttgaatggttcatgaggctgagaggtacccaggtagttcttaatttttgaagttttatgaggattagaatgtgttagcaacagaagtacaagattctcccatacctacttctttaggaggatagactttaaaacagaagaattatcctttctttccaaaaagtcttattattattaatcagactctctcctttcacctaatctcatagtttactgtgtgtgaaatcccagggatggttgaggtcacctgtggccccacagaatcctaagatgtccgttctgggatgtgctggttctcagggagcagcagcactgttggcctcacatactatgtgcagttgctcatgtggcttttaatctctaaaataatgtttgtcacgtttctcattttagtgattatacatattgattttagaggtttggatactgtagaaacataaacacgaaaaattccaataatttggagtcctactgtttggatatagctactgttcatatttggtgagtcgaatggaacacacagttttgcttcctcctttcttttcagttaattcacatgattattcagtatgcaaatattagtgctatgggaaacactatattttttagtttagagtcccttgtggttttctctgggagttcctaggatagcataggaaatagtgaattttttttttctaacacaagaacattttgataggtgatattggcagtagatgtgcagaggtttaattttgcttttaggaagatgtggaaaccttgatgaaattatgtctggtaaattataaaggaaatactatttttaaagtatatctttgtgataagcgaaaaaggattttttggaggtttagatatcttctttctaaatagatcatattcaccatattattttattcttgaattgagcatattttacttattttctttccaaatgtacaaaactttattttaaaggagctagtcacttaaaatcagataagatgaatgaagtgcagtcatcttagaaatgaaatgcttaaccacttgaggtaaactagaaaagtagggcacttgtcctctttgattgggtggtaatttacttcacattggtgaatgcttggcttctaagaaggtgtaaattttactttaatatgttttcacttattctccatgttgaattattttcttatgatattgtaagtgttttgaaataatcataagaaagactaattgtctgattagtatggctgagtaataaataaccttttttctttttgatattgtagttgactcatgttgaccaagcaagcttccaggttgatgcctttggaacgtcattcattctcgatgtcgtgctaaatcagtaagtgttgagttgcacttgcttttgtcagatacacattgaatccactttattttccacttgtaaagttttttcttactatattttactttgtcttcctataccggttaaatactacattttaaactatacttatttactgtaggttataaagtctggcagataacaagaaatatatattcatttgaaattgagcacctataatagagttaagaatgtaaaatgaaaggcaagagttaccccaatattttttgtaagaatatctataacttaagtttcctatgaatgacagtaaattatgacaataatactttgggtattgaagtatcttccttgagaacagcaggaaagagaaggttgcactttttgattaatgattcagaggactggctgcatgatatgtgatgttaaatagtacctggtgttcattagatgctttgatgtggtggtggatttctgtgaggtttctggtactgggattatcctgtgaatacaatataattttagaaatagttgtctatctagaattttaggtttggaaggtgcttttgatttgttgctggatttaatctcttgcatttggtctaagtgtagtgtttaataaatctggttagttactgttcacttttttaaaaaagggtttctatcctacttctgatcatgggcaagtgggcagagaccagggttctgccaggcctatgcttctgagctgggcagaattgggctatagttttctggaagcatttctacaacaggaagaaagtctgaggccagaaattcagacaaatagactaagagtgagaattagagcctgagttgtctgcaatggggaaccagctagatggaagttaatttaaaaaggcatgtaagaggcaagacttaggaccatgttatctggataggtagccattagccacttgtggctgtttaaatttacattaattcattcaaataaaattaaaaattctgttcttcagttgcattagccacattttaaatgctcaataaccctctctgccttcactccctcatctacttaatacctagtctccttctctgtttcattttaaaaataatacttatcaccatttaatatataggtgaattcttatgacattgccatttttataggtcaaaaaagtttgactaccattattgatgtatggccatctaatatttgatattttgattatttatttggtctatagtctttttcctacccctgcaatgtaagctctttgagggcagagattttctttgcttcactgatgtatccttaatataggggttaaactccaggctgggagtcatattgactcagaaaccagaggataggattagccaggagacagaggtaagatgactaggagaggaagagtgaaacagcaaaaaagaagataaatgtttgagactagcttctgaaagctgcatgtagatactaggtgtgatttggaaagtcaggttcttaggtctctattttaataactcccttccatccctctttgaaatcattgcccctgttggtaatctgtgttttctgcttcctgacatctgtaattccttgacttttaatactcaaacaaagaagggatgtttattcatgtccattctggccaaactgcctcacttgctttggagacatccgagtccaaagactttcttttcctgaaggagacacacatatggtcatacttatcaaagcgtgaagtttagaatactggggttgaagcataatttcttctgagatattggcagaaacctctattgggcatttttctttctatttcaatgcaaatttgcaactacaagacatataaaagattaaataagagcataaatggaggtagcctgggctgagaaacatgcactgtgctcttttttttttttttttttttttttgcctgggatcgatgttaaacataggtggcaggtggctgttatctttatactataaaaatcatgatgtgatacaaaaatgtttatcttatttttaatgtagaattttgtttttcgtggtttcagtttgtgtattgtcttaagttggttaaggagcaggaacgtgaagaacaataagttctttaaactttttttttcttatgaagcaattctggggctgtggaacatatagaaaatttttttaactggaggaaaattaaataagtccatgtagctagcttctggttgcagaatggatccaataatacatattttttgattggaatggatggaaaagtatcattacataatgtttcttcttaatgttcagtaaataaaattatctataagtagattatatctataagtagagtttaacctttgagtagtaacttccacaggaggctgataaaaatatggaaaggttaaaaatgaaaagcacagccagtttcttttttgtcaaaattatcaagaaaagggtggggagcagtttttcttcatggggtcgtagttgtgaaatttcactctttaggacagatgtattaacaaaatgaaacatatggcctggtctggccacactagtcctaggctgcattggacctttccagaggtcagcaatgagtcttatattttattgtgaaacattcttcggaaagaagaaagctcaataaagacatgtaactctattatctgagcaattcagtccaatttttttttcttgtacatctcctgttcttgaagaagtggataattaaactgctccaaacaatgcaagatgttgaaaaatgtttcctttcagcagaattctttgatcctttacaacagaggacctgacaaaaaccacacatagtcccccaacaaagaagcaagcactgtctgtggactgtggttggttgtttatgatgtgaaatatataacaattaggaaaaatatcttttatagcctgctttttttggaagggattctgttgtgcagctctcagatcctggatgatccagtgcctaaattttgagtgtattttacagattctcagcttcttgtcttcttatttcaataacaacgaaatggtttttctcactgtatgatccttatagcagtcttcttttcccccagttttacagtaagtggtgggaggacaactaggaactgaagcatgacagatgtcagcagatggggttgcccatgaagaatgggaggtggtgtggggatagggaagagggagagagagagagaagcagaagcagggttagacaaggaacacccaaattctgtttaaaagagaacattcagtcttgccttctctcatttagagaaagcatttccaattagttacctcttgcttgctttatactgtggctcttgaatttgtagggaaagtaaaaatcaccatggataaaagacaggatctgaattcaattggaattgaaagttaactctggaagagtctcatcatgctatatttacggtgtggctgatgatgatgataaaaataaatgatgaggataacattataattaaatgatgatgttatgtgataataatgaataacaatagatatctcactgttattaataaatctgtaactgaatgccttgctgttcaactaaattcattatggtgaatatttgttcccatgtacatttaatacaaagttattgtgtataagacaaatctgtgtttggagtagtttggaatccttatgtttatttcatatatatatatatatacacacacacacacacacacacacacacacacacacacacacacgcatacacaagttttctaagcctctagtaatgctaaaagcttctctagaccctgaagacttagacttgagaagaaaggaaacaaagactttactcttagggaatttgcatctagccagagaaacaaacaatgaacatgttaaataaggtaatttcagagagtgacagtgccatttatagagagtgtctggtgtgaggatgaaaatagcacattcgagaattggttgtccgggacaggccatctctaaggaggtgacatttgaaagtaaggggcccccatgcagagggaacagcaagggtctgggccctgaggcaggaacaagcttagcatgcttgagagacagaaatgtggctaaggaggttggcacagggatagccaagttattaaatgcggttggaaaagtagaaggaaccaaaatatctagggccttgtaggcaacagaaagactttgggtgaaagtctaaacagaggttattgatttttccccacactatttgttgcattattcactacttcccctactggcttatgaacatttattcatcagattcagttattacatatatatatatatatatatatatatatatatatataatttttttttttgagatacagttttgctcttgttgcccaggctggagtgcaatggtgcaatcttggctcaccacaatctctgcctcctgggttcaagtgattctcctgcctgagcctcccgagtagctggaattacagtgcaccacaacacccggctaattttgtatttttagtagagatggagtttctccatgttggtcaggctggtctcgaactcctgacctcaggtgatccacctgcctcggcctcccaaagtgctgggattacaagtatgagccaccatgcctggcccagttattacatattttaatattttttgaaaacaatctcttctgaagatcttttcattgattttagggcttagtaccatcatactatttattgtagctttataatgtgttttaatagctagtatggaaatatgttccattattagttttctgttgcaaaattttcttagatatttttgcctcttttaaaatagaaattcagaataattttgtcattcttcctttggaatttattgtactgtcactaaacttatattttaatttggaaaaaatagacatttttacagtgctgagtcttcccatccaacatcacagtgtattttttaaaatgttaagcattctcttatatgtcagtaaaattcagtatttttgtttttataggccctgaacatatcatgtagagtattttcctaggaattgtatttgtttttgttgctactgtgggtgtaatatttttccatcatattttataattatttattagtgttatacaggaaaggcactgatttgtgttgcaccttattgaactttcttatttttgctaatggctttttattgtttctcttaggtttgaatgtaacattctagtttgacaataacatgaatggcaaataattagagtttttcttttcaaaatgttacttattaccatttcctaccttaatcctttttctagaagtttctgaactgtataatttggtgataatagcatttttatctttttttttgtaataaaaataactaatgttcattgttaagtaagtagagtgttgattattgatttgtgagagctagtctttattgtgttaaagcaatatcttttgtcttatattttaagtaataggtattagattttattgaatgtttttctagtcagttaaagcttccaggactagtcagctttcccattggtgacaccaaccctccacaacaaggcctgtagataggtttggattttcttatttgacctgttattatgatttattatattaatgggatataaaattattctcgatgctgataataaacttgactttgtcatgttggataattcattgttttgtcccatatgttgctggcttctctggttgtgactataaagtagaattacaattcctattttttatcttaattattatgacacaagcccctgccgacattcttggtgtaaattaactctatccccaagtgtttcctttaactatttctgagattagtctctagcttttaatcttataattacattcctgccactggtagatccccctgcagtgacctgcagacagctgctctgccgggcagtttcccttcactagtgatgcccgctaacatctgccagagtggtttcttgaagaacccacaagcccaaacctatctataggccttgttgtggagggttggtgtcaccaatgggaaagctgactagtcctggaagctttttaagagagaaatctttgataaataatttttttgatgtctattgatgtattcaggttttctacttgtttttgaggccaactttgagaaattatagttttgcaaggaattgtccacaccatggggtgttttacctttatccatatttatctatgtgtgcttctcagaaaattctaaaatttccccgttcctattcttaaatcctctttccgaatcctatttttatttttggttatcttatcaaatatataaacttctagggacttatttttgagacaggttcttgctctgttgcccagtctggagtgcaatggcgtgatctcggcttactacagcctcaaccccctgggctcaagcaatcctcccatctcagcctcctgagtagctgggactacaggtctgcaccaccacgcccagctaatttttgtgtttttagtggaaacagggtttcaccatgttgcacaggctggtttcgagctcaagtgatcgcctgcctcagtctcccaaaatgttgagattacagacatgagctaccacacctagcttaggaacacatttgttgcatataatgaaagtctttttttttttttttaaagaattttattggctaggtgcggtggctcacgcgtgtaatcccagcactttgggaggctgaggcgggcggatcacgaggtcaggagattgagactatcctggctaacatggtgaaaccccgtctctactaaaaatacaaaaaattatccaggcatggtggcaggcgcctgtagtcccagttactcgggaggctgaggcaagagaatggcgtgaacccaggaggcagagcttgcagtgagccgagatcgcaccactgcactccatcctgggcgacagagtgagactccatctcaaaaaaaaaaaaagaatttattttatatttcataaaagtcacccatttcaagtatacaattcagtgattttcagtacctttactgagtggtgcagcaatcaccaaaattcaatttttaaatgcttttcatttttcaacaagattgtttgttgccatttacatgtaaacctcattcctggtcccagcccaatgcaatcactaatctactttctgtctttataaatttgtgttttctggacatttcttataaagggaatcatacactatgtattcttgtatgtggcttcttgacatgtttttgaagttcatccatgctatatgtgtcagttcattccttttattactaaatattattgcattgtattgatatatcacattgtgactatccattcacccgatggtggacatttgggttttttctagtgtttggctattataaataatgttactatgaacaatctgtctgtgtagtctttgcgtgcctatatgttttcatttctcttggatagatacctagaagtggaatggttggatcatatggtagtttcatgctttgagaaatgctaagctattttccaaagtaggcttttgatttttttaaatggtgctataacagctgtttttctataaattctattttgcaggagggatgatgtcaagtataaatagttactaaggcttcaggttttcagtttcatgtctcctgcaagtctggaaagagttccatacttctcatggctacgatcttatgtttttgatttatagtaaaactctacctttgaaatctacgttgaacttttgaaactttttaagggttgggattctactattggtagaataccttgaggaactttatatagaccttacatttcttgttctttagctgaagcataattcactttttcttgtttgttctaagttgagaagtggtaaagttgtgaatcccacaactagacttttggaaggctagttataacttcttctcacagacacaaagtctcttgtgctcagcccagggtggccttgttgttagaggggcagcttttggctgcaaagtccagagcaaaggggaactgtattggaaggtgctggaagatccatggatgtgtctggcaaagagctagagaatgatccaaggaagagaccagtactaaagctaagacctaggaaattgtttctgaaggggtatttggaaggaatcctagaggcaacaggaccccagggactagagacttacaggattcaaaaggccaaactcatgggtgaggaggatactgtgctaggcttgagttagctctattataaggatatatccgagcttactagagtagcatcaggctcctgtaacaccttcatgttactggtttatttaagctttctgctttcttgtttgtttttaaaaagtacagacttagcacagacacattatctttcatatgattgtttaatatgacttttagatatttttagtattacctgtttttttaataggggaatctggagattttagcatacttatgagcctgttatttaaattgtaaataaaataattgcagaattatttaatataacttagacaatttgtgttttttagtttttcaaggaaaataccacatacatactatttttatatttgaaatgattgctgtatatttttgtgcaacagatttatcaggtgagtgaaaaatgtaatttgctagatatagtcaacacttccaatgtgcaacaatgaaacctttaatgtaattaaatgtttttgcataaattcctagaagttcttttgagatttttacagtgattagatgtgttaaagattaaatcatcagagctcactgctatttttctcccaggtgtcaaattactattattattttaattattttttttggacagtctcactctgttggccaggctggagtgcagtggcacaatctcagcacactgcaacctccgtctcccgggctcaagcaattctcctgcctcagcctcccaagtagctgggattacaggtgtgtgccaccatgcctggctaatttttgtatttttaatagagacagagtttcaccatgttggccaggctggtctcgaactcctgacctcaggtaatctgcctgcctctgcctcccaaagtgctgggattacaggcgtgagccaccacgcctggccccaggtgtcaaatcattgaactttcttaaattatctagcagtgatagtggtacagcccaaccacagggaactttgccaggtttgacacattgggttcccagacatatttaatgtaatttgtttatgatatggctgttaaactattggatgaacaaaatctttgcaagataaaagattccatttgaataattggaaacttgttctctaatagttatatttgttttacagtaaggactatgttttagagtgaggtataaggtgcgtgcttactcctggtgataccatctgcacagagctggcttaattactttgtctctgaaatatttatctcagtatgtctgtatatcaatctgttacttcacactctgaatatatgtatattttcctgtgtttcacctgttggcatatcttcttagctaatgagtgtgtggcagattgtactgtatacccttgtcctgtgagtgttaactataaccattctcagacagggactgtagctaccttattctcagttgactcctttattattttgtctataataaaattaaacagttttgacctataatggtgcagaagtgataataccagatatactgcaaagaaacaaagaaagattaacagtgactatttaaatgaaaattttagagaagctgaagtctcttcttggaaactggtagagtatagaaatttagcttgaactttctttgaggaaatggtccggaaagcactggataagaatctacaagcagcaaggcatagcatcatggtttgatgttatgaaggatgtcatacacattattgcagaatggcatcttggtcactgttatatgaatggtacctgggaggaactatagctaggtactaatataacactatgggattttgccagagaaaggcactgtgatgcacctctgtgaggactgtgctgtaacaaccacatgtgggtttcattcatttagcacacccctttgccagagcacatacttggccctcagggataaaaaatcagaaacttgtcttatagtaggatatatattaagttagtgttttatcggaaggtatttccatattaattggatattttaaagcaagtcatatttgcgtattttattttaagaaaatcttatgacttactgacttactgataattatttcttcttaacttcagtgttatccaattcaaaattattggagagatggggcctgtagaggccttaagattattttttgtgctgcctttgccctttttactttctctggttctcaggggttcaggtgtgctttttagcaatgatagaagtagcgagtaggcctcttaaattcacaaacacacatatccctaaccctctctagtagacatggtaaaataactctgttacaggcaacttccctttagtcttagtctggagaagtagctttttcactgtattcttttaaaagagaaattgtagttgcaggaagaaaaatggaagattttccctaaaaaattggtttattgtgctttctctgttaatgtccccaggcaagaattagcaaatgaatgattaattctactgtttgtgtatgctttgtttccagagtcaaaagttaaaatagtcaagctttatgccttaatcagagatgtttccacatgaaagtttaggtttggtttttgaaggtgaaatataacatataggatatttgaatgaccttatgccatcacgctatcatttatgaatgggttctttaattaaaacattatttcttagatataaacaagctatggtaagtttccaggtacatagaatagaaacagatggaaagtttaaagagttgatttttatcctgactcatttttgtcaagtgattatttttattcatatttagtattttttagatatttaaatttttcaggctatattattgtatattatttatttatttatttagagatggggtcttgctatgttgttcaggctggaatgcagtggctattcacaggcatgattatagcgcactacagccttgaactcttgtgctcaagtgattctcccctgtatagtattcatactcatgctatatagcctggttagtagaaaactaattacatttgtttttctttgctactattattaacactgttgtcagagatatgtagtttaaaaagtgaattcttgactgggcatggtggctcacgcctataatcccagcactttgggaggccaaagcggccagatcgcttgaggccaggagtttgagacctgcctggccaacatggtgaaacctcgtctctgctaaaatcaccaaaattttccaggggtggtggcacacacccgtaatcccagctactcaagaggttgaggcaggagaatcgcttgaacctgggaggtggagtttgcagtgagcagagatcacaccactgcactccatccagcctgggtgacagagtgagactccatctcaaagaaaaaaaaaaagaattatttatattccaattcaatgtattattgctgatagttacttgagtaacttgaagcttcaaagtatcagaagagaatgtgtttcatactacttgcttatttgttgatttatttactcatttattcattcactcatctatccatccatcaagtgtatatagagtacacttgatgtactctatatacaggttttggggtgatagatacaaaaagataaagaccctatcttcaaggacatgacaacgtggtctgagtagaaaagcaaacagtgatacagtgtgtaaaggagcataaaagaggtatggccagtggcactgggagtgcaatggagctttattgaacagaagtatacgatctgctggagataattgtagatcatttttctacagacactaacctttgctcattttatgtttttacattgtaactgatgaaaaatcatttattttaaatacttttaaaatattgaagtctaacatacaccaaataagtaacatacatgaacatttttaaataattattaggagaaccagaataattattaagataactctacccaggtatagaacattaccagtatcccacaatcctccaatgtacactttccctccccactattggaaacaatcaccctgacttctgtgataatcagttcagtgatttttcattatagttttatcacttatatatctatccctaaacaaaaggtacatttatttctccccttttcttcttttttttttgagatagagtcttgctctgtagcccaggctggagggcagtggtgccatctcagctcactgcaacctctgcctcccaggttcaattgattctcatgcctcagtctcccgagtagctgggattacaggcgcctgccaccatatccaactaatttttttgtatttttagtagagacggagttttgccatgttgtcaggctggtctcaaaatcctgacctcaagtgatccatttgccttggcctcccaaagtgctgggattgcagacgtgagccaccacacccagcctttctccctcttttaaaataattgaatgtagaatggacttgtggatttttatttatgtgatattcacactcaatttcaatcatttttctttgtgatattcaaatctttctaaagttggtttatagaagcccttttgatttctgtgtttttttgacatgaccctattaatctttaagtgcttctttgtattctgggacaggaagagagccttttgctttctgggacaatcagattgactttttattatatcttagaattgatttctagttttttatggtgactagtttatagactaatctttgtcttcatttccctatttcagttgtttattatcatcttaacttattatattaaaaaatgccaaagactgacagctatcactagccttattttttttttttttttttttttttgagacggagtctcgctctgtcgcccaggccggaatgcggaatgtagtggcggaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggaaggtctcgatctcctgacctcatgatccacccgcctcggcctcccaaagtgctgggattacaggcgtgagccaccgcgcccggcactagccttatttttaatcaagtattgaaccaacacacaaatcagtgacaagcatttcaattctttgacttttgggaggattgctttgcacatattaattaaattgagtgaaatataagatctcagaaatagctatttttagaatgccatggtagttaaccatagtaagtttgaggtgataatcagaattttaaagaaacattagaattctaaaggggtaagttcttactcttcccaagattgaaacactcttaaaactcactagtgaaatacttaatctgtttttctctcacaactgaaagacatttgatcagagataagtgaaccttaatcagattcagcttagatcagagaaatgctctctgtgttcaagccactcttgaccatgtagaggaaacaaatatttatctggtgatctatagtgcaagatggtatccacccagggaaagaatgaacaatcttgcctggttaaagggcttctgataaagcttcatagaaaaattggtgttttttgtgggtttcaaagctgtgtaagattttgctacagcaggttatctaaagcagaggaaagagatggaacaaggatatagcgatatgaaagtgcccccagagaattatatgaagttcagggggctggggagggctgggaggctaagatgctttgtttggttggggcctagggaaggtgttggtgactccactaacaaaggtgttaatgactgcactaacaaagggggacttcattttgttggtaatggaggactgtcaaggtttttaagtgaatgttaacgttagtacgtttttcataaagataactttgatagcagtatggaagtttgattaatcatgaaaatagatacttgatatgttttgaaatattgaataagaagcctactttgattagtggttttgattatcaaaataattcctgatttccataggtagtattcgtttttaggtctactgtaagtgaagatattgcttacttattcataaattttttttctatagcacattttgataatgctttggactgaaagtaacaaaaaagtctgactcaagtatcttaaaaggagattcatgatctcgtataactgtaaatccaaaggttgtacagccccaagtgtgactctagccatgctgctttgtcattcttgggtccagaaaagacaaaaagaccacctcttcctctgactcattgtagggaaacggaaccttttcaccaaaacttcagaggtctcgttggctagaactgggtcaaaactcctcttaaaccttggtaaagtaaaaggtacctctgtgattagttgatactagtcaggatcaccgcagaactgaggtgagttcgcctttccccgtatcatataggagaagagaggatcactgaccaaacaaggaatctattggctagtggcgcatggggtggatattggagagatagctagagggtctgccaaagagaattttggtaaaggtaaccttgaggaataaatagacttgagtgctactgtgatactgctgctgagttcattccacagccttgctgaaaagagaaccctctaactactaaatgtacacccctttacacttgatccaacaggtgctccctttatcaaaaataatgaggcatgtaacagtaaaacctgggaatttttattgaattttattcattggtaatctttatacatcttattattcaaccctaatgatatctgtaataaattgctttaaatttttttcattttagtaacttatgctgtaaatagaagaataattcaattagaggtattgaatgtcagattgcacaataatagccctgggcacactgtgaaattcatttcttcagctgacttactctggacaccacctgaacttatagcttccttctgtcagaaagtcagtatgcctcaggccattctaaaggtccttccagcaccttacctgtcatgtgcattctcttcttccctctgctgtgcagtgtggtcaccctgatatcttggttctgttgattacctcttctctgataaatcaatccatgaagataaattggctggttctatcccccttctcagtccgtgtatgtgactttttagagatcttcttgcctctttggggtaactcaaaggattgactccaataggtggtattttaggacagggcaggattttgagcactgtgatatctcttaaacttcactgttgaaaaagcaatatatacacagaactagccctactcaaagagttatttgagcccatgaattcatatttacatgacttctcagagagattccacatattcaagcaacaatcatttagagaaaaaacaaaatcagcttattaataaataataaaattgtttataatcaataataataatcatgaaagtgtctgaatttcctgatataaagaatacactaaaaaccctctttttacaaaaattatattgtggctttgtgttaattgaagtctctttcacattgtgaaaatagttactgtcattccttttttttttttttgagacggagtctcgctctgtcgcccaggctggagtgcagtggtgtgatctcagctcactgcaagctccgcctcctggttcacgccattctcctgcctcagcctcgtgagtagctgggactacaggcgcccgccaccacgcccggctaattttttatattttttagtagacacggggtttcaccatgttagccaggatggtctcgatctcctgacctcgtgatccgcccgcctcggcctcccaaagtgctgggattacaggcgtgagccaccgcgcccggcctagttactgtcattctttagccaaactttgactatgcagatctgatagccttgttgtcacttgagtaacctttttctccattactttttccctttctggatctaattttgatgtgggtctaattcatatctcttctttttaaagtgttcttttttttttctgatcccaccctgattcctcctgtagcttatagctcagattataacagacaacaaagcttaatagaggtcacagaaacttccagttctcactttgctgtgtaccttgcatttaaagtgtgtaatcacagaaactgcctagttaatcacacaagtaggtcttcttcaatgcccatgtggtgaaatggctttgaaacagctttctagcattgtattttttttttttggagacggagtcttgctctgtcgcccaggctggagtgcagtggcgcgatctccgctcactgcaagctccgcctcccgggttcacgccatcctcctgcctcagcctcctaagtagctgggaatacaggcgcctgccaccgcgcctggctaatttttttttgtatttttagtagagacggggtttcaccgtggtctcgatctcctgacctcgtgatccactcggctcggcctcccaaagtgctgggattacaggcttgagccaccgcgttaactggtaacacatagctatggatatgaataccaaaggatttagagaaataacagatgttaatctatccttccctctgcaaaaatgatattgggaatctcagtgcctggatggagtggcataggattttctttcatgaacaccgttgattgctgctgggcagtgtctagaaggactttccttttgatatccctttccaaagctaacacaggccataaattagcctgcaaacccaaggacatcttaccttttgtgacaggttatcccagccatgcaaagttagtttccaccatgtcttcctcatttaactgttttcctagcctagtggtttcaatcctggctacacattataataacctggggaattttaaaaactactaatacctgggtcccttcctactcccatagaccaaatggtgcagtggttttccagagtggtccctgggaccagcggcatcatcgtgggaaacttgttagaaatgcacattcaaggttctcacccagacctactgaatcagaatcgctgatggatgtgacctaaaaaactgtgcttttagaagctctctgggttatttggttcaaatttgagaaccactgatctaatgtttttctgcatgacattcacctgctatagttttttctcactatcttgatgtagtccaaacctcaaccctgcaccgatatgtcactcattcccttacagatatttgaataggaatgtttttaaatttcaataattaaaaactgttctcactcatattctaataaagatagtatcttctggataaatcccattgaaaaccatgaccagatgtttgtttgttctaaacatgtttggccattatgaattacatcaaagaagattcctgctgagccctctgtaactttctgtgacctgagatattgcactcttgatctggaaatttgttaattagctactcagtcagtcactgtaggtttattttgcagtaatagggacacggccgtgcaccaggttattgggattttagatccagtaggaggcacaactttctagaagtttgtaatcatgggggcaggaaagacagctcaacaggaaacctccggcagtagattgtgctggttggctggttaatgtactgtgtactttgtgatgtcttagttcaggctgccataacaaaaataccataaggactgggtagcttaaaaacagaaatgtattccttacagatccaaaggctgaggagtccaagatcaaggctgattctgtcttattgagggccttcttcctagtttgcagatagctaccttcttgctgtacccttggatgacagagagaaagatagtttttcatgtctcttcttataagagcgtgaattctaatctactctcatgacctaatcacctcccaaagtccccagctcctcatataatcacattggaggttaggatttccacatctgaatttgagggggagacaagcattcagttcataacactgaagggaatattattgggacatgcagcctgccaaagtgatcagtgcaagagttcatatagaaaaaggtttaccccataaattctgggatcacgataccttgtatttgttgtgccaattatagatatttgttagatggtatctatcaacatgagaggcagtgttaccaaattggttcgcagcatagtctttgtagccagggtgcctggctctatactatttactaactgtgtgatcttgggcaagtcagttaactgctcattgcctagatttatccacttgtaaaacaggagtggcaacagtgcctgttttattgggtagttggcaggtttaatgagttaatgcatatgaaacacccaaaacagtgcttggcatgtggaggtgctcagtgtgtttagttattattatctaacagatgccctttcctttaaagggttgccatgaggtcacctgtcttgaaggaactgtttaactctgaaaactttaggactgaaagggagttaggcagtgagattactattggagtttgtttgttcgttaaaagcatatctaataaggttttactaaaagtttcaaagccgtattcatgtttattaacttggtaaacctactgaccatatttaaaaaacagaaataaatagttctgaatctcttcagtgcaatttaaaaacccccaaagctctgaaagcagtaacattttgtaaacttggagctcctcatttggcaataaaagcctcacttaatacgcatgaattagttttgtattgctgctgttaactttagctgcttaaaccaatacacatttattatctcatagtttccatgggtcagaagtctgggtacagtgaagctcaggtggattctctgcatagagtctcacaggcctaagtcatctggtctacgcttctttgtagaggctctggagaagaatctacttccaagcctttttaggttgttggcacaattcagttccttgagattatagctgaggctcccactcccttgctggctgttggccctggattgttgcaggcgctgcctgcattccctgggtggtgatccccttcctccactttcaaaggcaacagtggtcagtcaggtccttcacaggctttgaatctctcaaacctcccattttgcctcatctctcttctgctcttattccaccatatctttcccaccaagtcttctgccttcctcttctgcttctaagggcttgtattagtcagggacaggactaataggatagatgtatatatgaaagagagtttattaaggagtattgactcacacaatcataaggtgaagtcccatagtaggccatctgcaagctgaggagcaaggaagccagtgccagtcccaaaacctcaaaagtagggaagctgacagtgcagccgtcagtctatggctgaaggcctgagagcccctggcaaaccactggtgtatgtccaagggtccaaaagctgaagaacttggagtttgatgtttgaaggcaggaagcatccagcacaggaggaagatagaggccggaagacttagccagtctagtcctttcaggttccactgcttgcttttatcctaggcacacttgcagctgattagatggtgcccacccagattgagggtgggtctgcctctcccggtccactgactcaaatgttaatatcctttggcaacacccttacagacacacccaggaacaacactttgcatccttcaatccaatcaagttgacactcaatatcacagggctcatgggattacattagaccccttcagacaatgcaggagaatatcccgatttatctatttatttttttgagacagggtcttgctctgttgctcaaggtagagtgcagtggaacaatctcagctcactgcaacctccgcctcccaggtgcaggtgattctcctgcctcagcctcccgagtagctgcgactacaggtgcacgccacaatgcctggctaatttttgtgtttttagtagaggccgggtttcactatgttggccaggctggtctcgaactcttgaccttgtaatctgcccacgttggcctcccaaagtgctgggattacaggtgtgagccaccacgccctgccgagagtctccctattttaaagtcagctggttagtacccctgattccatctgcaaagtctcttcgtgcagcacccaaatcagtgtttgattgaatagggaataggaatcttgggggacatcttgagaattctgcctaccgtaatacattagactatttatagtctttacttatcccacttagcatgaacatcatttggtacagaaatattaatatgtttgattaaaagttgttatccttcattctgctgggagcattgtgtaatatatgatgtgtgcatatcattacctttctaaaattaaacaatttctcaactccaaaacacatctggccccggggttgttgaagagattgtggacacattataaaaagttactggtgaaagatatttttgaaagcatttattttatattttaaaatactgtgaagtggtacatgtgtagcacccactacttgagagaaagtatgttagtgtgctctccagatttaaatttagagaactaaaagggatatgggagacagactcattattttaaagattcagaaaaaggtatcaatgttacagataagaagggaaaaagatggaagataacatttatgaaacagtatactattcaccttatacacaatcacacaacatagctgtgtgtgggtgtatgtgtcatttaatccttatgatctatgtggggtgttattttccccattttacatgtgctggaatcaagaatcggagactcatttgccaagggtcacatggctagttagcatgtggaactggaatttgaactttgttctgactttaaaaatctgctttctctattcatcgaagaatggtggcagatctgggatttcaactctaatcttctgtgtcaccctaaaaacacccagatagttgtttttaatacataattacagatttacaagtaccttttgaaatatttgcaacattttaaaacttagaggggaaacttacgatgcttattctgttatcagaattgatttggatttatgatatcagttatacgggattaaaattttccattatttcaggatcttttaaaaaattatttaaaccttaagattagattctcaattgaatattttatcctcggataaattctttattaaaaattatttgccagcttggtgcagtggcacatacttgtagttccagctatttgagaggctgaggtcgaaggagacttgagaccaggagctccaggctgtagtgttccataattgcacctgtgaattagacattgtgctccagcctgggcaatatagtgagagcacatctctaaaaaaaaaaaaaaaaattatttgccataaaattccatctctcaaaatgacagagtttaccaatatgacattcattattaaatgctggaaataatatattttccaatagtggaatatgtctacattcagtgttaagtaatctctcattattctttagatatctagtttgttattccttctatataaaatattctcttttgaaaaataaacagctcccctgctgttttatgtttaaactcctcctcactgttttggtctctgttttctccatgtagtaaagtgttgacagcaacagtacagagagataaaaatatacatcaattagagcagcaaatcacagtatagaagctaagtattttagttatggcatgagaaacacagctgtaataagtgtctcaataggaatttcttttgaattgttgctaaaattgtatttcattgttttttattttatgattgtcctagtggattaaaaaaactggaataggcatgcatattcaggattgtgcatcattttgaaaaataaatatgaagtaaagactagttattttactaatgtcttcattctgtttctttattctgtttttatagccacaaagacaatattctagttttgcattatttattataataaattttttaaaatcttggtttttcaggaccaactttatggttcaacaaaataaattacagcttatataacattaattccttaacaaaaataacattacaaatgaagctctgagatggataccagtactgatgatgagaatatgaatatttttccatttagactgaagcttaggaaaattcatatttttttcagcaggaatgaatacaattttattaacttatatgctaggaagtaaagaagtggaatgactaagaggagagaactaggctttgttttcaccttggccttgaggaaggtttctgtccatttcttttgtttgctgtttatggtttgcttttgttttatagacaaattccagctcaggcactatgattgcattatcatgcaattgtttctatcttttggggctaagaagaattgagattggttagattttatgtgatatcctcccaaaaagttacctcatactctggtacatctgtctttcagacaaaaggtatagaaacacatgcaggaaaatagtatacaggttaaatatttcttatccaaaatgcttggggacagaagtgtttggattttaaattttttcagattttggaagatttgcatatatataatgagatatcttggaaatagcacccaattctaaacgtgaaattcatttatatgtaccttacaaacataacctgaaggtaattttatacaatcattttgatagttttgtgcatggaacaaagtttgtgttaagcattttcatgtggaattttacacttgtagtatcatgttggcattcaaaaagttttgaattttggattttagggttaggaatgctcaatctgcataagcttttggccaagacagtatgaaaagcagtagaaactcaaaagctaatattgaggaataagtaattatctcttatttagagatctggtatatcattgtctcttgagaatgggatcaaggctccctaattttataggcctgtgtttatatctggggagtgtgcttattccaaaatgagaggatggcattttgaggtttaaggtcagaactgattgtggcccactgtgtgctgccacttcataactttgtttttaggatagtggttatttcctccttggcatggtggcctaataatgcctataattctcctgttactagcaggtgagaactagcaaggtgagacaagcaggagcaagcatactggaagtttctataacatgtttataggaaagtaaaacttaagattgagtagggatataaaagacccaggcttgagttgcagctctgtaatttactagttacataaccatggccatgctgtgtcatctctctggaggtcagggtttttttttactttaaaatggcaaatgttcttgttctgcttgacctggcagagttgttgcaaaagcctaatgttataaactttgccaagtagtcaaatatgatgcatatcatttgggaatctttcagttgcaaataacaaaaatttaactcaaatttgcaaaagaaaaaggaatttattgacttgtgacggaaatccagcgtagttctggtttttggtctctaggactctgttgctctctatctttagtttctagctcaatgtgtctggctaggataccttcaagcatcatttcagtagggaggactgcccgcctctgtcctagtgtatcactgagtctcactgtctggaaccagcttcgagtgaatcacaggcccattcctgtggcatcctaaccaggaaatatggcatggcccttggctgagactgggtgcacgcacactgggagctgggtgtggaatccatccctcccaaaccatgtgagctgaatgtgagggaggggtgatttcccctttaccagcatcagggaatacgatgccacaagaacagctgatcactaaacaagatactgttatttctttctctgtgacaaaaatgtttaatggcttaaaaggaaagaataaataatagttggtgggcattcataaagtaaagaaagaatcatatttcaaagggagattatatttaataagccagagaggaaaaagaccagaaatttaatgaggacagatcagtacaaggatctgggtgaagaagaaccttttcctttatgcaccttggaggagagtcatcatagttagtgatactaacctccactgtattgggtgaccattttataagactgttttcacttcctccttgatcctgacccaagacataattcatttttaagaaggctggcctcagtctaaaggaatgggattaggaaaacttcatgcttagatgaagtaagaggatgtaatttgtgaagtgttagaaccttagtaaaaactggcaattctttgtcagaaatgtatatgttattgtcagaaaagtagctacacaaattgtgaaatgaattctgtttttcagtgactaactgggatcagaataaaaagagttgaagcagggaaaattatgaaaacgctaataaaattttatctgggaaaggcagacagctgcaggaggcatgttgttgctgcccctgaggagagcagggaatcataggagatctggaataaaaaaacttaaaaggaagaaagttaaacagctaaaactcaggaaataagctgtcaatttaaaattgccctctttgttccagaaactttatattcattatctcatttaaacctcatgataattctattttacaaatgaggaaactcaggcttagaggagttaaataacttgctcagggttctacaattgcttaatataagaagtggggctttaactgggaatcaagaggctcagtggtgctgctgctgctgcaactcaggtattccctgaaacttattagaaaatagagtgaattttatacatttaggttctccccccaaatttgatgtatcctgagagaatcacactgaattttttttcaaaagacagaattacatgtcagaattaagaaagatattgtgaaatatttagctatttcaaatttgggaagcaaagagaagacagatttcaatctccaaatggagggcagggaatcttgttctttaagaaaaggaaactctgagtcaaaagacgagtattttcagaaaccttaaaaaaacttgtcactgttgaatggcaactggtatttcttgagatgattttaaatgttcctaaaaaaagtttctaaggccagaaaagtttgggaaaagctctgcattatatctgcctcttggactcatatatagacgaacatatggaaccagggaaattgcccttgctctaccgagtctcaagtgagcactcaggaatgaactggcttgttactggttacttgcacctggtggaaaagtacactcaaggcctgactctgcagaacagttaggaggatctcaaaagaaagatatttaaaaagacctgaaaatctaaatggatctttaaccatgtaagcagaagcgtcagtagctggagccttcttggggatttgaagtcctgggaagctgacttcctttcttgggagtactgctgcattgcctgcactaagaggcttcttcaggcagtggagacctgtaaccattttcctgtaatttggtacctgttagtctatcagctcagtgacaaatgcccacatgttaaaagctctgagaactcctaagatgaagaaacttgcttaatgcagcatttcataaacttccttggtcatttgcttttagcatcttttggaccatagttaggggaataaggctcaagatatgaccagggtcagattattacctttgagggccaaagtactgaagagagaatggtggctttgccaaatgtaactcaaaataatagaacactacattataaactaagttaaagaagtctcacaaggttctaattttctaaatgatgaaagcacttagcatttaccatgccaggcactgttccaagaacttccaatatataaatgtgttcaaaactcacaaaaagcttaagtaaattgtgtaaggccacccctggaatatgtgctagaactgagattcagaaagagacagtttgaggccagaaaactgaaaaatttatttcagcttttcacattattagtaatgtaaattttgtggattttagtcaaatttgggaaaacctctgtcataatgcactctaagattttatggcatttcaagttttgaggggacagtgaatgatcttaaatactcttaaacaatatgtattttgcctctcagattaatgattttgatgcttctgaagaaaatgacattttttccaaataattttttctctcattttcttgatggagagggtcttgattttccagagccctaattgtcagtgtagtttgactttggataatccagcactaaatgtgagaatttaatgctatattattataaaacgctaagtgtgctgggcatagaggtgcattcttgtagtagtcccagctgtttggggggctgagatgggaggatcgcttaagcctaggagttcaaggccaacctgggcaatatagggagaccctatctccaaacaaaacacacacacacaaacaaataattgtgccctgtgttcacccactcactccccattaaatttgtgtattatagggataggagatttcctgagctggttgccaggaaagagatttggaacaggtgcaactctttaacatactgaaaaacaatataagactgtgatctggatgtcagggccaggggaggtggggagcattctgggcattgcaggggtagtggaagctatctggataagcagatggttcctatggagtaggcagattttggaggctgcaggcccagtgctatcaccatcacagtgggatctactaccttcaaacaattttagctttaaggcagcagcaaagtgttctttccatacccaagcagttcttgtggaggtttgtatcagtatattgacaggctcagatcttgatcctatgacaagatggatgtgagctcacagagaccagtgagcacctattatacacagatgcttaaggtgggtggatgaagggattgggcagagagagatgctaaatctgtcacattaaccgtatttcactaatgtaggcttaacttggaattttactaatatgatacaaggctaggtccagggttgaatccaggttcattaggcctgaaaatcatttaattttaagggatacttttaagaaaaaaatataaaattatgattacaaagttaagtatggagatatttataactaatgaaaaaagaagtaataacatttttaaaagctgacaagtaccacaaaaacctacatatataacataaataccacaaaaacctagaaatataacatttaaaaatgaattgcttgatacactactgtaatatttcattataatttatatgctgtggctgcatactttctaatcatttctcttaaggtaatagtcattttgaaatatcactgtctagcttttgaatgtgtttgctcttgcttttctagttcttttaatcacttcttttttcattagttataaatatatccatgcttaactttgtaattataattttatatttttttctcgacacatacactctcccaatactaaaccaggaagaagttgaatctctgaatagaccaataacaggatctgaaattgtggcaataatcaatagcttaccaaccaaaaagtgtccaggaccagatggattcacagccgaattctaccagaggtgcaaggaggaactggtaccattccttctgaaactattccaatcaacagaaaaagagggaatcctccctaactcattttatgaggccagcatcatcctgataccaaagctgggcagagacacaaccaaaaaagagaattgtagaccaatatccttgatgaacattgatgcaaaaatcctcagtaaaatactggcaaaccgaatccagcaacacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctgtctatgacaaacccacagccaatatcatactgaatgggcaaaaactggaagtattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagttgttaagcaacttcagcaaagtctcagtatacaaaatcaatgtacaaaaatcacaagcattcttatacaccaataacagacagagagtgaaatcatgagtgaactcccatttacaattgcttcaaagagaatgagatacttaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgccccaggtaatttatagattcaatgccatccccatcaagctaccaatgcctttcttcacagaattggaaaaaactactttaaagttcatatggaaccaaaaaagagcccgcattgccaagtcaatcctaagccaaaagaacaaagctggaggcatcaagctacctgacctcaaactatactacaagtctacagtaaccaaaacagcatggtactggtaccaaaacagacgtatagatcaatggaacagaacagagccctcagaaataacgccgcatatctacaactatctgatctttgacaaacctgagaaaaaccagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaatcctaaaagaaaacctagcattaccattctggacataggcatgggcaaggacttcatgtctaaaacaccagaagcaatggcaacaaaagccaaaattgacaagtgggatctaattaaactaaagagcttctgcacagcaaaagaaactatcatcagagtgaacaggcaacctacaaaatgggagaaaatttttgcaacctactcatctgacaaagggctaatatccagaatctacaacgaactcaaacaaatttacaagaaaaaaacaaacagccccatcaaaaagtgggcaaaggacatggacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataagaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcagcactattcacaatagcaaagacttggaaccaaggcaaatgtccaacaatgatagactggattaagaaaatgtggcacatatacatcatggaatactatgcagccataaaaaatgatgagttcatgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggtgggggtagggggtatagcattaggagatatacctaatgctaaatgacgagttaatgggtgcagcacaccagcatggcacatgtatacatatgtaactaacctgcacattgtgcacatgtaccctaaaacttaaagtataataataataataataataaaaagaaaaaaaagaaaaaaaaagaaatatcactgtctatactgagaatatagagatccaaactttccagttagcatggttgtttcaaatttattttcaattattgatagttcagaaaaatttatttcagcttttcaccctgttattagtaatgcaaattttgtggattttagtcaaatttgggaaaacctctgtcatagtgcagtctaagattttatggcatttcaagttttgaggggacagtgaatgatcttaaatactctgaattaatgacccccatgacacagtttgttatcactgtcctcattcattaggataccaacagttttgcattagcttcattgatgtcagtatttcacaagtcagtcagaaatttaaattttctggtatgctcgtatgattaacttctcttcataattagattgttaaacaacccaagagcttattcattaatttcaattggttacgtggccattttttgtcacttttgtttcatagttcattaattttttgtctgaattattttattttagttgtttaatgaattttttccaaaattacaaaagaagtagtctttgctgtatatagaaatcaggcatcataatttttcactaatttttttgaaatgccttttaaaatcatagttaaaatagtgtattcaaacttcaccaaatatgctattctaataaaaaaaagtgcatttatattgattttatttttgacaggagtgcactttgaattttgattaggtgtctgtgataatggaattctctgcttattattttagacatctggtgactggaaaaattttccatagactagcttctattttaaaccttttatccctactaccctatccttcagttggaggcatcatggggtgcatccctgtggtaagaggtctttggccctgcaccttgttttgttgattgagtcagcacagtgggctctaagaatgtatctggatgtcatttctacactgctaaggccagcagtaactttactgtacacaatagtgatgtgaaccacgtaagtgtttccgtaactctacttttcatttgtctgaatgccaaaaatgtctacaaccattccaacccgttatggttgaatttctctctttttttttttcaaatataaatagaaccatgtgaacatattgctagggtctctctatagaacttgtaagggaactgtccttggaagaggctcttaggttcttggtgagcctacttctggctatgtttcacttggaacagatcacctaaagaaccgtgaaaggacaggccatggaacactggctataaggtgccagaactgacctaaatttcaaatgtgtctgataaaattatcacaggtttttcatctgaaatggttgtttatgaatttgctttaagactttttttgcaggtgatggacacccgcttttaactagttatggctttggtagaaagaatttactggctcgggtaacaaaccactggaaggtaagcaggttggaagtagcctaaaggtcgcctggatttatatattcgaacagtgtcatatctgttaatctgtttctttcttttcccatctctctttttctatgttagttttattctctactcctgaaaaaggcctttttcttaaaaaatgattgcaggcagtgtggggttctatagtctgaaaggcctaaaggaacttcttttccagctcctagtgggaacacccttggaatgactctggccagcttgggtgatgtgcccacctcaacttttccgtgtctctccatgagtctagcaagtgatagaacattgtgattggcatgtggtgggttggaatagaagagcaggtcccccagaaaagcagggtgtcattttggtaagtcaaaaccataattgtccactgtagtagctgaggccaaggcttggtgtggaggtggcatggaagtcatcaactgatgaaacctactgtgtggggtgccactcctcgtgtatacagtaacttatccccattttgaagataatttaggcacaaaattcactctaagtctcagaaagtgtaattttttgtgattagtaaatgtggtgtgctttttaaagtatgtgatggcatattaagagttaattcacacagtccttcattaaagtgtcagtaaaatgggactgaattagttctaaaaagcattcagggctctgacccatttaacttggaatataattaggaaagctagtagttgagaaagggatcagagggctcagaaactttcagaagcaacactgttaatgtttacactaaaatggtaaaaaggcaatgtttaaatctaaaactattattgatttaaactcattaagacaattgatattgaacattgaaattaaaaacactgcctgtaatcccagcactttgggaggccgaggcgggcggatcacaaggtcaggagattgagaccatcctggctaatggggtgaaacccgtctctactaaaaatacaaaaaattagccaggcatggtggcaggcacctgtagtcccagctacttcagaggctgaggcaggagaatggcgtgaacccggcaggcagagcttgcagtgagccgagatcgcaccactgcactccagcctgggtgacagagcgagactcaatctcaaaaaaaaaaaaaaaagaaaaacactgcgtttttgttcttcctgcatttttgttcttcctaagtcaacttgttggagaatattaatagttggcaatatgtgtctttagagggaagatgagtggtgaaccctgaaagtaacccttcatctcactctgtaaggtgtttctttctctttctctctctctctctctccgccccccaccccccaacctttctctctagcttctttcaagattttctctttgtcttcggtttgctgcagtttgaatgatacacctaggtgtagatattttggtatttattctgtttggtgttctctgagcttcctggatctgtggtttagtcattaactttggaaaattcttgactgttatgatttcaaatatttcttctttgttttctcttgcttgtttttatgctattctaattatgcataagtcacacctttggagattgtcccatagttcttagtagagtattgtgttctgtttttttttcttttttttttttgtccttgcattttaatctgagaagtttttgtggacatagcttcaaactcactgattctttcctcagttgtgtccagtctactgatgagcctatcaaaggcattcttcatttctgttaacagtgtttttgactgctaacttttccttttgattctttcttagaatttttctctctctgcttacattattcatcagctcttggatgttgtctactttttccactaaagcctctaacctagtaatcataaattccctgatagttccaaaatctatgtcatgttggagtctgcttttgatgcttgctttgtctcttcagactgttttttttcttgccttttaacatgacttctaattttttgttccaagctggacatgatatatcagataataggagcaaaggtatataggtcttgaaatgtttggtttgatgttaatctggctagttgtgcagttttaatgattgctttagctgtaggtgccagaagtttcaggtacttctaatgttcttgttttaattttccttgttgagtttgtgaaaacctaagaccttcttcttagagtctacaccttgcagccctttcagctgtaacccgtgaatattatactagagccctagagccctgttcatgtgctggtaaggtatggaggaagagcaagtgttctataatttaatgattaaatctcagtcttttaagtaggctcatccctctgctgtgaccttcacagtgtttctgaactatccccctcactccctttgctgagactagaaggctagaggagtctgtagttggggaaatgctcttctgttaggtaggataaagttctggtgaagtccttccctgtggagagtagccgtttgttctggggaatgttccaggtgtatttcatgtaattcatattggttacttttcctctttccctctagagccaaggactcgggggaccagggaaatcttcaccatgagaacatggtaaagttcccggaggcaaaactctcaaaagtatgggaacgccccctaagactggaatccccagatgtctctcatgcttatgttagtccacagtcagcctccagcaaagcatcaaagccattacccaagtcttccaccaatttatagcatccagtagcttctgctccagataaactgatcttagctattattctctatgttcacctgtttttccagattttggggtggcagtttgccctgtgactctgttctctgataggttcaagaaaagtcattgatttttagtttgctcagctttttttccttgtgaaaatgagggtaatgacttctaagctccttacatgctggaacagaaactggaaaactttatattttcaatagattatattttttctgaactttcttattaattttcattttttgtcacagagtcttgctgtgtcacccaggctggagtgcagtgatacagtcatagctaactgcagcctcaaagtcctgggctcaagggatcttcccgcatcagcctcctgagtagctaggattacaggtacacagcaccatgcctggctaaattttttatttttattttatgtagtcagggtcttgctctgttgctcaagctggtctcaaactcttggcctcaagtgatccatgccttgcctcccaaagtgttgggattacaggcgtgagccaccatgcctggccatttcttgaaccttctgaatgttatatggaaatgagtgattttcactgatgttagtatgttcatactcataggaaaagtgtttcccacactcatgtttcaactttactagagtgtaaggttgatgatgagagcgatttgtctcgattctttacccaaatgacgtgaattataggtactcaaaaatattcatggaaaggataaatattagttgtatctgagtaccactatcttttttcttgaaattaattcccttttaaaatcttaaatacctactaccctctccttctaaggagtaacatctatgaaatcataggtttgatatgctaattgtctatttttttctgatatatgttagtatgatttcctaaagattagactaaaagtttcctaaaatcatcccgtatctatctagtggcatatgtacccatgatggaaaacactcctctaagctgatgaataacatgtagctgtatactgatttttatgggttctgtcaaaaattagctgttaaacaaaaacacattgtcccaagtagggcaggacagagtctttctgattctgcataggcgtgacaatataatgggcccgatgctgcttctattctaggaaggttcaactttctcccaactccccatcataaactttttcatattttattgcaccattctttaaatctgaaaggtaggtgaggaagttttttcagcaggcacattgtcaagaagttatatacttttgactgggtgaagtggctcatacctgtaatcccagcactttgggaggctgaggcgagtagagcacctgaggtcaggaatttgacactaacctagccaacatggcaaaaacccgtctctactaaaaatacaaaaattagtcaggggtggtggcagacacctgtaatcccagctactcaggaggctgaagcaggaggtaaaaaagaaaaaaaagttatatactttctggcaacactgggccctctaagaatttgccacatcaaactgagaagttgctttgagagctttctggcagaaggagcttttgcagaggtcacgtttaccaagtcatcattccattgagatatgtggtattctagtgattcccaaatgctgatcctcagattggctgcagcagaatcacttggataactttcgaagaaatgattcctaagctaagtcccacccacagagattctgagtagatctggtggaggaagcctgggaatccacaggtttgtagaactctccaggtgattctgctacagagccatgacgccgtatgctctagtctatgcagtgatcattgatacagggtagaactttaagagttcaacatacactgacatttcttctcatcttgaataaagtaacaaaggtttaataaagagaaaaagaaatggattgtggatactaaataatacctttgttctgaagaagacaatgaaaagaactttaacaaccatttaagaagcagttaggggttaaagatgattgagttgatttgaaccctaataagtgttatctgttgattggagagcacttaataaatattaattatgaagtaaataaattttaccttgctattccagaggtagaaagagaatagtaaaatgcttaaataattaccccacttcatgccatattatagcaaaataaagcaactgtggattctgtctctgctcatgtaaccaggctgtattcaccatccctgctgcccttagttgtacatttggaatcaatcatcacaggcatgcatagctgcaagcatgtggtttcaggaaagaggttcagaaaagctaagtggtaaaaggaatatggtttgatcaaataaaaaagctgcattcatgaaactggaggaggagatggaaacagacctccaaacatcacattttatcttagtacgttaaatgtctttttaccaaagccaagcaaagcccagaaaatactaaaagcttggcttcagaagccaggcagcttggatttttcttggatgccctatgttccaacaaatgatgaagtttaatattctcatatattgttcttttattactaatttaagaacctacatttcattttgcgtagtgaaatttgtggggagcagaggcattattgtgttttctctttgagtttttgtttttgattaaagttatgtatttacattttttagtgaattaatttgtggtacacttttcccatgagacaactgctttcaaatccttctttttttttaatttttcttcatataacaaatgtatatatgaatgactgaactacaaaatattattttccttttccctaaagctgtatttctcaaggtatattttctgattgctttcactggaattggctgatatgattattacaaatgaggagtcctgggtcccattccagacctaataagtcagacttgctagtgtatgagttctaggcatttgtattttaaacaatctctgagtaatcttcatgcaaattgaagtttgaaagtcacttccctaaagcttcttgatttttttctaggaatgtaacattttctaattgtatttctgttttcatatccattgtcatttggttagggtcctatctaacaaatgtttaacttttaccaatgacgttagtacaaacaaggcaaagtagtaagtttaccctttctagaacaatgggaaatgtccctagagactgaaatctgagtcctagatgtgcttagtgctattgagttaatgcttctagttccttttagtggacaaatttgaaaattatgttatttttgaattagaattattaatgcgtaccttataatttgttaaactttatatatgtctttttttcttatgtgaaaatttatacttcctaaaaacagtaacataatgattttgtgctaattgtaaaaccactgtatgatgtttaagattaccttgcatctcctttggatcttagaatatttcccactaaggaactgtagtcaaagtagtatgctctgtgttctcactcatatgtgggagctaaaaaaagttgagctcataaaagtagagaggataattgtggttgatagagactgagaaaggtagtgggaagggaaggataaggagaggttggtaaatggatacaaaattacagctaggccagcatagtggttcatgtctgtaatcccaacactttgggaagctgaggcaggagtattgtttgaagccaggagttcaacaccagcctgggcgttatactgagaccttgtcgctacagaaaactaaaatattagccaggcatggtggtaggcacctgtagtcccagcttcttgtgaaggctgaggcaggaggattgcttcagtccaggagcttgaggctgaagtgagctatgagcgcaccactgtactccagcctgggtgacaggcctaggtaacagagtgagaccctgtctctaaaaataaaaattaaaaataaaaaaatacaaatttacagctagataagaggaataagttctagtgctttatagcaccgtagggtgaatatatttaacgataatttattgtatattttgaaaaatccaaagaagaggattttgaatgttcccaacacaaagaaatggcaaatgtttaaggtgatggatatgttaattacctgatttgatcattacacattgtatacatatcagaatgtcactgcatcccataaatatgtataattattatgcgtcaactaaaaataaaaggacaaaagtactatgctgtgtcagtaacttaaaatacttaaaataagttaccttaaatacttactctctctgaatagttttattatcaatttgctatatatgtaggtttattcattttagtttgttttcacctagggctggcactttttctttttgattaaatttaattcttgaaatatatgaggcatatgcatgtccaaaatgatataaaatatataaagtatgtactcagaagttttatttacttctattccttccacctagtttctacgtccatctcctgtataagtaaccatttttattaatttctagcttttcctttcactgtttctttgtaaaaaatgcaagcatatgtgtgtgtgtatatatatatatgtgtgtgtatatatatgtgtgtgtgtgtataaatacatacatatatatacatatatatcttcctatttctcttcagtttttcacaaagaataaaaaaaaatttgttttacattttttttctccacatacagatatgggaaatgaaggaaaaccttcacaaagtaccacattcttctcgactccccaaagactctgtgatggtcccattgagttactagttcatcttgttcttaggtcctctcttgtttcaggtctaaaccagaccctttaagaaagatctgttgttcaaggtcagtattaattatcccatgttaatgaaaatgacctgaaaaatcacatagtgtatcctgtttgtgggctaattcatttgtagattatctaaacaatattgatattaagtggccaagaaagaagtggttttgccttccttttttgtcctttgaaaataaaaggtccagatgtagcacccagaaaccaccgttctctttgttgtttcatgttgtttgagatgccacagtgtctttttctttttttcttccttaaaactttgttaataacaattaaaaaggagtgtcattattggactcctctgtgaggaaccttttattttgtaagtaaataatatgagaaaatctagattttttttcccccattactgttctaccaaagtagcatttcacactgagtagagcaggaaaacatagtaggtgtataaaaaacaaagaagccaaatctaataaaatagatgatggaattggaatttgggtagaaatataaagcatctgctttattccttatttgcaacatttgttgacaataaggcacattgtgaagaaagaaaccaatctttccaagaagattttgcaattgaactcactctttaagattcccaatggtatgttcgcttcctattttactgcttatggcacacaaaagtgagaacatgaaaatccctggagatcaaatgttgtttaaattgtttcttagcagtgaataatggctccttaggaataaatatgtgcattttacatggcaatctataggaggcaaattgcatacttaatttctgagaaataactgaatatagtaatgtttacataaagctttggacaaaggtattatcagcacacattgcttttcatagatagcttatgagctctatagcttttttgtataaaaagttttagtataacgtaagagtatttatctcatgacatattatacatagtggttttattttttgccatctataaaaatgtgtgaactactaaaccaaaaaaaaaaaagtttagcttcaaaactattcctttttgatttggcgaaataaacttgcaagcaatttagcactgacccagaaagaatatccattagcccttctgaaaatttagcatgctaggccaggtgtcatggctcacacctgtaatctcagcattttgggaggccaaggtgggtggatcacttgaggccaggagttggagatcagcctggccaacatggtgaaactctgtctctattaaaaatacaaaaaattagttggtcatggtggtgggtgcctataatcccaggtacttgggaggctgaggcaggagaattgcttgaatctgggaggtggaggttgcagtgagccgagatcatgccactggactcctgcctgggcgacagagtgaaatgctgtctctaaacaaagaaagaaataaatacacaaagtttagcatactgactttgaaatttataatggtataaacttacttcaaaatatattttgttctggccgggtgtggtggctcatgcctgtaatcccagcactttgggaggccaaggcaggtggatcacctgaggtcaggagtttgagaccagcttggccaacacggtaaaaccctgtgtctacttaaaaattacaaaaattagctgggggttgtggtgcgcacctgtaatcccagttactcaggaggctgaggcaggagaatcacctgaacctgggaggcggaggttgcagtgagccgaggttgtgccatttcacttcagcctgggcgacagagcgtgactctatctcaaaaaatatgtgtgtgtgtgtgtgtgtgtgtgtgtgtgtgtgtgtgtgtgtagatgtatttcttaaaaataaaaagattaaacctcaaatgataaaaaactacattagtgttctgtcatcttccataatatagatgaaaatggtcaagttcctgaacctttatgggagctcacaaaaatagtgaaagccatctcttaggtggatagcaatttttttctgggtaatagcaatgattaaacagaatgggctttgctgatatacctgtgacctactgcattctcatgaatattggtatcgtggtgttaatgcgcaggcattgagtattagtcatggcaagggacaaatatgtgttctctaactgcaaatgtaaaagaaactgacaatgacaatgacaaactcattagtatatttttttcctgggacctcattcaggccagaaccaccatctctttccattgtaatttgggattggttggctaaggcctaacaaaatgggtttttaagtcgctttgcctgtggtttgttgagaagggagggctggtgccacaatcatgtgacaatactccacagggggttctccatgcttggaggaggatgcatatttgccaaggggatgggttttgtgatttgtacttctgggctttcactgggagagcagaggcaacttttgtcttggtttgtttcctccaatgtgtatcgactttggctgtacttcttccttcactattccaaggcaccctgacagtaccacttctgaaattccaccaggtgaatgctcattaaacctttgacctcttccactgcatcgcggtggaataggcccaggcagtccctgagatcagcagattatttgtgccaggataacatatatttttagaattttaaattttatgtattttgtattcacatactatgtaattcaaaataggattattccaggaaagtttattttcagtgagaccatttacaaaagcatgggggtaagagaaccccaatggataatgcagaaacctggcttttagtaccctagttggggatgaggagagggagtgggtactggaacttaaggggtgagttctggaatttagggagtgaattttactctagagtcagaaacccctgagaggaaccacaatcttctttggagagacagccaactccaggggaccatgttcaagagagccaggaaataaatactttgtcttcactaatttttctcctcttatcttctgtcctgccttccatcatccagtcttaccagaaaccagaaggcagggaactctttgctatgaaccataaaggtcagcctcttggggcacagggcagtgtggcaagtgaatcacaaggaaatggaaattcctagcataaaagaagtatgtgaggctctttcctaccttggcacctagttctcctctgcaaaagcaaccatttcaccagagccttccagagaccttaatccactcttgttattttgtaagtaaactgaggagtggggattatttttacagagttttaaatttgcctaaagcaaacctttttgctgggaagaaaccccggtatgtgccaaaggtttgctgagggtcacaaaagacaatatgacacatatcctgtttctgaattctggacactttgtatactccattttgtccttaaaaataataaataggttaagtttttgtgttattgccttatgttttctattagcgatctggctcagaaataaaacatgtaaaaatatattggctgttttcagacaagtaattatagcattttttcttcaatggacttttcagtggttctaaagcacagtttccagacccactgatcatgaatggatgctgaatttcaggaatgactgaaattgtattcaaaatattatgtatgtgtacttgtgcatttttcaggagagtggagccatgactttcaggaaattctgatagaggttttcgagtcataaaagactcagagacaatggtataaagtttaattcatttggaatttcttccttctctcattacattttttttttttctttttgagacagggtctcgctctgtcgctcaggctggggtgcagtggtatgaccaaagctcactgcagccttgaactccagggctcaagtgatcctcccatttccgcctcccgaatgttgaggactacagacatgtaccaccatgcctggctaattaaaaaattttttatttttatttttattttttttttgtagagatggagtctcactctgttgctcagactggtctcaaacccctaacctcaagtgatcctcctgcctcagcctcccaaagtgctaggattacaggcatgaaccaccactcttggcctcattacacttaactattacttaactattaattagctattacttaaccatcacttacctattaatgtgacctctgctttcttagagttcagtaggccagacagagggaatgataccagatggttcatgacattgcaattcaaatgttctcagtaacttgcaaactaaaattcaatgttttggtggactaatatgtgctaaatgattcttatcatataaaacagtgagattttggtcaagaaattccactatgaccagttaataagatgatttatattcaatcagattgtttcaattggattttaccaagagaacagtgtttagtttaagtaataggaaagaggatttgggttaatgaaaaaaggtgcataccattctgtttttctagagaaaattgtctggaaattttatgatctgttttggtgtatgaaatttaatttttttcatatcagtaagtagagttcgtgaattaaactactacactcatatttaagacttcctctgatttcatcataaaattattcttttacataggatgattttaaatgtttgccatagtttttattccggctttatatttatatactctgtcttctggccaaatatttttctgagaaaaaaactataactttatattaaccatcactaggtaagttcaataaatgatattgtagcagcatttaaaagatttttcttttctctttcaaaaggcacacacaaactattgaaactattagtggagcaatataactcttgctgcactttgtaaaacattgctagactagattagatacatcgattcattacttttacttatttcacttttcttttgcttaggactctttgtttataagtatctgaaacctgacttaaccaaaataatgaatttactgatttttgttttctggttgtttcgtggtcttctcttcattcttttcttccttcgttttaatgaaagattgtttagatggattatattcagaacaatggaagtggaactggcctcaggtatgcctgaatctaggatctcagttatatcagatctctttatatttatttattgatattgtttttaatttctgggtacatagtaggtgtatatattcaaggattatatgaaatactttgatacaggcatacaatgtgtaataaccatatcagggtaaatgggatatctgtcacctcaagcatttatcctttgtgttacaaacaatccaattatagtcttttatttatttatttagagatggagtcttgctccattgcccaggctggaatgcaatggcatgatctcagctcattgcaacctccacctcccaggttcaagtgattctcctgcctcaatctcctgagtagctgggattacaggcatgagccaccacacctggctaatttttgcatttttagtagagactgggttttgccatgcggatcaggctggtctcaaacaccccgcctacctcagcctcccaaagtgctgggatgacaggcatgagccactgcccccggcttagttattttaaaatatacaattaaattgttattgactatagtaaccctgttgtgctatcaaatattagattttattgatttttctacccattttttggtactccttagctacccccacttcccccctaccctcctgttacccctcccagcctctggtaaccattattctgctctctatctctatgagttaaattgttttaatttttaaatcccacaaataagtgagaacatgtgaagttgctcttcctgtgtctggcttatttctcttaacataatgatctccagtttcatccacgttattgcaaatgaaaaaatatcattcttttttatggctgaatagtactccttgctatatatataccatattttctttatccattcatctgtggttggacacttagattgcttccaaatcttggctattgggaatactgcttccataaacatggaagtacagatgtctgttataccgacttcctttcttttgactatatacctaacaatgggatttctggatcatatggtagctctatttttagtgttttgaggaacctccaaactgttctccatagtggtcatactaatttacattcccaccaacattgtatgcaggttgccttttctctacatcctcaccagcatttgttattgcctaacttttggatataagccattttaactggggtgagatgatacctcattgtagttttgactttcatttctctcatgattaatgatgctgaacactttttcatatgcctgtttgccatttgtatgtcttctttggataaatgtatattcagatatttttgccaatattttaattaaattattggatttttctttcttttttttaaattatactttaagttttagggtacatgtgcacaacgtgcaggcttgttacatatgtatacatacgccatgttggtgtgctgcacccattaactcatcatttaacattaggtaaatctcctaatgctatccctcccccctccccccacctcacaacagaccccagtgcatgatgttccccttcctgtgtccatgtgttctcattgttcaattcccacctatgagcgagaacatgcagtgtttggttttttgtccttgcgatagtttgctgagaatgatggttaccaccttcatccatgtccctacaaaggacatgaactcatcattttttatggctacatagtattccatggtgtatatgtgccatatttccttaatccagtctatcattgttggacatttgggttggttccaattctttgctattgtgaatagtgccgcaataaacatacgtgtgcatgtgtctttatagcagcatgatttataatcttttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgttccctgaggatttttcttattgagttgtttgagctccttgtgtattctggttattaatcctttgtcagatggttaatttgcaaatattttttcccattctgtgcattacctcttcactttgttgattgttttctttgctgtgcagaagctttttaacttaatgtgatcccatttgtccatttttgctttggttgcctgtgcgtgtggggtattactggtattgctcactctgatatcctggagagattctctaatattttgttttagtagtttcagagtttaaggtcttagatttgagtcttcaatccattttgatttgatttttgtatatggcaagagataggggtctcgtttcattcctctatatggatatccagttttcccagcaccatttattgaagaaactatcttttccccaatgtatattcttggcacctttgttgaaaataagttcgttgtagatgtatggatttgtttcttggttctctatttttttacattggtctatttgtctgtttttatgccagtaccatgctgttttggttactatagctctgaagaatattttgaagacaggtaatatgatttcttcagttttgttctttttactcaacataattttggctattcagggtcttttgtggttccacataaattttaggattgtttttactatttctgtgaagaatgtcattggtatttagtaaggattgcattgaatctgtatattgctttgggtattatggtcattttaacaatatcttttcattttttgtgtgtgtgtcctcttcaatttctttgacaaatgttttatactttttattgtagagatctttagtttctttggttaattcctagctatttaattttataagtatctactataaattggattactttcttgattcctttttcagtaattgctgttagcatgtgtgttagcacagactggataatttataaagaaaagagggttcattggcacatggttccacaaactgtacagaagcatggcatcatctgcttctggggagacctcagggaacttttactcatggcagaaggcaaagtgggagcaggcatttgacatggcaggagcaggaccaacagagaagggagaggtgccacatacttttaacaacgagatgtcacaataacttatttacccactatcatgaaaacaggactgaaggggcggtgctaacccattcatgagaattccaccccgatgatacagtcacttcccactagaccccaccttcaacactgggaattacaaattgacatgagatttgagtggagacacagattcaaaccatattagcatgtagaaatgctactgatttttgtatgttgtttttatatcctgcaatatgactgaatttattagttctaatattttttggtggaatcttcaggtttttccaaatacaagattatataatctgcacacaaggataatttgacttctccctttccaatttggttgctgtttttaatttctcttgtctgattgctctagctaggtcttccagtactatgttgaataatagtgatgaaattgggcatccattgtgttgtgttcccaatcttagaggaaggtctttcagtttttttccattcagtatggtactaactgtgggtctgttgttatggcttctatcatgttgtggtttgtttcttctatagccagttttttgagggctttttgtcatgaaagggtgttgaattttaggaaatgcttttcatttcagcatcaaatgaaatgatcatatgaattttcttcaacattctgttaatatgatgcatcacattgattgatttgtgtatgttgggccatccttgcatccctgggatgaatcctacttggttgtgatgaatgacctttttaatgtattgttgaatttggtttgctagtattttgttgaggaattctgcctcaatgttcatcagggacgttggcctgtatttttctttttttgacacatttttgtctggctttagtatcagggtaatactggctttgtagaatgagtttggaagcattccctcctccaccattatttggaatagtttccgtaagattggtgttagtacttctttagatgtttagtaaaattcagccgtgaagccttaagcttgcagcctttgtttttgctgagagactttttaattacagttttgatctctttacttgttattactctgttcaggttttggatttcctcatggttcaatcttggtaggttgtatgtgtataggaatttacccatttcttctagcttttccaatttcttggcatatagttgcaaatagtagcctctaattatcctttgaatttctgcaggatcaattgactcttttctcttttttttcccccattaggctggctaaagatttgtcaattttgtttatcttttcagaaaaaaacaccttttgttctgatgactatttgtattgtttcaatttcatttatttctgctctgatctttattatttcttttcttgtactaactttggatgtggtttgctgttgcttttctagttgtgaagatgcttcattaggttgtttatttgagcttttctacctttttttttttttctgagacagagtcttgctctgttgcccagaggcattatcttggctcactgcaaccctacctcccaggttcaagtgattctcctgccttggccttctgagtagctggggttacaggcatgtgccaccacatccggctaattttgtatttttagtagaagcagggtttcaccatgttggctggcctcgaactcctgacctcaagtgatctgcctgccacagcttcccaaagtggtgggattacaggcatgagccactgtgtccagccttttttctacttttttgatgtaagcagttatagctaagagcttccctccttagtactgcttttgctgtatctcataggttttggtgtattgtcttgccattgtcacttattttaagaaattttaaaatttccttctttacgtcttcattgacctactcgtcattcaggagcatgttgtttaatttccatgtgtttgtatagtttccaaaattcctcttgttattgatttctagtttgatttcattgtggtcagagaagagatttggtataatttcatttttttgaatgttttaaagacttgttttgtggcctaatatatggtctattcttgagaatcatccatgtgctgaggagaagaatgtgtattctgtagctattggatgaaatgttctgtaaatatctattaagtccatttgttctataatgcagattaagtctgatgtttccttgttgattttctgtctggatgatctgtctaatgctgaaagtggagtgttgaaatctccagctattattgtattggggtctgtttctgtctttagctctaatatatatttcttaatatatctgggtgcaccaatgttgagtgtgtgtatatatatatatacacatatgtatatattttaattgttatgtattcttgctgaattgacccttttctcattatataatgaccttctttgtctcttttgtagtgtttgtcttgaaatctattttgtctgacataagtatagctactcctgctcacttgtagtttgtatttgcatggaatatctttttccatccttttattttcagtctatgtgtgtccttataggtgaagtatatgtcttatagacaatagaacgtggagtcttgtttttttatccattaagccactcaatgccattttaatttttttaattttattttttgtggatacatagtcagtatatatatttgttgggtatatgagatgtttcattctctgtcttgattggagagttcagtccatttaaattcaatgttattattgataaataagggcttatttctgttattttaaaatttgttttctggttgttttatggtcttttcttcctttctgtcttctttttaatcactgtgattttctctggtggtaggctttgatttcttgctttttattttttgtgtatttgttatatgtttttcaatttgaggttaccactaggcttgtaaataatataatccactattttaaactgatgccaacttaacactgattgcataaatacacaaaagaaagctaatataaactctgcactttaattttgtccaccctttttaacttttgttgtttctactttttattgtactgtctgtatcttgaaaagttattgtaattattacttttaatcagttcatctttttgtctttctgtgtaagatatgagtagtttatacaccaaaattagtcttataatagtctgtgtttttctgtgtacttactattgtcaataagttttgtaccttcagatgattttttgctgctcattaatgtccttttctttcagattgaataactttgtttagtgtttcttataggacaggtctggtgttgatgaaatcactcaacttttgtttgtctgggaatgtctttatttctccttcatatatgaatgatatttttgctggatatactattctggggtaaaagttttttttttctttcagagttttaaatatgtcatgccactctcttctagcctataagatttccatggaaaaatctgctgccaggcatattggaacttcattgtagttttttttctcctgctacttttaggatcctttcttttttcttgacctttgggagtctgattattaaaaaccttgaggtagccttgtttgagctaaagtctcttggtgttctgtaatcttcttgtagttaagtattgatatctttctctaggattgggaagttctgttattatccctttgaataaactttctacctgccctcatctctacctcctatctaatgccaaaaactctttaatttaatttgcccctttgaggttgttttctagatcttctaggtgtgattcattcttttttatccttttttaaaaatttgtctcctctgattatgtttacaaacagccatcttcaagctcactacttatttcttctgcttgattaattctgctgttgagagactctgatgtattcttcagtgtgttaattgcattttcaactccagaatttctgcttgatttttaaaattatttcagtgtctttgttaaatgtatctgatagaattttgaattctttctctatgttatccttaatttctttgagtttactcaaaacagcccttttgaaatctgtctgaaaagtcacatatctctctctgggataagtccctcgtgccttattttattatttggtgatatggcttggctctgtgtctccacccaaatctcatgttgaattgtaattcctaattttggaggtggtacatggtgggaggttattggattgtgtggctggtttctaatggttagcatcatccacctagtgctgtcttgtgatagaggtctcatgagatctcgttgtttgaaagtgtgtagcacctccctctttgctctctctctctcatgccagccaagtgaaaatgtgcttgtttcccctttgccttccgccatgattgtaaatttcctcaggcctccccagaagcagaagcctgtgcagcctgcagaaccatgaactgattaaacttcttctctcggccgggcacggtggctcatgcctgtaatcccagcactttgggaggccaaggtgggcggatcacaaggtcaggagattgagaccatcctggctaacacagtgaaaccccatctctactaaaaatacaaaaaattagccgggcgtggtggcgggcacctgtagtcccagctactcaggaggctgaggcaggagaatggcgtgaacctgggaggcggagcttgcagtgaaccaagatcgcgccactgcactccagcctgggcgacagagcaagactccgtctcaaaaacaaacaaacaaacaaacaaaaaaccaacttcttttctgtataaattacctagtctcagttctttatagtaatgtgagaatggactaatacagaaaattggtaccaggagtggggtattgctataaggatacctgaaaatgtggaagcagctttaaaactgggtagtgggcagaggatggagcagtttgaaggttcagaagaagagaggaagatgagagaaagtttggaaattcctagagacttgttaaattgttgtgaccaaaatgctgatagtgatatggacaatgaagttcaggtttaagtggtctcagatggagttgaggaacttattggggactggagtaaaggtcactcttgctttgctttagcagagactggtggcactatgcccctgctctagggatcagttgaactttgaacttgaaagagatgatttagggtatctggtggacaaaatttctaagtagcaaagcattcaagatgtggcttcttcttaccatgtatgctcagatgtgtgaacaaagagattatctgaacctggaacttatatttaaaagggaagcagagcatgcctggaaggtgtttcagagaccttcatggcagcccctcccatcacaggcctggaggcctggaagggaagaatgattttatgggccaggcccagggtcccactgccctgcacaacctcaggacactgctccctctgtcccagccactccagctccagctgtggctaaaagggccccagatacatctcaggctgctgctccagagggtgcaagctggagctgccaagccttccagatggtgttaggcctgtgggtgcacagagagcaagagttgaggcttgggtgcctctgcctagatttcagaggatgtatagaaatacctggatgtccaggcagaagtctactgcagggacagagccctcagggagaacctctactagggcagtacagaggggaaatgtgatgttagagccccacacattggggcactcctggtggagctctgagaagaaggccaccattctccaatccccagaatgatagatccactgacaacttgcaccatgcacctggaaaagctgcaggtactcaacaccagcctgtgaaagcggccattgggtctgtattctgcaaaactggggtggagctgctcagggacttgggagcccactttttgcatcagtgtggcctggatatgaaacatggagtcaaaagacattaaatgattgccctgctgggttttggacttgcgtggggcttgtagccccttggttttggccaatttctcctttttggaaagggagcatttacccaatgcctatacctccattgtgttttggaagtgactatcttgtttttgattttacaggctcataggtggaaaggacctgccttgtctcagatgtgactttggacttggacttttgagttaatgctggaatgagttaagactttgggagactgttaggaagtcattactgtgttttgaaatgtgaaaaggacatgagattcggtgggggaggcaggggcagaacgatatggcttggctctgtattttcacccaaatcttatgttgaattataattcccagtgttggaggtgcggtctggtgggaggtgattggattgtaatggtttaacaccatccctttagggctgtctcatgatacagttctcacaaaatctggttgtttgtaagtgtgtaacaccaccccctttgctccctgtctctctcttgctagccatatgaagatgtgcttatttctcttttgcttttcatcatggttgtgaattttctgaggccttcccagaagtagaagcctgtacaccctgcagaactgtgagccgatccaacctcttttctacataaattacccattctcaggtagttctttatagcagtgtgagaatggactaatacatttggttaagtcatgtttttctggtcttgctggtcttgatgcttatggatgttcattggtttctgggtgtggaagagttaggtatttactgtagtcttcatagtctgggcttctttgtacctgtctttgggaaggctttccaggtgtatgaagcttgggtgttgtgatatacatttttggttgctgcagctgtatctgcattaggggacaccccaagcccagtaatgctatggctcttgcagacttgtagaggtgtaagcttggtggtcttggataagatcctgaagaattctgtttatccaggcagagactcttgttcttttcccttactttctggcaatcaaacagagtctctcattctgtgctgggctgcctggggctgagtgtcggggtgacacaatcacccatgtggccaccatcactgggaccacagtggtggttcagacccagagctaacatagcactgcatcttgcccaaggccagtggtgaccactgccttgctaccatctatgtttgctcaaggccctaagggtctaccatcagctggtggcaaagccagccaggcctttgttcttccctacagggcaatgggattccccaggctttgggtgggtccagagataccatctggagatcaggacctggagtcagaaaccttagaaatctacctggtgctccattcttctgtagctgagctggcgtccaagccacaagacaaaatcctttctactcttgcctttccacaggcagaggattctctccctgtgtccaccaccccacaggcccacgtggagtactgccaggctaccactaatgtttacttaaggcccaggggctcttcagtcagtttgtagtgaatgcttctaggcctggagctcactgttaagggcagtgagctcccctctggcccagagcagatccagaaatgccttccaggagccaaagcctgggacctagtacttcaagaacctgcttggtgctccaccccagtgtggccaaactggtacctaaggtgcaagacaaagccccctttactcttccctctgcttttctcaagcagatggagtccctccttgtggccaccatagctgggaatgtgctagtgaagtcagcacatctcagagtctcaccccaggcccacggcatgtactgcttggctactgctgccgattattcagggcccaaaggctctatatttagcaggtgatgaatcctgccagaagttggtccttccctttaaggtagtggcttcctttttgggatagcgtgtgtctagaaatgcctgggagctgggccctggaatgagggcctcacgactcttcccagtgccatattctgctgtggctgagctggtatccaagttgcaaaacgatgtcttcattactcttccctgtcctctcttgaagcagaaggaagaagtcttttttggagctgcaagctgtgctgccagggactgggggaggtgtggtacaggcactcccttagatacctcagctcgtgtctcagtaacttgagtgcccccaagtcccctaagcccagcacagcactaggacttgcttaggagttgcagtccttatggcttagactgtctttcaggtttatttagggcaccgaagcactttagcctcaggtagtgaggcttgccaaactcaagttctgaccactaggatggtcgattcccctttggctagggctcatttaaatgctccttctgtgggcatcagctgagttctgtctggtgttgcagcactgaattccaacgcaaagtcccacaattgctgtgctctcccttgcctaagtgcacagtttctctctctgtgccatgaggctgctgctggggtgtggggaagggttgctgttggcaattgaagactgtctttcctactgtcttcagtgcctgtttcagtgattagaagtttaaactatttactgatctctcacctgattcttggttcttatgtaagtgtttttctgtgtagatagctggtaaatttggtgttcctgcagagaggatgacctgtggaagcttctatttggccatcttgccctgcctcattctcttgctcctttatttcttgattctacttgagtttgtgtttgcctcgttctcctaatatggtttttcttcatgccaagaaacagattatggtcaccgaaaggtcaagacttgttatactctaggcagcaaacactgtaggaaggaaaactttcttttcacttattaatatatacaaatccaagagaaaggagtttgttgccttggcttgggccctagatccagttgtgtcaattgctataccagcagcttatcccacatttagcagtccatttatggaacagtggagccttcccccaagggaaggggtggggatagtattatcagagtaagcagataaggttgctgggctggtgtagacagcagatttccagcacaatgtattatgtatacagttggacctccacatctgtgggttccatattcatagattcaaccaaccgtggatcaaaagtatttttttaaaaattggatggttgcatctgttctgaacatgtattgattttgttcttgttattattctctaaacaatacagtattacaacaatttacgtagcattcatgttgtattagatattataagtaatctagagatgaccagagtaatgcataggctgtatgcaaataccacaccattttatataacagacttgagtatccatggattttggtatctgctcagggtcctggaaccaattccccaaggataccaagggatgattttagtcgtgtcagaaaatactgctaccaaattagtaactagagtgctgtcttctgagtttcataagctatggattaaacttctttttctagcagtaaaagcacaggcaaagtcaggaaaaatatggatctgtttaatttccacatgttcttggtctttgtgtagaagaaagtcaagtagataatacttacatgtaatcatcacataatctttattgttgcagaaagcttttaagtcaccgactagctggcaaaattaaatataaatgcaaatgaaaaataagtatcacagtactttttatgctactcacacatttggaaataatctctgcatgggtatttaaaacacaataggctttcactgcttatttttctatataatccttcatttttcttttggaaattaccaaaaccttcactaaagaaagaaaataacccagagttgtaattgatgcaaggtttattgcccctcccaaagttcagaaatcctctagtgtgaatgtttttatttgcttaattcttttgatggaaaaatataatatctttcttctgttgcagcattctaatgagggctggggatggacatgaaagggagtaaagatgtaaaatatttttcacaattgtatttttaatatagcaacccattttatcaccacatttattaccatttgtaatgtttggcaatcattaataatacgttaacagtataacagcacagatataaggaagtttccttactttagcacttcactggaatacagtactgtatctgtttcccctttgatataaaacctctggatacattgagcccatacttagtttatttttattttaattaactgttctcccttatccttccttgctgcccagtctgtgagaaagttgtgaattagaataaaatgaaaactcttctgattcattcaccaatttttgagtgttattttgtacagtgactgcaatttataacaaaaacagaaataaaaagaaaaagagagcctcctcctatgtaatcttaccatttgaagaaaacagttggcttttccttcttttctttcttttcctttcccaatgagaatatatatatattttatgtcatgtcattgtgatcatacttaggtagaatttgtagtcttccctctccatttaacatctgtcataaacatttccatgtattccacattcatttatggctacatatttgctgatgttccataatatgcaaaagaattgaaaatttcattggacatttatgttattttcagtcttgaactctataaatgatgctattatgaacatatttgcgcagtagagcctctcttctgggattctttctttgagaaaaattctaagtaatggaattagtagatcaaagggtagatacattttttatagcccagttttctagtggatttgagatgtttttgacatctggaaatatttaacgatgatgttttgatagtttattttaaattaaagctcttaaaaattcaattttttcttaatgtaattttaattcttattcttcattggacctatcttatgcgttctacaaaattatctccattttttctgtttcacatgatagagaaaaaaatgaaaatctaaagcctagatttacatatgcaagaaataaaagggaaagatgagaggacatatattgattttttcaccctgttgtctaattttcattaagtctgcctgctgtccaatttcccataggttggcctgctacctaatttccattaggtctgccttgatgtgttttatttttttatttttatttttatttttttttgcctatggataagagcttatttcataactgtatctgtatgttaacctttaaaccctgctgtggtcaatgaagaatgatgtttgataacatcctcaccatctttcccttcacaagaagattttgtacaattataccggctttctataccttatacacacactcactttctctcctgggagtttttcataaaactagatcactttcattttctgtgataatatagccatatgtactatctctttaagactttcagtgggaaactttgtgccaatattcagagagtcttaaatgcctgttgtacagcttgataaaccaaagataatgggtttaattctgaacttgtatctcataagcagttttttgtaccccatggacatagtgatatatctcagccagcatagaaatattcaggagttatgagctacttgattgtaagtgttgggaaaccagacaacatcttgtaattttttgtgtgtctctaggacctagctcagttcctgacaagtgtgacttttagcattctccatgtcctgtggatagataagtatactccatctattctatgggagagaatgtagactatgaagtgataagtttcaggaataattggcttattttgacttaggatagaaaggtattaaaaattagcaatgagctaaatttattacatatagtgtaaattttagaatgttttggcttatggttgtcagacatattcactgccttatgaactacaaaatccctggatttaaacttagactggagcatccaaatataagcacgctctaaaaaaaaagtcacataaacagaatgatacatctctgctattcttttttttttttttttcttttgagacggagtttcgctctgtcgcccaggctggagtgcagtggtgcgatctcgactcactgcaagctccgcctcccgggttcacgccattctcctgcctcagcctcccgtgtagctgggactacaggcgcgcaccaccatgcccggctaatttttgtatttttagtagagacggggtttcaccgtgttagccaggatggtctcgatctcctgacctcgtgatccgcccgtctcggcctcccaaagtgctgggattacaggcatctctgctattctacatagtaactgaataatagatatttcttcttcttcttcttttttttttttttagacagagtctcgctctgttgcccaggcgggagcacagtggtgccatcactgcttaatgtagcctcgaccttctgggctcaagcaatcctcccacctcagcctctcgagtagctgggactataggcatgtgaggccatgcctggctaattttttagttttttgtagaggttggttttcactatgttgcccaggctggtctcagacttctgggctcaagcgatcctcctgtcttagcctcataatacatttcttaacccaactgaagagctccagatttttccaagactatggatctgcaaaggatggtagtcataatcatcaagtttatgagaaggagttttacattagaaaacaatttcatgggccgggcatggtggctcacacctgtaatcccagcactttggaggccaagggaggcggatcacgaggtcaggagatcgagaccatcctggctaacacggtgaaaccccatctctactaaaaatacaaaaaattagccagacatggtggcacacgcctgtagtcccagctacttgggaggctgaggcaggagaatcacttgaaccgggaggcggcggttgcagtgagccgagattgcaccactgcactccagcctgggcaacagggcaacagagcgagattctgtctcaaaaaaaaaaaaaaaatatatatatatatatatatacatttcatgtacggtggctataatctgaacctgattttgtttctatatctttccaaatattaaggattccaaggacagggacagataatataattatggttgaaatgtttttcattcatgtttgcatgtgtgtgtgtgtgtgtctgtgtgtctgtgtgtctgtgtttagtatgaccagtggtgattactgtttggcatttattacgtatctaaaaagagaaagaatgagccacttttctttttctcactatcttgtttctatctgtgttattctactgaatatactctcgccactttaccagtaacatactagtcttcaaacttaatgaccgtttttgtccttggattctctgtaggtacttgaaaaggctgattctctcatcctcaaaactcttaatagtaattcttccttccttttctccagcttctttttagcacatcttccctctctaaatgtagacatatccaagcctgagtcagtgtccttttcactctcccactcatcacagttcaaccctatttctgtagatatttgctaagcctgacctctttcatgactgttctccccacaccaccagttcctattgcatctttctcaaagggtcaggatttcagttatcacttcaagatcaacacttccattttttttttaattttattttttgagatggagtcttgctctgtcacccaggctgaagtacagtggtacaatcttggctcactacaacctccatctcttaggttcaagctattctcctgcctcagcctcctgagtagctgggattacaggaacccgccaccatacccagctactttttgcatttttagtagagacgaggtttcaccatgttggccaggctggtctcgaactcctgaccttaggtgatccacccgcctcagcctctcaaagtgctgggattacaggcgtgagccactgagcctagccaacacatccattgttaaactcatcagcttactccccatcaccatcaggtcttctagattttcacacatctgtaagtggttctgtctatacttcccctgtcatccaagtttattaaatatctgttgcagatgatgtggtaaagagaaaattaaaattttatttagttttttttttgttttgtttttctattgctgtgtaacaaattaacacaaacttagtggcttaaaataacacaaatttattatctcacactttatgtggttcaggattttgttttcagatgagctgggtctctgcttagggtgaagtaaaggtgttggcctgtttgcttgttcagatgagctgggtctctgctcagggtgaaataaaggtgttggcttacatctgaggtttgggggttttctcagagtcattcaaggttgttggcagaattcagcattccttgtggctcgatgactaaggtccctgttttcttgctaagagttggatcaaaacctctcttagccccaaaaggtcactctcagatcttgtccaatggccccttccataggcagtttataatatggcaactgctttttccaggctagcaggagagcttttgctatggcttctgacctgattaagggctcacaatattaaattaggccactcaaagttgtctcccttttcattaacacaaagtcagctgataaaggaccttaattacatctgtgaaaacccctttgccatgtaacattatatggatggtaacccatcgtatttacagtcccaccaatattcaaggggaaggaattgtgcagggggtatacaccttggggtgggaatcttgggggctatcttagaattctacttaccacaggacagatggaatcaagaatggtagtgagtgccatcattaattatttgcggaagttaaaatagttatactaacatagatggtgccaatggaatgctagcttggagttttacattagtatgtgcatgtttgtggaaaactatactaattacacatccatatatattttatatatataaaaatacctaaaaatgttttaatatactcatctatatctatacattcattttatcttaaatctgtctttgttacctctttgtaaacatttcccacaactcaactatatttgaatgtgaaatttaagattaattttgcaaatatcatgtttttaatgagagatacacgccagtacttttgcccttatcctttgttataaaattctggacaatttaacatgcttttttccctagcccaggtaaagtgtaatgtaaagtgactgccttcctctgtcttcccagataaggataattgcttctggtgaataatcaaattatggctttcatcctctgacctttgaaggaatagcattccctttattttaagttgcctttgtgtgtatgtgtgtgagccaagccacattttgaaatgcaatttttcttagaaacagatctgttgagaaacaaaataaaaatgtagatttcttatttgaatagagagaaaagtgtttttctctggtttcttaaaatgtatttataaatagcacctgtttctatgtaaatatagagatttgttgttaattgttctctgctggtattgctaaaattgatgatagagcttttctttgagtcatatctatactgtattgtttgctgtactgtctaaatcatttctccaatctaagaagaaagtttatcttcaggggagggctttctcactgttttccattgattttgaatacatcagaatctattgccagtttttgattgtttatttagtaggccataagaaagattcaagtttacttccattttgcagagggtttgaaaatttataaattttccaaatatggtgtgttagctagagcatcttgtagggaggaaaaatgtgagaagtgaactttggtttcattttcaaattggtggattatgttgatctggtatatagctggtatgaaactaaatactgacacttaaagacttaactgttttgtttgcctgtttaatttggagctgcttatagctattgagatcattacatgcaacaatcttttgtatatttattcatagattactctgctatacagcctttagctttatacttgatttgaagtttgaaatgaaattggaaattaatatttttacctttactcacatgcacattcagtcttcatttctctccattgacttagcatttctcttcatttaggaaaaaaaatagatttgtggctcagttagtaattatgttcatcctccaattcaagtctttcctgaacttgttcaggtcaggctgacattttgcacttgattaagggagactcgatgatagctaggaatccacaatataatatcttgttcttgagtgtgacttaatgtgcttctaacctaatctcaaggtgtcctgattgtcttgttcattcattgatatttcttcctatttccttggcataccagatcaaaatttgaatatattaatagccttctaaggaaagaaatacaccatagctgtaaaagaagaaaaagttgcttctggtagcaagaaggtggatgacacaaacttccttgcgcaatggtgacctttcaattagcttacctattttctctgttctttgagggtttgatgctagctgcccatttcaaatctgcagcttcaaacaatattgctgtttcttctttgaaacatagatctcagggaagtgactgttggaaaagtaataataatgattctgtttattattttattaactgtatatattagtacagataaatgaacacatggataaagaatattctatactttgggaggccgagatgggcagatcatgaggtcaggagatcgagaccatcctggctaacacgatgaaaccccgtctctactaaaaatacaaaaaattagcccggcgtggtggcgggcacctgtagtcccagctactcgggaggctgaggcaggagaatggtgtaaacctgggtggcagagcttgcagtgagcctagatcgcgccactgcactccagcctgggtgactgagcgaggctcagtatcaaaaaaaaaaaaaaaaagaatattctacttttcagggtaagatttatgccattccatattatagaaaatgtatgctagccagtctcagtggcatgcgcatgtagtcccagctagttgggaagctgggggatcacttaagcccaggagttagaggttctagtatgttacgattgtggagtgccctccaacatgggcaagcctggatagtgagactccatctcttaaaaaaaaagagaagaaaatgtatacttaaaaatttatatttatttccaatttgaatcagtgaaaaagctgagtaaaggtatagacaaaataaagagcatttacattatttatttcagatacatccatgcaaatccacacaagtccatatgtggatgtaaattgtggagagtttttaatcagtgtgcatgccatttaaaaatacaagagatcctagggaaaataatttccatttttagcatcaaagatacttcatctgtttttataaatgtgtgttatataaatcaaatcaactattcttctcattgctacagtatggcatacattaaatccaaagagaagtacttgttcttgaaattaaaatagggaagccaaacaatatgtcagttattaaaaagtagatttttaaaatgattttcaaaattgtagtcaaataatagcccttgactgctctcaaatattacattgcagttccactcttagctaagctattgataattcaattatttgaagaaagtggtttaaaattaacttaaaagttactcttcccttttggataatagattctgcatcatatcatctatgattatgatgatgatgtctttagagtgctcaggaactgctatgttatctgctctgttatgtggttccataatgataacatgcagatggatgtatacgtggaattttcaactaaaagctcctcgatttggagaaatttattaaattcatataatggagactttttgtttgtttttgagatggagtctcactctgtctcccaggctggagtgcagtggcgcggtctcggctcactgcaacctccccttcccgggttcaatcaattctcctgcctcagcctcctgagtagccgggactacaggtgtgtgccaccatgcctggctaattttttgtatatttagtagagacagggtttcattgtgttagccaggatggtctcgatctcctgacctcatgatccacccgcctcggtctcccaaagtgctgggattacaggtgcctggcctttttttttgagaggaagtcttggtcttgtcagttaggctggagtgcagtggcgcgatctcggctcactgcaacctctgcctcctgggttcaagtgattctcctgcctcagcctcccaagtacctgggattgaggcacctgccaccacacctggctaatttttgtatttttagtagagacggggtttcaccatgttggccaggctggtttggaactcttgacctcaggcgatccgcccacctcggcctcccaaagtgctgggattacaggtttgagccactgcacccggcctttttttcttgagacaaactctcgctcttgttgcccaggctggagtacaatggcgtgatctcagctcactgcaacctccgcctcccgggttcaggcgactctcctgcctcagcctccggagtacctgggattacaggcacctgccaccacaccgggctaatttttgtatttttagtagagacagggtttcaccatgttggccaggctggtctcaaactcctgacttcaggcaatctgtccacctcagtctcccaaaatgctgggattataggcttgagccaccgcaccaggcctaatagagacatttcaaccatgaatctcctttgttaattctttctatgtcttgcagttaggttattttttttttcttgttgctttcccacccagctttattaagatatgattgaaaaaaattgtgtatatttatggtatgcatgatgttttgatgtatgtacatactgtgaaatgattacatcaagtgaattactttatctgtcacctcacgtacttttcatgtttttatggtgagaacatttcaccatttccaagtatataatacattactaactgtagttaccacagtgtgcaatagatctccagaacttattgccccagtataattggacttttgtaccttttaaccagtgtctctctgtacaccctcctcacttcctccagagtctggcaccatcattatactttctctttcgtgagttcaacttttttagattccacatgtaaatgagatcatgtagtatttgtctttctgtgcctggcttatttcatttataatgtcctccaggttcattcgtgttgttgcaaatgacaggatttccttcattttaaggctgagtcgtattctattgtgtgtgtgtgtgtgtgtgtgtgtgtgtgtgtgtgtgtgtgtatgtcaccctgttttctttatccattcattcatccatagatacttagtttgaccccatatcttaggtattgcgaatagtgctgtaataaacatgggagtgcagatatctctttgacatactgatttcattttctttggatgcatacccagaagggggagtgctggatcatatcatagttctatttttaattcttggagaaacctccagattgtttttcctaatggctgtactaatttatattcccatcaacagtgtgtgagagttcctttttctctacatcctcaccagcccttgctatctttttgttattttttgataaaagccattcttacttgtgtgaggtgatatctcattgtggtttcactttgcatttccctgattattaatgatgttgagtattttttcatttacctgttgtccatttgtatatcttctttgtaaaaatgtctattcagatcctttgcctattttttccatcatgttatttgttttcttgttattgagttttttgagttcctcatatattttggatgttaacaccttatcagatgtttgtttcagaaatatttgcccccattttgtaggttttctcttcattctgttgattgttcctgtgcagaagctttgtagtttggtattatgctatttgtttatttttgcttctgttgcctgtgttttgggggttatagccaaaacaattattgcccagagcaatatcaggaagcttttaccctatgttttcttccaaaagttttatagcttcaggtctgtgtttaagtctttagcctattttgagtgttttttatatatgtcatgatttcagagtctgattttattgttttgcatgtggttatccagttttccaacactattacagttaggttaatttttataggactttcatcttgaatagttctttaatgtgcactggccactttgttgatacaatataaaatcatgggcaacttagttttactctttttcattaatagtggaatgtggttgttcagatggtagactcaggaattagacctacgtgggaatacatcttggtgtaatcattcaccagctgtggaacttggtgcttgttcctttcactggccacttgtgtacctccttgggcttgccatttgtcttcaggcatctatttcctagcctaccaaatgagatcatatttataactaccttcccaattggctgtttatttctgtgatctatggatgcatttaaaatacctagtacagttcctggcacaccataaatgctagctggtggtattatttcctcaacttaaactctcaggcaggcttatcttttctctacctctgtagttttttccctgccacagctttgctgttgttattcttttcatttgaaatgttcctctatgcctctttacaaaccatggacatttaatctatcttccagcaattaagtcttcatgaatcctgatttgactgttctaattcaccaagatcttttcttttcatggagtctgtgtgtctactgtcagttctgtttattgtgactctcaatgatacattgggatttgatttttgtattttcttgttttgttaataagactcaaaattccatgcagtcaagtgctctctaaatttttacatatttctaaaaattgagcacacaggcatgttttggatttttttgtcttttattaaaaaatgattttttgttatgtaccatgaactgtatgtattctgaacattgaagatactactaattattttaattgttaacaatttgattaagttatatgagtttgtaatacactgagatacattcaaatttccgttgttatttattttagcgggatctttcacaaaaatttatttttaaagtgccatgattagattacacgtatgcagggcactgaatttataagtaaatggatcaaataaataaatgcatcagatgtatatacatttaaataaaattattcacatatacatatatataagaaaagtgaaatacattttttaaaaagatgaaaatataaaattagcaataaaaaagaagtgaaataaaagtaaaaatggaagtttcttgaacttctctgccactggaatacctctctggccatgttttcttcttatgtcctgccctgttgctagacttccacaacttttgaaataaatattttccctgttatattattgaatctgataatatttgtgctgatcggcagcctacttttttcactgtttattttataaaaatttttacgtttcataagtagatccctatggtatttttaatagttacatagtatgccagtgtatgattgttttgtaatttatttaacaattaacttcttagtggatagttagattgtttctagtattttgctgttattatatgaatatccttcacatattttactattctgggccaattattttctttggaccttttcttaggagaggcattttggtgactagaaatatatcctctatttatactgcatattgtcaaactgccttctataaagtctataccaatgtattcactcaagattaacctgtgttcctaaatttttattaatcttttaaaatacttgtttatgttaggtaaaaaatttcatctttcaatattctttgattctggaaagattgaacatatgttttgaaatgtatattggccatttgtaggcattttatgaattgcttcctaatataccatttccattttctactagaatgttcaccttttcttattaatttatacattaatagtatcaactattttttatatacagggtggtcgctaagtctagaaacacaggaaaatatataataaatggtttatagatattataattcatgatcaaataatatctgtttccagattttatggctaccctctacattctacagataattcccttttctctccctacctcccagtatgtcatttatcattaactgagtttagtgtgttttgtcagagggattatttagatttttatctaaaaatgtggccaaatttatagggatgttttattttcagttttggctttggttttagaaaggcccttctcattgaggaattagtcacccaaattttctcccatgacttttattactttattttaaataattgatcatttaacccacttagaatttatataggtgttagtgtgaagtaaggctccatctttatttttcagaatggcctgctggttgttctcagaagaggcctccacctgaggctttaatgactgctaactagcagatttcaagctcttgggaaatccctaacatctctgagtctcacttttctcacttgtaaaatggggagttagaatatttcttatctcaaattgaagtccatgtagggtaaataacttgtccagagtctaacatcttttctcatttggaatagaactttaccctgtacactgtttctttttttttcttttctgttttttgttttttgtttgtttgtttgtttttgagatggagtttcactcttttactcttgttgcccaggctggagtgcagtggcacaatcttggctcactgcaacctccgcttcccggattcaagcaattctcctgcctcagcctcccgagtagctgggattacaggcatgcaccaccacgcccggctaattttgcatttttagtagagacagggtttctccatgttggtcaggctggtcttgaactcccaacctcaggtatctgcccgccttggcctcccaaagtgctgggattacagacgtgagcaagtgcacccggcctaccgtgtacattatttcatgtgtcatttggataactatagtttggggtgaaagggatgatttttaccttgatcataaattgagaaatctaaggttagagttagtgaatggtatatagattcttttttatttttggtcagcagatgttattttaaattgatgaaatatattattttatataaaatacttttcataacagaaactttgaaatatgaagtgctctcagaagaattagtaatgttactttgtaaaaaatacaagaaaatgtcaactcagaaatcaaagtacagatacagaacatggtttttattttgattttgtttaaaaactctaacctcaagatgctttcttgtttaataaatataatgtaaatttttgaaagatttataaagaattaaacaggaaggccaggtgtagtggctcacacatgtaatccaagcacattgggaggccaaggcaggaagataacttgaagccaagagttcgagaacagcttgggcagcatagcaagcctccatctctactaaaaaaaaaaaaaaaaaaaaaaacctgggcatcataaggtgcatgcctgtagtcccagctcctcagaaaactgaggcagtaggatcacttgagcccaggagtttgaggctgcagtgagccatgattgtgctactgcactgcactccagcccgggtgtcagagtgagaccctgtctcaaaaaaacaaaaaaaggaattaaaagaattataccagagaaaatgagaaaatgcccagagtcagtcttagtgatttcaggataactcaaaaaaaaaaaaaaaaagaaagaaattaaaaaatattattgaatggtttgtagtcactgaagtcagagctagaaaagaccttaacttacctgatttttctttgatttgcattctctgatggccagtgatgatgagcattttttcatgcgtctgttggctgcataaatgtcttcttttgagaagtgtcagttcatatccttcacccactttttgatggggttgtttgtttttttcttgtaaatttgtttaagttctttgtagattctggatattagccctttatcagatgggtagattgcaaaaattttctcccattctgtaggttgcctgttcactctgatggtaatttcttttgctgtgcagaagctctttagtttaattagattccatttgtcaattttggcttttgttgccattgcttttggtgttttagacatgaagtccttgaccatgcctatgtcctgaatggtattgcctaggttttcttctagggtttttatggttttaggtctgacatttaagtctttaatccatcttgaatggcgatcattaaaaagtcaggaaacaacaggtgatggagaggatgtggagaaataggaacacttttacacgttggtgggattgtaaactagttcaaccactgtggaagacagtgtggcaattcctcaaggatctagaactagaaataccatttgacccagccatcccattactggatatatacccaaaggattataaatcatgctgctataaagacacatgcacatgtatgtttattgcggcactattcacaatagcaaagacttggaaccaacctaaatgtccatcagtgatagactggattaagaaaatgtggcacatatacaccatggaatactatgcagccataaaaaatgatgagttcatgtcatttgtagggacatggatgaagctggaaaccatcattctgagcaaactatcacaaggacagaaaaccagacaccgcatgttctcactcataggtgggaattgaataatgagaacatatggacacagggtggggaacaccacacaccggggcctgttgtggggtggggggaggagggagggatagcattaggagatatacctaatgtaaatgacgagttagtgggtgcagcacaccaacatggcacacgtatacatatgtaacaaacctgcacattgtgcacatgtttcccagaacttaaagtataataataaataaaaaaaaaaagaatgtggtttttcagtagtccattttttgctatttcttaacaagttttatagagtcttggcctttgacttagcctttttatattatcatttcatattgactattgaaagggtcttatactagacccattgtgcccactgagtaggagttatgagatgaagttattttgttctttttattttggtaaaattattttttgtatttttacctttgcctttcaacagggcatccttaaatatccctccaaattcagaatatgggtttaggctgggtttaacttgccagactgcttaaagctgtttgctaattgaatttatccaaatatatcatttgttgcaactttgatgtgtttgtttcactcatccaccatgggccgtttactgcccaccacttggggtgtccctgctatccacttcactttgtaaacattggaagatagttgagtaccatgaagaaaacaaagacctcgggctttagcacataaaaaaaaaattcccggccggacgcggtggctcacgcctgtaatcccagcactttgggagaccgagtcgggcagatcatgaggtcaggagatcgagaccatcctggctaacaaggtgaaaccccgtctctactaaaaatgcaaaaaaaaaaaaaaaaaattagcctggcgtggtggcgggcacctgtagtcccagctaccagggaggcagaggcaggagaacccgggaggcgtaacttgcagtcagcggagatcacgccactgcactccatcctgggtgacagagcgaaactgcgtctgaaaaaaaaaaaagttcccagatgctgctatttgattagattatcatattttgcatacttttagaatctttagcaaacataacctaaaatcaaagtacacagtacacatatcacaaaatttgtgataatttttggctgtttttccaaacagattgaagctgcacgtgatagtttccttgtttatctctattgttccttccacacacccatgtgacatttattttctttgtggttgactgagaaaaaaagttaactttcccatgtccttccccggtcagctatcctgtttgccttaaattctattgctcttcacttgtgttggtactttcaggcctttttcactaaacactgtctctcttcaaataccttctcggctgccatcattcatgttgaatctttcttcagttaaaaaagttcagcatggacttttatgttttacttcattgttaaatgtatattatgggttaaatgtatttatttttttgaaaatattatatgggtataggtacagaattttaaaaagtttcctttacatctctgtcctccagttatccagttccccctttgagcaatatctattattgcatttattgtcagtctccttcttgagggagcccatgtattcatgtatgcatgtatatgtgaatatacacagacacacagacacacatacttacagacacacacataattgtattttttgtatgcagatgttggcatattaggtacatcctactgatatctcttagcaaaagccaagagttggagaccagcttgggcaacatagcaagacaccctctccgctaaaaaaaaaaaaatttagctgggcatcatagtatgcatgcctgtagtcccagctacttgggaggccgaggtgggagggtcacttgagcctgggagtttgaggctgcagcaagccatgattgcaccactgcactctagccaggggaacagagcaagtatctctctctcaaaataataataataaaaagacttaaagagaagaggaaatgctcagaggcattcttagagatttcaggataactcaaaaaagaaagaaagaaagaaggaaggaagaaaggaaggaaggaaggaaagaaagaaagaaagaaagaaagaaagaaagaaagaaagaaagaaagaaaaaagaccaagtaaaaaagatatcttcacttagcaaaatatcttagagctaattccatactaatacatgtagaaatgtttcattctttttaagggctacatagtatataccatttgatggatttaccataatttactaaatattcctctgttaaggctcattaagtttgtttacagttttttattattacaaatggtgctgtgggctgggcatggtggtttatgcctgtaatcgcagcactttgggaggctgaggcgggcagatcacctgaggtcaggagttcaagatcagcctggccaacatggcgaaacccgatctctattaaaaatacaaaaaattagccaggcatggtagcatgcgcctgtaattccagctactcgggaggctgaggcaggagaatcacttgaaccagggaggtgaaggttgcagagagccaagatcatgctactgcacttcagcctgagcgacagagcgagactccatctcaaaaacaaaaacaagtggtgctgtgatgtcatgtacacatgtttttatatgtgtattatattacacatataggattatatctataggataaattccagaaatgaaattgctgagtcaaagggaatacataatttatattctcaccagaaacatatgaaagttcctttctcataccctgtttccatcacatgcaacattgctctagctgtttttggcttccccgtagggccctgaggtgatgttctcccatacttctctcagtttttctgttgttattatattattagaaagctctgcctattatgtgcctgttccaccacagctccctccatcccaccagtctgttttccttcaagactcagatctatcatacattcatcttagaaacatccttgctccataatcaccattctgttcccttcccctagaactttccaggcctgattaggtgccctcctgtgtgtgtgtgtgtgtgtgtgtgtgtgtgtgtgtgtgtgtgtgtgtgtgtgtgtgtgtgtgattcctctgcacacatggtcggtttcccctgcacgcttctattatggtgctcatcactgtgaattgtgttcgtgggttctttgtacattctttcgccattttcatctctttgtccaaaacacttttcctatgtcaacatgtagtagaggctcagtaaatatgtttttggataagataacttaaatccagtcagaattttagaattagatagggccttagtgatcattttatatgtttactttattagtgaaaagtagacttttaaattttaatgttttaaattcaaaattcaacaattcgttgttttaaacttctttaagaaaaaaaacaaactaattaaagtcagtagttttttacttgcctgtgacttttttctccctgggttcaaatcaataccccagtattacggtccttaatgtacaggggttttataatggaacatgctgctgtttcttcaaactcaacaaatatcagatatatatatatatatcttttgtttcttcccattttccttcttgctcaactatcctttgttctcaggaccttgctccctagacctgcccaagtttggaaaagactgagagggaaggaagctgaaagcaaagaatcactgttctggctgggtgcagtggctcatgtctgtaatcccagcatttcaggagaccaaggtgacagggtttcttggggtcaggaagtagagatcagcctgggtcacgaaactagaactcatctcaaaaaaaaaaatcgctttttttttctttctttttgctgggggacctgtgaaaagcattgtgccttgactgtgaaggccaaatgatgctcttagtgctcccatccccgtttccttttttacagtctagacattgatatttaggaacgatctcggtctgtagagcagacagattctcataatctctattcacattgatctggggcagagaggaaaagaaaagagagagtcttcactgtttacaaactttaaaaatattaaccgcacctagttgagaaatgtggaccatggtgtgaagataactcggtccttctccatagggagggtaagaatccagaaaagttatgccagtgccagtttccctacctgaaatccagtcactcgagggagaggctccctaacacacctttcataacgcttttcgtttatttatttatgtgcccttttaattgtacatacctcttctgtgtgttttggtgttcatctcgacatcttttggctatctctccttgaactgtggtaaccaagttttcttatcttcaacccctatcatgacagatgttttgcttgttattttggattgccaatcatcagccaagacttttacagctgtgataccattattcatgtctcaggaatctgcacaaaagaaaaacctcagattattctcaggcattttgggaaatattctgttagtcctgtgcaatacctagttcctgcttccatttaatttcattgcaattttaaaaatgtttatggagtccctattaactcatagttttggacttcttggtactctgcatagaatatttataggttctttttttcttctccatcctctttacttcatagaaaaggacaatgcttaatttttattaaaatattccccacagatgcctaattcatttaatactgaaatctagaattagagcaaaaagttgagagagccatgagaagaatatgtcagtgatgtagatatatcttggattcttttcacttggatgcatctgtagagattattttgtttcaggatctcttctgttcctcagtagcttaacatgaagccttaccattatgcgttgatttctcttttataaaaacataatttgaaatttatggctgaaaagcagcaatgaagacactgtttttccttttgctgggctgtcggctgaatttagtttgaggaatacaatggttcatcagataattgtgaaaagaggtgccacatccaaaggccttagataatcaatcctctgtgtctggcatatagacattcacaattgataatatatatgatgttttctccttttccatcttatcttcttttgcatgttttcagatgttgcaaaaaatttagtaattttccacaagaaaattcactcctaaaaggttgtcctagaaacagttttgtaaaatctggcaggagagcaaagcatatttaacttttatgtttgtagttttgatatgattattagctctgaaaatatagaaactaactcaagttaggtcatcgtgtcaaggtcttgatttgttttctttccatttattatttatttaagccagttttaggagtgattatgaggcaatgggaatttttaacaggcctttcaaaacttatacagccaagtgagttatccctttaaagttattaccctaggaggacattgcatttattacaataaaagctgtattgctcaaaccaatgttagattgagggtagggcaggtaggatttgcttttaatgtctacagcacattattgaatctttttttttttttcttaagacagggtctcgctatgttgtccaggctggttttgaactcctgggctcaagcaatcctcctgtattggcctcccaaagttctaggattacaggcatgagccaccatgcctggccacatttttgaatctttttaatgatggaataacatcaatagggtatatttgagttttagaagtagccaacagctcttcaggatcatcttttcactagtttaagtgtttagcctgactaattatttgttaatcacaaaaatatggttaggaattaaggaaactgttttttcttgtatgtcacatacattgtctctgaagctaattccaaaagataagctttaattaagttttgaactatggcagcatcattgacataaatgaagaagatctcaagatgacagttttaaaaatgacaactctcatctgactatttagttctgttataataaggaaaaaagcccattccattatttattgtagcattctggtattgtgaaaacacaaagacattttagtggaatcaaaataaaatagtttgtctaggtgtgattactattagctcatcagaaataattgtaagttggctgatatttgctggaaatggcccttggaatggaaagctaggtcaggaaatgacagctaatggaatagactgaaatgtgagagagtggaaaggtcaccttttaaggacttactgctggagtcttgagataaatggtgagacataattttctactctttggtgcctgtttcatgcccccattacttaaatttccctggctcaggtttaatccagtaattttccatcataacgattatgtgctcatgatagaaaaacaaacatttaaaaatgacccacattttctggctaggtatagcagagtgaactcttgcatatatctttgctccattataatgatagtgagggtataataaactaacaagaataaaacagatgggagacatcaataaaattttggaagatacaagaagaatggacaagtggtaactgacttaccagagtggaaaaagctgacttctgatttcaacaagaagtagcacttgggaaaagttctagaaatagaggtgatgagatacctcagaaaactgggtggtataggtctgagaagagaaggttatcttagttttgtaagatattaaactctaaaactttgttttaaaatgggaaacctgacagtcatagttttgttttattttgtttcacatctataaacatatggaagaaaagcgaagtgccaagtctacttttttggcttaatggttatttatgctttatagcaaacagagatgtctgtttaaatattcttaataggataacagattattaaggaaacaaacagaattacagactttttagaagttatacttaccttcataggacataacaacatattttcatgtctgaattgtgggaaagggtctactgttggaaataatgttcacaaagactgttctgttacatagattagtacttgctttcctgatgatctaaaagaaaggatgttttcttttcatcttgatggccttcctttcaccagtagttggaagggcctgtagtgttaaagctaactattgcacttccactaagtagaaaaaaagcaggcctgaaaagcataaagcttataatgtgaaatgaaaatgtcagaaaaagaattttaatcaatggaatatagaacatatactgtgttgcctctagtgcttgaattttcctaaggagcagttagaagcccagctaagtttcagtaaccagggatatgcttcttcctttcctggcagaagtaggaggttctctttctggagaaacaacccacgtttctggattgtgggcatagtcagctgagggcaagtgatatactgaaaacaggagggtgtactgatttctatatgttgaatcagagatccttagttcccatccccaggttgctctctgaacattgacaccaagtttatgctgtccaaccaggagattggaggttcactctctgggcaaagtgatcaatccatggtaaagaatctgtggatgttgacatttaggatccttctaatgaaatttctgcctccctctagagacgcccacccatccacaaccctgctgttcttcacagagcttccaggaatgtcgtaatgcttcactgtcaacaacaatggagagccaaggacgatcagctgtttaaccaaaaagaaagagagcagagaaacaaatgaattcagttgaaacaatgaaaaatttgggaacagaagaaaatctttaaagctcaaagctataataatatataggcctaccttggagagattgagagttcaattccaaactgcctcaatacagcaaatatcacaataaagcaagtcacgtacattttatggtttctcagttcatataaaagttatgttcagacacctgtactcatatgttcaatgaagcactactcataatagcgaaaacatggactcaacctaggcgctgatcgatggtggactggatttaaaaatgtggcatatatacaccatggaatactatgcagtcataaaagaatgaaatcatgtcttttgcaggaacgtgaatacagctgaagaccattgtcctaagtgaattagtgcagaaacaaaaaaagaaatactgcatgttcttacttataagtgaaagctaaacattgggtacgcatggtggacataatgatagaaacaatagacactagggactcgaaaaggggagaaagggatggggacaaacgttgaaaaactacttactgggtactatatttactatttggttgaggggttcagtaaaagccaaacctcttaattatacaatatatatacatgcacatgcaccccatgaatctaaaaaaaaaccccaatactgtgtttacactatattatagtctagtaagtgtgcaacagcattatgtctaaaaaaagtatatactctaattaaaaaatactttactgctaaaaatgctaatgatcatcttagatttcagcaaattataatctttttgccactcgggggtcttgcctcagtgttgatggctgctgactgatcagaattgtggttgctgaaggttggggtatttgtggcaatttcttaaaataacaattaagtttgctgcattgattactttcacaaaagatttctccatagcatgagatgctgtttgatagcaatttacgcatagcagaacttctttcagatttggacttaatcctctagaactctaccactgctttatcagctaagtttatattattttaaatctttgttgttatttcaacagtgttcacaacattttcaccaggagtagattctgccttaaaaatacactgtttttggctgggcgcagtggctcacgcctgtaatcctagcactttgggaggccgaggtgggtggattacgaggttaggagatcgaaaccatcctggctaatggtgaaacccgtctctactaaaaataaaaaaattagccgggcatggtggcgggtgcctgtagtctcaggctactcaggaggctgaggcaggagaatggcatgaacctgggaggcagaccttgcagtgagccaagattgtgccactgcactccaccctgggcgacagaatgagactccatctcaaaaaaaaaaaaaaacaaaaaacactttttttcgctcatccataagaagtgactcggccaggtgcagtggctcatgcctgtaatcccagcactttgggaggctgaggagggcgaatcacttgaggtcaggaattcgagaccagcctggccaacatggtgaaaccctgtctctactaaaaatacaaaacttagcctggtgtggtggcaggcacctgtagtcccatctactcaggaggctgaggcaggagaatcacttgaacccaggaaacaaaggttgcagtgagctgagattgcaccactgcactccagcctgggtgacagagcaagactctgtctcaaaaaaaaaaagagtcctcctccatccagatttgatcatgaaatgtagcattcagtcacatcttcagactacatgtctaattctagttatcttgctatttctacgacatctgcaggacttcctccactgaagtctttaaccctaaaccatccatgatggtcaaaatcaacttcttccaaactcatatttgtgttgatattttgacttcctcttatgaatatggatgttcttaatggcatctagatggggcgaaggttttcaatttactttgcccagatccatcagaggaatcgctatctatggcagcaatagccttacaaaatgtattttttaaataataagacttgaagttgaaattacttcttggtctgtgggctgcaaaatggatgtggtgttagaaagtatgaaaacaacattaatcttgtacatctccatcagagctcttaggtgactagttgcattgtcaatgaatagcaatattttgaaagaaatatttttttcctgagcagtagatctcaatgacgggctgaaaatattcagtaaaccacattgtcaaaagatatgctgtcatccaggctttgttgttgcatttatggagcacaggcagagtagatttaggataattcctaagggccttaggattctcagaatggtgagtgagtattggcttaaagtcaccagctgcattagccctaaacaaaagagtcagccttctctttctttctctctctctctctttttttttttttttttttttgaggcagagtctcagtttgtggcccaggctggagtacagtgacacaatcacagctcactgcagcctaaacttcctgggctgaagtaatcaacctgcctagcctcccaaatagcttggactacaggtgtgtaccaccacacctgggtgctttttaaaattttttgtagagacagggtcctgctgtgttgcccaggctagtctcaaacacctgagctcaagccatcgtcttgccttggtctcctgaagtgctagaattacaggtataagccactgacctgagcccttcttttgaagcgttgaaaccaggtattgacttctcctctctggctaggaaagtcctagatgacatcttcttccaataaaaggctgttttgtctatgttgaaaatctgttgtgtgctatagccaccttcaattgtcttgtctagatcttctagataaattgtggcagcttctccatcagcacttgctgctttaccttgtaattttatattgtggagactgcttccttctttaaacctcatcaagcagcctctgctagcttcaaacatttcttctgcaacttcctcatgtctctcagccttcatatagttaaagagagttagggccttattctgggttaggttttggcttaagggaatatgtggctggtttgatcttctatctagaccactaaaactttcttcatatcagcaataaggctgttttgcttttttatcattcatgtgttcagtatagcagcatttttaatttccttcaagaacttttcctttgcattcacaacttggctaactgtttggcattaagaggtttagtttttgacttatcttggctttcaacatgccttcctcactaagcttaattgtgtctagcttttgatttaaagtaagagacatgcaactcctccttttcttggacacttagaagccaatgtagggttattaattgacctaatttccatattgttttgtctcagggaatagggatgcctgtggagagggagggagatgggggaatggccaatcagttgagcagtgagaacacacacaaaatttattaagctcgctctcttatatgggtttgattcattgtaccctcaaacaattataatagtaacatcaaaggtcactgattacagatcaccataacaggtaaattaatgaaaagttttaaatattgtgagaattaccaaaatatgacacagacacaaagtgagcatatgctgttggaaaatggcgctgatagacttgcttggtgccggattgttacaaaccttcaatttgtaaaacaacaatagcaataacaagaacaaaaacacagtatctgtgaagcacaataaagcaaagcacaataaaacaaggtatgcctgtattcaaagagataactactgcatttatgaaaaaagaaaatcatacttaaaaatgcagagaaaaacacctagaaaaaacagtagaaacagtaacaaagcagtagacgtttgaatactatggttgaaaataaaagttctcccagaaaacaggacaaaagatgaagaagtggaatataggagagacaagataaaaacttagaggatcattcaccatggtagtgatattaagaaaagaaaatttagaggatcattcaggagactaaacatctgactggtaggagtcccagaaagacactagagaaaggacagagaggaaattatcaaagaaatattttaagaaaatttttcataacttaaggacaggaatttctagattgaaagtgcccattgaaagcccaggacagtgaatgaaagaagacccacatgaagacatacaattttgatgttttagaatggtggagataaaagagaagatcacaaggcttccatagaggaaaaaacaggtcacatgggaaagatcagaatcagaatagcattagacagacttattactagccatactaggagacaatggagcaatgctgtgtaagttctgcaggatttctgtacttacaaatccaaaccatcaatcaaagatgagttctcagaaaatatatgtgcaagatttaaaataaattaacatcatgcattctttatttggaaggcattggagactgagctccaccaaaataagagggagaagatcaagaaaatgtgagatataggaaacagtttacaatgaagtgagaagccaagggaattcccaggatcataggttctaggattatggctgtacaacaggcctagggtgcagttagtccagatgtgagcaggaggatggaaggccacaggagggatgtagccaagaaaatattggaattaatttattacctaatatatttgcccatatcgaaggctttatagttacgtagaaaagtttaatgctgatgtagctacatatgtagaaaactagacaaatgaaaagagaagaaaattatgggaggagtaaagatacaggttgaggttgggtttagtggtccagagaatgagctttgtagtcaggctatctgaatttgaatgctgtctataacacttagtactactaaccgcatacccttgagtaaattacctttctgtccttcagtttcctcatctatatggagatactaatcatacctaccactttagtctactcctgcttctataacaaagtaccacagactgagtaatttataaatcatagaattttttttcctcacagttctggagactgggaagttcaagatcaaggcactggcagattcagtgtctggtaaggggtcattcactgcttccaagatggtgcctttgtgctgtgtcctccaggggtgacaaatgctttgttttcacgtggcagacaggatagaagggcaaaggggactaactttctaaagattttataaaggcactaatctgttctatgagggcagagctttcatgacccaataacctcccaaaggcctcacctcttaatatcatccccttgagggttaagttccaatgtaaaaactttggaaggatgcatccattcaaaccacagcacctacttagcatgttgttatgtggatcagatgagctaatacatgcaaaaccattagatcagtagaaatagtactagtaatcatagtaatagtagtagtagtggtagcagtggtaatagtagtaggtgctcaaaattgttaactattatttctattattgctgttatttttaaaattgaaaaataattaagatgtttaatacttttcttgagaaattttgtgataagtacccagaagaaactgtttaaaataataaacccaaaacaaaacatttttaatgacctatagtgccaccactcaaaggtgaaatttttaaacatgtaggtgtattttttcccgtgcattgttttatttatataattgttacattctctctatataattttgtgttctgcttttgttttttaacataaaagaaccatattacctgttaatgcaaactctaattgaagagtttttgttgacttcattattttccactaaatgtatggaaaatatttcgtttaaccaagtatctatttttatatatttggtttgctttgtgaataacattgggtgatgcttttctaaaatacatttcaaaatttaattttattattagaaatataatacatgtttattatagacattttaaggtgccaaaataagatcagtaaaattaatgtaatagtaatctaactagctagagataagcactgctagcgtcttcataatgtatgcctgttgtcttttttcttgacaatatatattttttatttcttttgcaaaatgtagaacttttcttgtagatggtatgaccaccttttgatatcttctatggcatgttagtgtcagcagagtgtttaattgtaaattttgggatcttattttttaaattgctttaaaatttttcagtgtttcacaatgatagtgtatggaagatctttacagctacacatctattttaaaattattcaaaattattccttaaattcttagaaacagaattgcaggttcaaaaggtatacacttaatatgtattgtcaaatttccctccatgaaaattctacaaaactctatgctcacagccttgtcaacactaggttttctgatattatctttttaattccataaaatgtctcctatatttagagttatttttcttcattagattcttaggtacaaagaatattagaagtttaagacttttactgttttgaaaaattgctttatcagaagaggacagtatttgactgtcattaacagtggataataatgtctgctactctgtcttctcactaatgatggaattgttatattcttcatgtggatgataagcgaaatgttgacaggttaacagagtagatcttaagccttgcagtactccaggcaagatagcatggtggctcagaccagggtggtggcaatggaaatgttcatattctggaaattttttttgaaaacactattgacagaattttcttatcagttccatatatgatttgtaagagagattaaagagtcaatgatcactctatgatttttggccagggtaactggaaaattgaagtagccatttaagaagcttggaagattataggagaatcatgtttgtcaagcaagatcaggagcccaagtttggacatgttaagtgtgatgcttatttaataagtaagagatgttgagtatatagttggatatatgattctggtgtttagaggagaattctaagctggagaaacatcagcatataattgagtacaattatatcctgtataattaattaagagaaaacattagatgaaatcaccgaggaagagagtgtcaaaagaaaagaggaggatcaagtactgatccctgggggtactccaatgtttaggaactgtagcgatgagaagaaacctacaaaggagacagaagcagcagcaagagaaaggagaaaaaccaggactgtgtggttcctggtaggaaattgaaggaaatatttccaagaggaggggtgatcagctatgtcaaatgctgcttatacatcaagtaagattaagactaagaattaactgttagatttaacgatatagaggtagctaaatagtgaccatgaaaatacagttttggtgaagcggtgtggtgaaaaccagattagatgggatctgattttcaagtgattaatattataaaaatgcccaataattcaacattaagtgcccaaaatctccatttctagggtactcataagaagtctaagtaaattttgaagtaagtctggcaattttacccttaaaaaactacaaaacattagtcctttacttgactgtaatggggaggaacatgtctccctctgttgattatttgcaataagattcaccagggactcatttgaattgccttggtgtagtgtgttccctggtaccttggcttttttttttttttaaattatactttaagttttagggtacatgtgcacaatgtgcaggttagttacatatgtatacatgtgccatgctggtgtgctgcacccattaactcgtcattcagcattaggtatatctcctaatgctaaccctccctcctccccccaccccacaacagtccccgagtaccttggcttttaaagtggtattgagccacaatgatcagatatgccaacaggccattatatgttaatagaattttactagcatatttgtagactgttaatttgattaaactttcatgtcttggtaacttttctttatagcagaataaacgtagaagattctgatttggtaggcctgacggtgtctaggcatttttttaaaaaatctgattctgctgcaaagccggcttggaaaactttgctttattaggaacaggattctataaataagagctaacattcatgatagtggcaggctcagcttttacttgatcacatttattgtaagtgccctagtcctagcatacacatttaaagctccctgataattttcatcagattgtgacttcctcaatagaagtaacaaaaatagcctcacctttagacacaggggtacacagaaaatttcttttatgtgcataagcaagagagaaattatatttacaaactggaaaagtaattaagtgaaactttcatccaaaaatcagatatttaataaacttttaattcccttttgtagtttccttttaatttagtttaaacaacataaacattttaaataccactcattacatgctgagggtatagataacagttttggcactttaaaaaaagctgaggaatggatggttaattctcagtgatatttattcattttctatagtgaggattctctagtatatcaaaaggatctggagggttggtgcatggctagagaaactaagaaaataaagatgatgaaatggaggtgttggggagggattcagagaatggagagaatgggaagaatgttttctttaaaaaacctttccaagctcataatttgttattcctcttaaatgaaataatgaaatttggatccttaaagcttccattttttccagttctcttcttctggagaggttttcatagtttaaagaccttatgaaatctttgattttcgattgtgaactatgatctgtgggcttcttttattttcactggttggattataatcatatttgaagtcttatgattcttttatattggtccaaagaaagttacatttaatatttggtgactgctctaaggaaaacatagtaatttggggcagcataacaatcactgaatgttagaacaagaaggcatagcttgttacagtatattataatctttacagtgtatattgttttgcacaattctgtaggtcaactgggcagatatgctttatgtagtgtcagctgggatgctattatatctggaagatgcaaacttgcctcaatcacgtgtttggaaattggtgtcagtgttggcttggaattcactgggtctgtcagctagggacatgattctcctccacatggtctttttatgtgattgcttgggcttcctgacagcatggtggctggattcaaaggagaattctacatgcatgaaaatggaatctgcagatctcagatgttacgcagagctgtagtttgaatgtttgtcacctctaaatatcatgttgaaatttaattgccattgtaacagtatgaagaggtgggaccttttaagggtcattaggccatgagggctggctgcactcacaggcctgggattggtgccttattaaagggcaagttggattccctcttgcttctgtgtgtgctctccccctctctctctggctcgctctcaccctctcttgtcttcccttaccttccctccctcttcctccctctccctacctctttccctctcttctccctgtctccttcctccctatgtttctccttctctccctttccttctctctccctctctccttctgctttccttctctccttctctccttctaccatatgatgacacagcaaaaaggccctcacaagttgctggcaccttgatattggacttcccagcctctggaactgtgagccaacatatttctgttcattctacattacctagtctgtgatattctgttacagcagcacaaaacagactaagacacacaatatcacttctgtctcatatttttcacagggccagctcagattcaaggggagaagaaatgatttccacttcgccattagaagagttacaatttattgccttctttaatcaaccacagtttgtcctttggccacaaattatttgtatttatcacatatgcagaatgcattgaattcctccagagacccctgaaaaatcttattccattatagtatcaggctcaaatgcaaggttcaggttctcatcatctgaattaggtccaggtgtagataaggctgcttagatgaggtagcccaggtgtagacccttgaaccaaaaagataacctgaaatacagggtggataggggcaggatgactgcagtagatactcctgttcaaaaagtgggaaatagctactcggcagtcactggtccattgaatttctgatactgaatcaggtatgtcactggtttctcctgctttggcagaagggaatatatgttgattaaggctctgctttgcttcctgggagcagtccttttgtggttcttgggttcatcctctgagtcaacatttattttttttttaaaagaaatgtgccgggctttaagctagctatctttctggtctgtttcctcactataaagagtttgaactgactgtccattttggtccaagctggtgtggttccagtgatataattctcttaagaacttcacaggtttcatgtgaatctcattggcatttaccccattagacaaatccacatccacagatctttttgagataggtccctctctactgtgagttaagatgctatgggacaatgcactgaagatccatactagcctttttgtttaggtgagaatgtctatgagaacctacaagatacttagaaactcttttgtctagctgaggcccttaatagttttcggaactcttttacatagatgatttggtaaaggcgaaacagcctttagtctgtctgagttataacaaagcgttttaaaactacacccttgacttactcttgaccttgagattacatcttactggcagcaccttggattagatctttgctctgaggctgtttctttgaaaatctattgcacattcaagttgctttgttcatttgtttgcttcttatgcaagcatcacttcagaagcacatgattttgtttttttctattattggttatgttaactgtgatcacttggttaaggtgatgtctccagtttttttttcactgtcaagttgttactaggatacattttgaaggtagaattgaatgttcggatttgactgagagagttatgcattagacatgttgaatttgagatgcctatttgacatcctagtagagactggttcagaaacaggggtgctggtagattggaaagatgaggtagtcttgttttcatttttccagtgaatacagaagtgagattatctgaagggagtgataatgagggagcacagtagagatgtgaggagagagatttagaaggatcttctcagagtaaattgactggaaaagcgtagtggacttaagggcagtgttgtgatgagggaccatttgacaactgtgatcctacaccagcctatgaccattcaagatgttctatttcttggagtcagactttgattagtagaaggagttttactgtgattgaggtttggtcaagcaagtacagtggaaagaggggtaaattagtttagagtgtgtgaagggaggtgatttatcaggacagatcatggaagataaactggattaagtagacaagaaggtgaggagagtgaaaaagtggtagataggctcaatggttttaagttccaaaacagtgagatagagttctagagaaagatgaatagatatgagatggtgaatagggtatgtgaatgattgaaatcaggatatgggatgcatttcatctatgttctggtttaataccataccagctttatgaagtgattttttttttttttttttttttagtgtctccattttaaacagaagcaaattatgttgatcaagattaagcagcttggccaagggtacacaattagtaaatggcagagcttggatggaaaattaaaatatttgtttttgtttttaactcccaaacctttgtataatactgtacgagctgtctctgattcatgacagttgcccactacacaaaggataatcattattatgactgaaaatgtttacattatatttgttttgcttttttaggcttgttatgacatgcaaatgaaaaaaggtctcagaaaacatttctaattttataaacatcttacttcctttagagaatgagtggcctttagaaattggttgaaaatgatttttacttttatatttcaaagttcacaaacaagcattcacacatcattattaagctattagtatggagtgaattctacctgacccatttacattaatataaaatttcctttatgttaaggaggtcttccattttcctacacttaaaatgatttaagtagatccctatataatgatgaacaatgatgttctaaagaaaataacaagataatttgattatctctacttcaggaagcttcaagaaaattaacttaggttctaacttgatgatagtaaagattttatggtttagtagagggaaaagtgaaagtttaaatttaaggattctcaccctaatcattaaaataacaatactttgcagactttcacaatatgcaaacaaacaaaaccaaattgcatgagctgtttttggtttaaaattacatggagcgctttccagcaatacttgtatatagaggcttgattgaaatagctgcataattcctgagcagagggcttttctttgctgtaattacattcgtgcagtgactcatattctcttaatgcctagattttataattcaaagggaaatgttcccttgaaatttgaaagcctggaggactcaaaagtagtttttagattttattattattattattactactactattcctacaccacagctagtattcctctgaggagtatttgacttaggtgattttgatttcactcatgctggctgcagtagtggggtttgactcatgtgacagtgagagagcaagggtcccaaagatgtctagcacagggatagggtgttctgcattcagggacttcagcagtggagatgtggggctttcactctggtattcaccaccgtacagctcagtttcttttaagtgtcaacttacttttgactttctgtttctctttccttcatcagctgaatgatttttttctgaatttacaagttcagattcccaggagagggaacctggctggctctgctgataaacatgcctctgtatgatgatgtttctctcctacatctggggaagtttttaagactgatagcaaggttggaggacagtcctttgcaaacacctggctagtatctctcctgttttgggtaaacagggtgtgatgtggatgctggagcaattaccagttttgcctgaggcaggtctttccatataattttacgtttttgttataagcccttggaaatttgtgaaatatataatatactcatgatgaagacaaaaaaagagacaattttcaattggatgtacaacaggtactttcttcaccactctcctttccaacaatattgttcagttctctgtaaagaatcatgatggtcaaggaaggcctggcaggagaatcttgattgttcaaagacaaatgttcttgtcaaaggattggtttaggagtggccatataatgtaattctggcagaagatacttgagaagatgaatgctaagagctatttttgaaagggcttgttcacttttaaaaataaatacaaggctttttttctttttttaatcttggaataatgtattttctataagatggtgagaattgcagccatcatatcagggtcatgagaggagccagttaagagagccccggctaccatgctgagggcagagcagaaagttgtaaacacccctcatctcattaatggcactgagccaccacgtgagccaaccctggaactgccctgatgtcagatgggaagattactttgatgcaatggtagcctccaagtatgcttaggtgagctatcctagaggtgagggaaccaaaagctcccacagactaaattccaatcctcaaatcacgtaattcactaaattaatttaaagtgcacagtgagaggcaagaggaaagattattaggttggtatacctgggttaggggcaagtagggtagaggggccatgccagctaatcctgggatacatagtgttcatgttcatacatctgcatatgccttccccactgatggtgtggttacaaggaccagagttgaggtttgggcaagccccaaagatagcagtcgtcccaagctaataacacctgctcaagtgtctgagagatactgggacaagtatgcctagtcagtggctgtggcttgccagttagcctcacaaacagtcatgagttctgttatgtttattggacagataacaaatggagcaggaaagagtatcagcagttgttaatcagggtaattttgtaccccagtgtacatttagcaatgtctggagacatttttgattgtcatgactggtgtatgtaagagatgctactggcatctattaggtagaatctagggatgctaagtgtgctacagtgaacaagacagcctcccaagacaaagaattatctggcccaaagtatcaattgtgtcgaagctgaaaaaccccctcatgaatattaagtacatatgtatatttagtgtatcctggatatttagtgcctcttatatatttaatatatcatgaacatttattactcatatgcttcaagagtaattgacatttcttgatcttgcagccctttctgtcagtgtgtaacacatatacaatcttctttttatactttatacatctgtgaattctgttcatgtcttactagcaaaatatatactgaaaatatcttaaaagggtttgcctatattttataaacatcaaatttatttatcaagtagaactgaatatcctcaaaagcaaatttatattatgctagacctggaatttcaaagaagaaataagatgataaatgtcctgattgtttaatatactttttgttgtgttttctacagcttgcagctgagagcgtgctagctgattctaacataaagtcagtaagaacatctattctcaagataaatgaagcattgacttagactataattacaagttttctaaatagtaatataagtgtcagataatacaggattatggtgcctgcattaatgtaatgcttgtttgatcgttctgtttacatttcaagcaattgtaggcatggtgcttatcatgatgaacctctgtgctcaaaaatgcacatttttagatgattggaacagttttagtttgatgaccttcagttcacttaaggagtttttagttggctcaatgtctattaatagagcaacactagaaatttatagcttgatgcattttttaaaatttattaatgatagttttatttatattttagtgctttaaaagattaaaaatattttacggaagttgtgtcttgagacccctccattaaaagggaaagtttttcatatatatgaaattaaagagaagcatatttaagattatagaaacatgtaaatgttgtttaggattgatttcaaaaaagaataattttcaaatgttgatggtatatattccatttcatttcttttaactttctttgcctttttttattttgtgatgaaaactaacattttgtcagatgaaaatatcacatataacacattaaagaaatggtaaggcataatatacaattaaaactgtttgataaaaagttaaagtaaaaaattaaggacaatatgtctttaaaataatgatgtgcttacggtagtttcctggaattattggctggttcagcagaatcagctgtgctcagcaatggagtgacaggtggtgtaggcagttcaacctcatgtccttttagaaatactgggtgtgtgtgtgtctgtgtgtgtgtgtgagtgtgagagagagagagagacctataaagtgttgatttggggggcttaaagaattgttaaagcagatatgtgtaaactagatcctgattttcgtgttttacatttttgggatcctctttagtcatcatttatttttgttgttgcagtgatttgctgtcctctgaatacatagagagacacattgaacatggaggcaagactgtggaagttaaagtaagtgaaattttcctacttgtggggaaatttgttgagaatcttttaatactactgattattattttaattttcaatgatatttctaatgtacagttttgagggttttaaaaatactttataatttgaagttttatcacccactttggaaaaatgaaactttacttttagttatcagaaaaagaatttttagggtactgtaggaattgctagacttaatgttttgtaggattgctatagctgcaagtactaggttggtgcaaaagtccttgtggtttttgtcgttacttttaatggcaaaaaccccaattattttattttattttattttatttttttgagacaaagtctcgctcttgtcgcccagctggagtgcaatggcgcgatctcagctcactgcaacagcgcgatctcggctcactgcaagctctgcctcctgggttcaagtgattctcctgcctcagtctcccgagtagctgggattacaggcgcctgccaccacacctggctaatttttgtatttttagtggacagggggtttcaccatgttggccaggctggtctcgaacttcagacctcaggtgatccacccgctccggcctcccaaagtgctgggattacaggcatgagccaacgcgcctgggaaaccccagtgacttttacaccaacctttagttctttcttagattatgtcactgaaagtagtttttgaaatttgcctttaatgttacccctgagaaccaagaggtgaaaacttgggtccagggtaggtgtttgcctttgcattcagctgtgtaagattcccagccctgccgcccctccaccctgccccaccccacacctccaccagtaaaatgtaaaattgttagatctacaggagatcaaggagttaaaaatacctggagacagaaatctcaggatactggttatgacaggtaaactgtgaaaatattaacacaaaaataaaagcctccaccagctagaggcataagaatgtggcggttttcccccagatctgcagatggtataatctgagagcatatgaaaacaaaagccacccaagtgtagggcttccttctgctcagtgtttagtatagtgacttttggccaagtgtttattttcttctgaatagtgttcagactatctattctactttatctgaattataatcccactcgttcatattcatttcctttttctaattacaaattagataaatgctcattttagaaaacttgtaaacagagaaaagttgaacaaaaaaggaaaactttatccttaaactcatcactgagagataaatgttttcattttgttatttgagtgttttttgtcatatgcacacatttgtatatatacatagatatttatatagtatcatatgtagctacaatattgtatctgcttgcttctgtatcattttgtaaacatttgccaagttattttcccataaagcctttgttcagttttttatgtacatttattacatagtaaagctttttatttaaactgttatcagtaaccaaaataaattatattgtcctattcaaatgacattctgaagataattgagtttttccattacatatatatgtaaactaaaagaaaacttttcattatggaaaagtttaaacagactttgaagtgaaaagaatgctataatgagggtcgggagccaagatggctgaatagaacagctccagtctacagctcccagcgtgagcgatgcagaagacgggtgatttctgcatttccaactgaggtaccgggttcatctcactggggagtgctggacagtgggtgcaggacaatgggtgcagtgtaccgtgcgtgagccaaagcagtgcgaggcatcgcctcacctgggaagtgcaaggggtcagggaattccctttcctagtcaaagaaaggggtgacagacgacacctggaaaatcgggtcactcccaccctaatactgcgcttttccaacgggcttaacaaacggcacaccaggagattatatcccacacctggctcagagggtcctacacccacggagtctcgctgattgctagcacagcagtctgagatcaaactgcaaggtggcagctaggctgggggaggggcgctcaccattgcccaggcttcagtaggtaaacaaagcagcccagaagctcgaactgggtggagcccaccacagctcaaggaggcctgcctgcctctgtaggctccacctctgggggcagggcacagacaaacaaaagacagcaataacctctgcagacttaaatgtccctgtctgtcagctttgaagacagtagtggttctcctagcacgcagcttaagatctgagaacgggcagaatgcctcctcaagtgggtctgtgacccccgagtagcctaactgggaggcaccccccagtagggtcagactgatggactgacacctcacacagctgggtactcctctgagacaaaacttccagaggaacgatcaggcagcagcatttgcaattccccaatatccacttttctgcagccaccactgctgatacccaggcaaacagggtctggagtggacctccagtaaactccaacagacctgcagctgagggtcctgactattagaaggaaaactaacagaaaggacacccacaccaaaaacccatctgtacatcaccatcatcaaagaccaaagatagataaaaccacaaagatggggaaaaaacagagcagaaaaaccagaaactctaaaaatcagagtgcctctcttcctccaaaggagcgcagctcctcgccagcaacggaacaaagctggacggagaatgactttgacgagttgagagaagaaggcttcaggagatcaaactactccgagctaaaggaggaagtttgaaccaatggcaaagaagttaaaaactttgaaaaaaaattagacgaatggataactagaataaccaatgcagagaagtccttaaaggacctgatggagctgaaaaccatggcacgagaactgcatgacgaatgcacaagcctcagtaaccgatgtgatcaactggaagaaagggtatcagtgatggaagatgaaatgaatgaaatgaagcgtgaagagaagttcagagaaaaaagaataaaaagaaatgagcaaagcctccaagaaatatgagactatgtgaaaagaccaaatctacgtctaattggtgtacctgaaagtgacggggagaatggaaccaagttgcaaaacactctgcaggatattatccaggagaacttcccaatctagcaaggcaggccaacattcaaattcaggaaatacagagaatgccacaaagatactgctcgagaagagcaactccaagacacataattgtcagatttaccaaagttgaaatgaaggaaaaaatgttaagggcagccagagagaaaggtcgggttacccacaaagggaagcccatcagactaacagctgatctcttggcagaaactctacaagccagaagagagtgggggccaatattcaacattcttaaaaataagaattttcaacccagaatttcataaccagccaaactaagcttcataagtgagggagaaataaaatactttatagacaagcaactgctgagagattttgtcaccaccaggcctgccctacaagagctcctgaaggaagcactaaacagggaaaggaacaaccggtaccagccgctgcaaaaacatgccaaattgtaaagaccatcgaggctaggaagaaactgcatcaactaacgagcaaaataaccagctaacatcataatgacaggatcaaaatcacacataacaatactaaccttaaatgtaaatgggctaaatgctccaattaaaaggcacagactggcaaattggataaagagtcaagacctatcagtgtgctgtattcaggaaacccatctcatgtgcagagacacacataggctcaaagtaaagggatggaggaagatctaccaagcaaatggaaaacaaaaaatggcaggggttgcaatcctactcttggataaaacagagtttaaaccaacaaagatcaaaagagacaaagaaggctattacataatggtaaagggatcaattcaacaagaagaactaagtatcctaaatatatatgcactcaatacaggagcacccagatgcataaagcaagtcctgagtgacctacaaagagacttagactcccacacaataataatgggagactttaacaccccactgtcaacatcagaccgatcaacgacacagaaagttaagaaggatatccaggaattgaattcagctctgcaccaagcagacctaatagacatctacagaactctccacctcaaatcaacagaatatacattcttttcagcaccacagcacacctattccaaaattgaccacatagttggaagtaaagcactctcagcaaatgtgaaagaacagaaattataacaaactgtctcccagaccacagtgcaatcaaaccagaactcaggattaagaaactcactcaaaaccgctcaactacatggaaactgaacaacctgctcctgaatgactactgggtacataatgaaatgaaggcagaaataaagaggttctttgaaaccaacgagaacaaagatacaacataccagaatccctgggacacattcaaagcagtgtgtagagggaaatttatagcactaaatgtccacaagagaaagcaggaaaggtgtaaaattgacaccctaacatcacaattggaagaactagaaaagcaagagtaaacacattcaaaagctagcagaaggcaagaaataactaaaatcagagcagaactgaaggaaatagagacacaaaaagcccttcaaaaaatcaatgaatccaggagctggttttttttaaaagatcaacaaaattgatagaccgttagcaagactaataaagaagaaaagagagaagaatcaaatagacgcaataaaaaatgacaaaggtgatatctccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaatattgaaattgaggcaataattaatagcttaccaaccaaaaaaagtccaggaccagatggattcacagctgaattctaccagaggtacaaggaggaactggtaccattccttctgaaactattccaatcaatagaaaaagagggaatcctccctaactcattttatgaggccagcatcatcctgataccaaagcctggcagagacacacaaaaaaagagaattttagatcaataaccttgacgaacattgatgcaaaaatcctcaataaaatactggcaaaccgaatccagcaacacatcaaaaaacttatccaccgtgatcaagtgggcttcatccctgggatgcaaggctggttcaacatacaaaaatcaataaacgtaatccagcatatagacagaaccaaagacaaaaaccacatgattatctcaatagatgcagaaaaggcctttgacaaaattcaacagcccttcatgctaaaaactctcaataaattaggtattgatgggacgtatctcaaaataataagagctatctataacaaacccacagccaatatcatactgaatgggcagaaactggaagcattccctttgaaaaccggcacaagacagggatgccctctctcaccactcctattcaacatagtgttggaagttctggctagggcagtcaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtccaaaaatcacaagcattcttatacaccaataacagacagagagctaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcgatgccatccccatcaagctaccaatgactttcttcacagaattggaaaaaactactttaaagttcatatggaaccaaaaagaacccacattgccacgtgaatcctaagccaaaagagcaaaactggaggcatcatgctacctgacttcaaactatactacaaggctacagtaaccaaaacagtatggtactggtaccaaaacagacatatagaccaatggaacagaacagagccctcagaaataacgccgcatatctacaactatctgatctttgacaaacctgagaaaaaccagcaatggggaaaggattccctatttagtaaatggtgctgggaaaactggctagccataagtaaaaagctgaaactggatcccttccttacaccttacacaaaaattaattcaagatggattaaagacttaaatgttacacctaaaaccataaaaaccctagaagaaaacctaggcaataccattcaggacataggcatgggcaaggacttcatgtctaaaacaccaaatgcaatggcaacaaaagccaaaattgacaagtgggatctaattaaactaaagagcttctgcacagcaaaagaaaccaccatcagagtgaacaggcaacctacaaaatgggagaaaatttttgcagcctactcatctgacaaagggctaatatccagaatctacaatgtactcaaacaaatttacaagaaaaaaacaaacaaccccatcaaaaagtttgcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagtgcaaccattgtggaagtcagtgtggcgattcctcagggatctagaactagaaatgccatttgacccagccatcccattagtgggtatatacccaaaggattataaatcatgctgctataaagacacatgcacatgtatgtttattgtggcactattcacaatagcaaagagttggaaccaacccaaatgtccaacaacgatagactggattaagaaaatgtggcacacatacatcatggaatactatgcagccataaaaaatgatgagctcatgtcctttgtagggacatggatgaagctggaaaccatcattctcagcaaactattgcgaggacaaaaaaccaaacaccgcatgttctcactcataggtgagaattgaacagtgagaacacatggacacaggaaggggacctttacacactggggactgttgtggggtgggggactgggggagggatagcattaggagatatacctaatgctaaatgatgagttaatgggtgcagcacaccaacatggcacatgtatacatatgtaacaaacctgcacgttgttcccatgtaccctaaaacttaaagtatataaaaaaaagaatgctataatgaaaccccccattcccatcatccagcatcaatagttatcaacactttgactatcttttttttctctttttactttgtgtttgtgtgtgtgtgtgtgtgtgtgtgtgtgtgtgtgtgtgtgtgtgtgtatgtgtagtattttaaagcaaattccagactttaggacattttgtcagtaaatacctcctgtatacctatacatttctaattcataatgacttaaaatctggtaattcttgtaagcgacctagatgtaataattatgcctgtctctccagaaagttattcggaactgaagattggtgaattgaatggtggattaatttatattactgcctccctacagaaaggacaggattcatctagatataacatgggagaatggagccattttgtttatagttgggaaaaaaaaattacctagggctagaatctccaggtccttttattcccatcccttttcatttggcttcacttctctattttgtatgataatgtttttctgatgtagagtatctcttattcccttgttaaattaaagaggaaaggaaacaggccattcactatctatttctatctgtgtctgtcagtggaatgatgaaatgcaaataggagcatggagggtggacccagcagacagctctctgctgtctctacagtaatatcctttttcagaaaaattgtacctaatcagcaaagtgcacttcactctgggatcttaaggctccttgggtatacataactcatgaagcgctgactttgctgcacaatctttgctgattttccaacctgagatttgcagtttctttgttgatggtttttctaacccctaagcctgtcataccagggaaatgataaatacaaactttgtccagactgaagggccagtggtggtttatttttccctttaagaaaactgctttgatctcacctgtcacctccatttgtttccactccatttgaaaatctaactcaaaattctcctctgggtttttccaggaaccacattgaaaatgctgaattctgcccatcaatccaaagtcagtagccaattatttctctgctggttccctcctgtctcgacttctgtgcttagctctttgagatgtttctttttacatgaaatctgatagaagtctattttctttattaatgactcattaatacattataaatcaaagttgtaacgttttatattttttccttccctgcagtacctttttaaaaagcaactcttaaaacttttacttctttaccttccatgttagtttgctaaagctaccataacaaagtaccacagactgggtggcttaaacaatagaaatgtatgttctctcaattctgaaagctagaagtccaagatcaagatgttgacagggttggtttctgccgaggcctctctccttggtttgtgcatggttttcttcctgtgtcttcacatggctttccctctgtgtatatctgcatcctaatctcttcttgtgagaacatcattcctattgaactaggacccaacctaataaccctgttttaactgcgttacctctttagagaccctgtctctacatacagttatattctgaggtattaggggttaggactttaacatatgcattttgggggaacacaatccacctgtaacaccttccttaagagccctgtaagtttttttgttttttcttaaagttggcttttctcttgggactgaagtaaatgaaaggaaatatgaaatcaaagctaaactctaagagcttcttgtgtcagtttgcacaagcatggccatatgtatcctaaggatgcaaatttaaaattaaagtgttattccaaatttaacaatggctagaaaccagttgataaatggctgtactcaggtgtctttgaacttttggtaaagaatacatttttcaggaaaaaacatttttaaaaaagagctggatgcagtgtcatgcctgtttgcacctaccaaggaggctgaggtgggaggatcacttgagctcaagagttcaaagccagcctgggtaacatagcaagagactgtcttgaacaacaacaacaaaatcatgataaatcttttagattgcaattttatttttaaaaacctatatggtaaaatatacaactgacacagaaattcacataaaacatgtatgggttgatgaaatactaaaggcaaacaattttatattgaccattcagttcaagaaataaagctcggccagctgtttatttgctgcatcccaagcccttttcatcctcctcttgtaagatttgtaaacactatcctgacttttatcataaccccttccttgcttttgtttatagttttatcaccaaagcatgtacccctacagtttaattttggctgtgtaggttttaaaaataatttttgcctgggcacagtggctcacgcctgtaattccagcactttgggaggccgaagcagggggatcacgacgtcaggagatcgagaccatcatggctaacacggtgaaaccccgtctctactaaaaatacaaaaaattagctgggcgtggtggcatgcacctgtaatcccagctactcaggaggctgaggcaggagaatcgcttgaactcaggagttggaggttgcagtgagctgagattgcgccactgcactccagcctgggcgacagagcaagactctgtctcaaaaataaaataaaataataatgttttaaaaattatctttctcttttgtcccccccttgcaatttatttgttgaagaaaccagattgtttatcctatgtaatttcctacaatctggattttgatgttgattgcaattttgtatttagtgtaaaaacagacacattttggtgattgttccttaacataatgatttgtgttatctgcagggacatcatcagcctcattgaaatcagtttatcttgttcatgtagctgtgcataattctgatataaaagttatattaaaacttaaaaagaatttttttcaaaggttacaaaaataaagtctttatgcaagaaaagaaagatactttttattcctttaatgggacatattaatctttcacttacgtttattttcaatccatttaaaaattaaattcttaatttactcatctgttcagggagaacttttatatgattgacacggacttctaaaagaattttaaagtaaagcctcaactaatcagaataccttgggaatacaactttaattctgattatggagaaccatcgttctggattcataagacaaaggacattggaattgatgagtagtggcagcagagtctcagccatgcagtttgctgctttatagcttgttttgtcttgaaacagaaagctgctaatatatggggctaattgaaatgaacagttatataggctttagttaatcagtattataatgctaacagtaataactatttattacagtaataacttttattgtatgatgtgatagtcacataaatttgtatgtaccattcaatcctcaagacaacctgtaaatacaactattatcctaatttacagaaacgagacacagagaagatatacaacttgtgaaagtaacgtagtaaggagtaataaagctgcagtttgaatctagattctctaactccagagctgactcttacatgtataatattttatatactatacaatgtacaccatacattcggtgtacattctataatatgtaaaataagaggcataaaaattgaaatgtattttatttttatactcatggtatacatatctaattcatttttggtatctaacaatttctcctttatggtctttaatccttaaactgaaatggtgatctacatcaagaccctttaggcatttctctcaaattcagttatgcatttaggtagtttttctgtaatatcagttgccttgggcaagaatggtaaaagacacactccaggccaaagcttgttttatttttgtttgaatgaacgtatgaggaaaataaccatagtatgaattttagaaaactaagagaggaatgtcaaatcctttatataggtcaggaatgtgtgtagatggggcagggaacagattttcttgtggccaaaaagtaaaagtagacatctttgtagagatatgatttattatatcaccaatgaaagatcatgacagtcaggcatattctgactattagcattgttctgataatatttcttggtgaaattatttgatctgatatgattatagtaaaaagtaatcatcagtgaatgtctatgtgtattagctcaagttatttctaaactactgtatatgagcattcccaacttgtcttaggattagattcctaatccttaacgatgagtttgtacagagacatccgttacacaatattgacttttgactggtaattaactgtttacgactcatcatttgattgaattgagtgcactcaagaatcactgcatcaaaatcttaattgtattcatagttgcagtaaaaagatgaataagtaagcaaaggagtgcgggccaccattgaagtctggaaatgagtaaaggaattggagagagtgctgtgcgttgaagggcagttgtcagaggagaaaggaatacataagggtgggagaggttattatgactctagggaaccttttactctggtggtagtatagttacattcaatgacataaaagttatatttatttaggaaaactgaaaatggccactatcatctgtggaaacaaagtaacaaggaatttgagttagtagcaaggaggaagcctgagtttttatccagaatagttttctgcttctgttcacatctgtcttccctccctggggtgggagccccatgatagatttctaacttagcacaataccatctcccagcaggcacctatgctgctagcagagtctctagattccttttgtgctcatttttctaagtcagatttccatttcttctttcttaaaaaagggataccttttaaaaatcctgccttaatcgtttagttttccccagtgaatgtgtcaatgacaggaaaaaaaaaaaaaacactagtagaggacagctgtaagaaatcacttagaaaattttaaatatagtgactgtcaggacaacagatgcctccctggctaactttataattcctgtgaacttgaacagcagtgatagaaaatttcttgcgatctcaaattgtattcaggatttctcatgtcacctcttctagatttccccgcaaggaccatacttctcaatacttgaataactcgaaaggtacacaacgtgttagagaaataatgtttcttaagatatcttttaaaatgtattgtttgtaaaaacaacaacaatccaaaattatatgtgcaatataacaccgtggactccttttgtaagtgaaatatattctcagtttgtcattagtgacagagttcagtttatatacgatataggttatagtttagtgactgcattccatttcttttttttttaatgacagtacttatacttaacatattctgttatgggacatagattttttttctgagtccagtgcaaattgaatagtaaagaattgcttgaattgtttcttttttggccatgggaagcacacaagtagctattaaactgtcaaagtggctcatatttattgcaacagaaaagatgaacacaggggttaatttgcttttgcttaccctggatataaaatttccttattgattcttaaaactgcattaccatacagaatcttggctctttctataagagtaagaagagtaagcaattaaatatatatataaaaaaagaaaaaacagaccttggtgtgcagtaaattttgctgcatgcgttattagtacagagctatccatacccttgcatcaatgatgaatcttctgaagtagagacttgtgtgttttttcaagtaggtttttaggttatcttttgttttggatgcagtctttgagataaaatgtgagcaacagccactgttaccaagtaatctatactaaggctttttcctttactctcattttcatttttcttttccaatagagcaactcagcaacagcatttctcttccaaagtgccttccttatttacagctttcccttgcatttgagaaacatgctttctgtcttgaattctcacttcagtagcttctccagaaactcttggataaggctcttggataatacttagtcacctagacagtaattaagtcacatgatttaggaagatggctttagaaatgatgtttttccttttgaaacagatctatttatagaagttgtcacttaagctcttaattttatcaccaaatttcaaatccaagtttcaggcattttccttggctctgtggagatggggaggctgctttccaagtaaacaagctcagtgatgtgcattttaagggccggctgatgggcagagtgtcaactgagggccttcagtcattggaggtctcctgctgccatggtaattggaatttcttttttctaaaaagaacagctatattgaggtatagttcacatagcataaactgaggtgagttttggtctccattttgtctgctagggaacatagattctttaacagtgtgtgtgtaaatacagttgattaaaatgatcacaaacaattaatgaagcaatgatagggttgtttggcagatgtgactacctgtatgttaaaatctgtttttatgttttccttgctgcacttgctgggagatttaggttaaggactcttgctgttaagcttaaactctgagagcagaacttttggtgtggaacaaagagaaccctcaggtgcaggtgttacaggttgtggcatgagcatgcaggtacctcacataggttctctcagacaggagaggaaattttggatggtatagctatgaacatggtgtctttctatgctaatcagaaccaagttaaccacaaatacacagattttaaaattaggtgacttgcaaaaatttattttcaagaccattctctgaaaaacagtttggccacgacttaatgtcagtttgactagtaatgaaactaaaatgactttaaaaatatttatcaatacatcttcatacatgaatatttagttgttagctgtaggtaggctagctttaaacattattatattttaatgactccattctcccctaattactgaaataaaatgatttttttaaaacctcaggatataaagatcctacaagaataagagctcaactttctaaaagtgattccataagtagggttcaccatatggtaatttaatgagaaattattgaattgaatttcatggtgcttatgggaaacaatattaagatcttctgatttagagatgattctgtaattgcagatagggccaacacaggaaaccgtgtcccttggttcctgtgggtttgagctgttgcccatttttaagtactttcatttttaaatagtgaattgtgtcagaggaatactcattaattttctctgttactcgttcaagaactgtgatattctcacagaagtattttaaatactgaacaaaagtttatctggaaatattatagttttgatggttagtatatgtaagtcatagtgagctagcttcattgattaataattactgtatattgctgtcctgtagaaagattatgctttcatatactgtctattaactcaggctccctaactcagtcttaggggcaaataactgccgccagtaatttactgttagtcatttggaagagttaaccttttctccttacaaatccaaactcattttgcttacttaaggctactgatggattattctttttagttaatgacactcatcttaatggaattaaaaaatataatgacttgttgtatttctgttttacatcattgtcaaagtcttgtatttttacaaataaatattatatattcctataagtgctcactttaacaccagggatttcctgtattatgcaatctgtatgtctttcaatcctatgatattcagatgagatcaatactagtaactggatttaggattaataaaagtactggtagcagttggagtaatagcaaatacttgtatggtatttactatgtgctagatgccagtctaagtgtttcacatatgttaagtcattttatccccaagtaataccactgttatcctcattttgcagatgaggaaatgaaggcacagaaagtttaactaacttgcccaagaattttaagaaaggaagtctggcaccagaatgtgtgctataatctactgtagtttatcctccctatggaaataaatgatcataatagcagaggaattagaatgcaaatattttaattacagcccttctacaatttaccatttgtaattcaccgtctcttttagtagttgttttaataggccagaattgaagatgtgttagttcaggtgagtcccaattattccaatataaaattttctttattccaaagaccaatgccttctaaagactcccccaccccccgctttttttaaaaactatttcattttggagttcatttttagtccttctttgttcttcatagaagttggattgtgtattgttcagcacaggggagcaccatcgcttcaaatcattatagtttgaaatatgttactgtcttgcacatggcaaacacatggctcagtttatgcccatcttttgcctatgtgtaaatttatctgcatctggagtaaatgtgaagttttatgggcaagagtaactaagctgaaacataccattatcctgccaagagactagaagatatttgattgtatctctgccaaagagcttcaaaatacccatcccccctacctcttttaccctccgttccacaacatacacagcccgcaagcaggaagagagtaaaagagccatacaaatctaacaaacaaactgataaagtgtttatttcctcctcacatgtaatatcagttattccagatatgtttcctaactttacatgtaacatcagttattccaggtatgtttcctaactttactttttatctgccactaggcatcatttagtatcttctggatgagcttattgatgtgtgcatttcccccctggcaggcttatgcagacatatgctcctctgccatcttgtaatcagtgtggtttcaggaaggtctcagatttcatgatttaattctctttgcattataggaaaaaaatttggggggattaagtaaattttgctttctcttgggactgaagcaaggttgctctaggtccatcatcatgtataatgcatcaactgccttaatggcattgttaagattgcaagtggtcttaactctgtatcctgaggaaaatatgttggcccattgccagtttatacaggtcaggtgtcttagtgctggaagaaaggaaaaatgaaaagtgacagctgctgtcagcatgagttctgttcctaagctctgtttgtaacctatttgagtagaaagtcctttattttctttctggtataagattttttttcccccagttaactatctaaagagttatttcatctgttaatgttcaagatgttatctataaacttaaaagacatattcagccataagtttttttaaaaatcaaagtagcactaactgatgatatttccatgtatggaactaattagctattttataatagaatttactattttaattctaattatagaactaaccttttcattatagaatgtcttttccaaatctactcttgcaatttttttgaaactagagtgaactattacagtaattataattgaacagaaagtagtagaaatactgtttttgattttaaactggtttgaagcaaaaaaaaaaaatcacaaattattcccttggtgttgtcataagctacaattattttcctattcattaataaaaataccttagtttccagtgaataaggtgtggccactataaaatcagaaaaggtaataaagaccagagaatatatactattggtattgagtggtttgagtgtttacagcctttttgaaggaggataattgatcagtgctacatttgatgttttttgttttgttttgtttctttttttctttctttttgttgttgttgtttgtttgttttgagacagggtctcactctatctcccaggctggagtgcagtggcgcagtcttggctcgctgcagactcagagtcccaggctcaagtgattttgccacctgagtcctaaaagtagctgggactacaggtgcatgtcatcatgcccggctaatttttgtatttttagtggagatggggtttcaccacgttacccaggctggtctcaaattcaagtgatctacctgcctcagtctcccaaagtgttgagattacaggcatgagccactgcatctggccacatttgatattttatcataacactattttctttgcacctatgaggtagaaaaagagcagatggacttgattttccccatagccactcataaaaactcaggcatgtggagtttaagtggctggaaagctgacatgagagatttacagtggaatagaaaaaaagccataattctcagatactcaatgtgtgttctcaaccctcatttattcaatagacatgagttgagtgcttgccaggggccagtgacagggatatagctataaacaacagatgatgcatttcttgccctcatgaagcttgtcctttagtaggagagacaggcatgatgcaggcaactactgagaactctttgtaaatgatagaaatgataagtgttgaaaagaattacatgttgctctgagggcacttgctgggagacctgacctcatctggttggtcagggaagactttcttgaggaaatgatattatttccaaagttcaaaaaataacaggtgaatgaaatgggagcagaacaacttttcaggtagtcaaatcagcatgtgcaaaggccagaggccttgatgcaggatcttggtgtgtgaaaggggcagaaagaaaccagagaaggtggacagaataagaggtggagcaagtgcacaggaagaaaagggatgaaagtaggaggatggtatttgaccagagcctcaactcagaagaatcaggtacaatgtaaaggaaatcagactaacagtgtttttggacttcctacattggtcactttttgccttcgttttctcttctcttgaaaatctggaaattattttctaactctgtggatggcagagtggttgctttggtaattctgagtggggttaataggtattccacatagcaattagatttttggacagagtaaatgctattttcttgaagtcctgctgtctttctgattaaataaaaaaaataaacttcttgaattgtgttaacaaatggtacccattttttggttgttatttttaactccaggacatatctgtggtttgaggacagtaaagcttagagaccatgaatattgtgagggctagaaggacctaaactcaaatcctgactttgccagttaatatacgtacgtccttagacaatttacttatgcctcctatacttcattttcctcctctgttaaacaagacaaacatgtagctcagagctttgggtgtgggaaatactccataaatattagttctgatatcattattgaggtaaagtggcaatttgtacagaatttctggcaaagtctttggtggcttctacccattcttactgctagtttctgattccactcatgacaggaagcatgtcaggatcaccagcggcagttctttacttcctgctttataagacaattttctgtgcctctagactgtaaattccataagaagttcctccaagagaagcacccacgggaacttgtactatattctcagcatttagcataatatttgttcatagaagacaataagtatctgctgaatgaaaaaaataagtgaaagaattaatccaggtattagaaaattgagtggtttctcctgttcacccaacagtatgtcagatgtgtaggggaaagtacagcctggacaggtctgggaacgcatattattccccctgctatcaaaatatgcagtgaatataaacaggaaaaataaaaactgatagccttataatcggcttgcctgatggtaagcgcatcctccacacagaggctcacattcatgcgttttctttctaaggtattttagagccacgtctgatcagttttaaattttaagtcaccaaatatcaacaattggcctgcgataaaaatctctataatcgtgaaatgttttaaacatgttaaaaattgtataaaatacctcaacagacatccacgtgtagatttaacatagttcagtgttttgctatattagcttttaaatcttttcatggttttaaaatctactaattgtgtatcagcatgtctcctgttagtttttatttttattcttgccttgactcttttacttgatcaatcttgttagaattttttgtaaatactctctccccacccgccccccaccccccctttttttaaagacagggtctcactctgttgctcaggctggagtgcagtggtgcgatcatagctcactgtaaactcgaactcctagcagtacttctccctcagtctcctgagtagctgggactataggcatgtgctgccacactaattttttaatttttacttttagtagagaccaggtctcactatgtttcccagactggtctcgaactcctgacctcaagcaatcctctcgcctcagcgtcccaaagtgctgggattacaggcatgagtcattgtgcctggctgaaaatacttttttttttttttcccccaaagaaccagctttactttctttaccaaaatatatttttcaataatttctgctcttacttttgtaatttccttttttctgctctgaaatttctgcttttcttttcataattcatttagttaaatatttaatttgttaattaccaatcttcttttctatatgcatctaagaatttaaaatttactcaagtaccattttagcagcatcctaaagctctgctacatagtttttttttgctgttgtccacacacacatatatatatattccataacttatactatgactttatatgactcataaattatttatatttttagaaataatataatattttaaaaaattgtatatttggtattttaaaaatttccaaacatatgaacatctttgttgttggttttaaattctattcctttgtggtaagtgcagtgtacaagatattgattctttggaagttggccttgtatttaaaagaaaagtaacctgtgattttttaaaacagtttgcaaatcatggaacaagaagggactctggtggttcaactcccttcttgatttatggaaacataagtaacagaaatagtgaatgatcagcttattctcatagaaacacttgctgggaaaaaaagcactttactttttcatgcttagcatcacttttcattagatacaaccttaaatattaatttgctttccatgaaggatattgtttgagacctctttagtaatctgactctttttacctgttaataaatcctgggctaatccaaaatcatttatgcagagataaaaatgaccactgaatgctagtattaactgcttgagcttagcatgtaaggctcaaggtgcaagagagccttacatgctctcttggacgtgctgcaaccagaatctttttttcttttcttttttttttttttttttgagacagagtctcactctgtcacccaggctggagtacagtggcaccatctcggctcactgcaacctccacctcccacgttcaagcgattcttgtgcctcagcctccccagtagctggaattacaggtgtgcgccattatgcccggctaatttttgtatttttagtagagacagggtttcaccatgttagccaggtctcaaacacctgacttcaagcgacccacccgcctcagtctcccaaagttctaggattacaggcatgagcctctgtgcctggctgcaacagaatcttttagcggccagaaattttctctttatccttccttcttcaaaaaaggaatggaggatagaattgaagtgaaactaaaggaggttatgtttatggtaaaagtggagaaaaaacgatttcctttttttccttaccttagaccctcatatagttgtgtttccttaaaaaaaaaaaaaaagaaaacaacaacaaacatctttttcagatatgacaaaagaaaattcctcctgtattttaggaatgcacaaatatgttttctctttgtgcaacaatcatctagtcagttatgttttttcctgttactagtcaaacatcaactacagaataaggttttaggtaattcacagtctttatgctaaaaagtccatatagagtaatgcatttaaattttattattcataaaaaggtacaatgatatagtggtttcctggaaagagttataatttcatgagtttgtaattatatagtaattatatattatgtggtccacattgattttccattctcccaatttagaactacatctcagagaatctgataagccccctctctgcattacagtaatctgttgctgagcattttgtgggaacctaaaatttttagtagtctgatatttgttatattagtgggtgtctaatgattacttgacagctgcatattaatttctctcgactattctgttacaaataagcaatttaggaagctgtgtttgacttagtaaaatggaatattaagtttgccatattgtgtaaaaataatgatgagtattttaaaataaagagataggaaactagaatgctggttataggtaattaagatacaggttaattttattagatgagtgatgccatggtagacacctccagtttctaccactgaaccaagcttcttaaaaggaaaatccctggattgtgaataaaaatttacttggctatgtataaagagatgaattattttactggtttgaatagtgttccccaaaattcacgactcctagaacccatgagtatgaccttatttagaaacagaatcttttcagttgtaatcaagttaagaggaagtcatgctagattagggtgcgccctaatccgatggttggtgtccttaccagagaaaggtatagacatagagacacagagacaaacacagaaagttatggcccctatattttatggtgttcaccatcttttaataagattaactccttcctcatcacttttattcctatccagtggttttctactgtctttcttttcctttcttgtggaaacttttgctacaataatattcttacacatcttttcctctccggtggtaatcatgtatcttttaaatgaaattattctttttcatcggctcgttttatttccttttaattttttaagtccataatatgcctaatccttttggtttttaaaatgtttttgattgatactacaagatcctagtgctcaccaatgaatgttgaaatagtacagagatttttaatgactatgttgttagatgctgtttgaacatttgtaccctggaatggagtggcaaatattaatacccaaaggtgttaaccagtagtgtatatgagagttaagttacctgtgataagatgggcagtatgtgccttatttagctttagctgatttttgtcttgcaggaaaatggaaaagtggtaatggagtcttactcttaacagatctcttaatttttaggggaagatggaaaatccaagttcaacaactctgaaagtctgaaattttatcctacttacaagttaataggcattagcttgctgcagttttatctatgccggcagaagacaggaaactcctgggtcagagacgaaggacttcattactctggcattggcaatagccagaatagcaacattttcttaccctggtatcttgagccttaattcccagagggtaacagaggaaagggccggctaacctgagcacacagtgcattgtgttacaacaaagaaattccgaatttaggaaacctgaatcctttatagtgggaagtaaacatgcctgccctttgctttgaagggagattgtctccatcttccaaagctgttccctatgcaaacatcattgaaaggatagtccagaagaatctcagacattaaggggttctagatacttattatagtgaaatattactgagtaatctttcagaattcatttccatatgtaacattaaatattacattttaatcatttaaattaagcctgatgatgtagggtagttgtatttttaaggcttttgaaaacctatagtgctaagttaaagtctaggaagtattcatttgtattcttggtcttatacttttatatttcatagatccatatactaacaaaatgaattttgaggatcaacatagggttgccatttcttctattttgccatatatgaaaacaaccctctcaaaacatctaaatactattactattgctaccaattttaaaaaaatgaacctaaccactaatgcaatatggcactatggattggatcctggaatggaaagaaaaaattaaaggaaaaactggtgaagtctaaatgttcagagtctagtaaatggtaatataccaatgtcagttacttggttttgacaaatatactaaagaaatataagatattaacaatgggaaaacctgggtgatatactatacttctctataccatctttgcaacttttctgtgtatcagaattattccaaaataagtctatttaaaaaaggaaaacagttgatattttaaataataaaggtaaggaagtaaacatagaacaaatgacagtttttcaaaaattaaatacatttagctttatgaaaaattaagtacactgtacttatttttatttttttgacaggaactgataaagattttgagatgcattagtatagattcatggattattggcatttgggaaccatgtgatagcctcacttaattttaatttactgtaaatgagaggaaataatcttttcacttttcttagcctttagaatcagatacttttagaatcaattatactctgtacctgaccagatatttagcctatgtcctttttgtgaatccagtctgattctgtacagtcacaggttatgagttttaatcgggataggttggtggatcatctttaacataaaatttagcttttttaagaatttccattatgcagctggccctaaggagacttactttgttatttgtttattttcttattttaatttgtattagagatgcggtctcactatgttgctcagacttgtcttgaactcctggcctcaagtgatctccctccttggccttctaaagtggtgggattacaggtgtaagccaccatgcccagcctcccaaggagacttacaactgggaaggtggagtaaagattggaggagggcaggttcctgatgttgatgccagtcgagagggagttgagaccaggcaagaaatgtggttttggtaggaaagcacctggtggaacagactgcagccatgcagccaccaatgtgtcaggacagtgtatacacttggggggaatctaggatgcagtagggttcaaggacaggccgttagttcctgcaaggtggtatcagctagagcagaggttcccaactatggtagcatattggaatcatctgggcagatttttaaaatacccaggtcccaccctctagagattctggcgcagttggtatggggtgaggctgtgaattttttaaaagagcttcccatgtgttacaatatgctgccaggttggcaactactgtgctagggtggggtgagaaagggtcccacttgtggaagagggtgactggcatgagcttcccaaactgcatggcagaaggctggttctaggaccagtgcccatggagggggagaaggctatgattcagtgaacagagcaggagaacaagagttgcaggggcgggtgtttggatctggaggtgcctacactggccctgacccttttagcatgaccaaaccattcctatctgcctgtgactttcatagatgtagcactgaaataccagtatcctgggaaacccctttgtcccaggcaaactggaagtttggttattctagcccctttgatccaggccaaagcatcctgcatgatatcctatgaccagcaccaacaaaaatacagctctgcccttccttgatattcttatctcaccttttaccttccattatgtttctgataaagccaactcttttttgggaaacaagaaacagagtggagtactacattctgtatcaggaagggtcagctcaggaactagtgtaagatttcagtgagcttagcagtgaggagcttcagaatcagaaacaggagtagtgtaaagcagttgttctcaaactttagaatgcagtaaaatcacctgaaggtttggctgaatcacaggtgggtaggctgcatcctccgagcttctgaggaagtctatagggaggcttgagaaatttgcatttctaacaagctgatgcttttggtctgcaaaccactctttgagaaccactggtgtaaataaccttgactttgtagcaggcatacctgggtgtggatgatctctctcagtctatggtttctcacttgtaaaaggggggaaataatactcacctcatcagtcatcatgaactatcacataattcactaaaaaggatgtccaggatatggtagatacttccattctctgaaagatctttctgtatcctttgcatggggacagtttggtattgaatatttttagagttaacaattccagatttgatcatcaaaatcatgtagaggaactttttacaactataagaaacctggggccctacctccttggagattctgattcagcaggcctgagggaaggcccgggcatcagttggtttagaaagcctaccatggtacttctgagagtcagttctgggaactgctattttgaggagcatttctcttgtacaagggttctcaagcactgaatttgtattcagtcatttggaggattttaaaagatgctgatgcctggaccccagagattgtgatttagatggttgggagtaagtcatgggcattggaatttaaaagctcccgggtgattctgaagtgcaaccaaggttgagaacctcccctctagggtattcctggaacaagaaaaacacggagtatttgttacaatgcagattcttaggtcttacctcagagctgcctgcacaaactctctgggcaagagacagtatctgcattataaattgatgtcttgaattgttattcttaacaaagtttgagaatcacagctcaagggacattatagcatccctgaatattgcctgactacacctccctcacctgtttatatagcactttacagtgtactttacattgttatctcatggaatctcctgcatatccttatgaaacagctggagtagatgttatctctagttaattggtgaggaattggatattcagggaggttttctctccagtagcacgtgtgggtatataaacataaatcaggcaaatgtgcttctctgaaaggagacaatagcctattggagaagtaagacagaaacaggcattcaggtaggaagaggttgcagtatggttgaaaaatactatgaaaattcagagaaggaggggttagcaggaagtcatttatgagaagggaatttgagaaggctatttggaggaggtggttctggcccattttagagctgtcaaagtctagtttcctttgaggagcttgatagagggcatgtgactatggctttacagctgtgctccaattgtttctctttattaggttttcctcattttatggcccaggctgtgtaacttcctttgtgttatcatcttgtcatatttataataaattctatttttcctttgagattttgctatctgtttaataaaaatgtggtatgtctttgaattttataaataaatgattattttgatgttcctagaataaaaaattacaataaatttttctcccattaggaagataaaccaataatagacatataaactatcgtcttcatttttatagaggtagattttttttagctataactatgtagctaaaaataaacgtttgtacttttatggctatgttattagatcaaggagtatgaagaaagtttcaaggacaatggatttatttctggaacaaaagagacaataaggaataaagctatgactggctgtctgataaagagcccaactctgataggaaaagcccaaaaggcttttctcttttcctgcaacatctgtctcagattattgtatataatacttacttccatatagcatacttttgacttttcttcaaaagtcatatgaagacatggagaacctttataattgataagatttgagaaagttggtttgttagtggtctttactgaaatagataatttttaagtaaaatgcagtttatgattttcaaatgcagtgtatattctaaaacatgtaagtgcaaaaaatacaattatatctgtcccattagttattaaaatttaaaatacacctattctttgacctcccaggtccatgtctagtactctatcctgcatatatactgatagaagtgcgcaggaatatatgaaaggatgtttgttgcaacattatgacagcaaaaaaggagattatctaaatgtccattagtacaggactgtttaaatgaattctggttcacccccgtaatggaatagtatgccatcattggaaaaaatactgtattgatgtagaaggatgccaagcttaccttaagaaaaagaaagtcaagtggctgaacagtgtacacagtataaaactatttgtgaagtgaaaaggatatatggatatatgtgtatgtgtgtatgtatgcatctacttgaatgtacatagactattcttggcatggtacacaaaatgtgtcaaaaatgcttaccatttagaaggcatctacagcttgaatagtatatgtgaagggagtatttttattcttcactatgtaccctttcaattcttagaatttttgcaccacatgtgtattattttaaaataacacataaaataattatttacaaaataaaatattaaatttatatttaataatatagtttatataaattaagaaagccctttaacagcctaactcttggactaaaaaacatttctaggcatgttaaaggaaataaaagcttcattacttcttagtttaaataattattgacttatgattaatagtccctgaaaaatattacagcacaaaaatgaactttcaccattattgctaataattacatataccaccagttgagacctcaagatttgaattgtagtaatgcaaattgagatttttttttttcccctggtgtttatgcctctgctgaagtgtcatggaaacatttaataatgattcaaccatattgagctctttgcttcatttgccacgttaggcttttgtgcagatgcatcctgatcatctgctatttttggcttgactcctatttttttcaaatcagagattagtgaaatattgttttccattattgaatcatctatataactctccccaatataatggaggaatgcttttaaaaaatgaattatttgtcctttttatgatttaatataacatgtttccagagttgcgtttttgaagaaaactgtagtaatttataaaatagtatgctttgacattgacatgtattctcatgactatcaatttccattgttttctagtctgataccataattctcgagaattttttttgtttctacttctctttatttatctttgtttctactatcttcatgtgttactgttcactatgaggctcagacttctaagagaagaaggtctgattcggttagtcactgtccaatataaggaaacacttatagacagagttctgtctttatcaggtcatctgttgactgttgaccttttatgcctggccaacacaaagctagaactttgatctctgatccaatccgatgtatccaggaaatcacgggcatctaagtgataacatcctctcatacactcagaatctgatctgtggactgttcaccagtccaacagcccaacacacattattgtaacttttgttaaatttactcttagccctgatgacaaagtagaatacaacacaacagaataaaagaataaaccagcctaggggaaagtttagatttgccttgcataactcacaggttcgaggttcaacattggggataggacacaggccttgtatccacataaagttttcatccctacttggcaactccccaggtagacaaccataatctcagagattgtggttcctatgtagaagagggataagaatatttctttgtaggattgatatgaagatttagtgtgattgtgtatgtaaattgagtagaacagtaacagacacagtaattataatagcagcaaacacttgttgagtacttcctatgagccaagcattactctaaactctttatgtctattagctcatgtaatcctcataacagccctatgagataattatctccaattgacagatgagaaaatggaggcacgggcagtctctgtaatttgcttaagattacacagctggtaacggaaggcgccaatagctcacattgttaacatctacactacactggtgctccacatgaagtcagtgccccatgttctagtgtctaggacttgtttcagcccccaagactctgtggccttctgggttccattccctgtacaacccagatgtgaagtaccaccctatcttctccattaaatgcaaccgcaaccctcagttcatgatgatcagtggctcccctgggaatttggaggtggtttaaggtccaggattgcattgtgtaccattttacctgctctccaccccctccccaaagctgagagttaccagcttctgtgggattatctcacaaggagcagtagtctcaggctaggctggtttccttggaatttcggtgaagaaaatgtcttcagtctgttacatctccatgtcatcctgttctctctcctccatttgtgaaacactgaacattttaagtagtgtcagtccttaagtcatactgtgaagtaggtaacatttgcgcctttaaaccacccatcctatcggtcctttctgtttcactctttcgtatctcagtgagtcaatttaattagaagctttcagctactgaagaaatagaagattggtgacaggatggaaagaggtcatttagagaagagcttctcgaactttaatgtgcatatgaatcatctagggacttgttaaaatacagattctctacagtaggttgggggtggggcctgagattctgcatttttaacaacctcctagtgatgtcaatgctgcttgtctctgaactgcactctgagtagtaagtatttaaaggtgacatcctaagatggcagaagatttaccttcttacctttccaggcacattgaatccaaataaatgaatctctcttagtagaattttattaatgcaattggatgctaagaaaaacttcacaatttaaaaccccgcccataaactgcttaccagttaaagccattgctggtttcagaaaagaatagtatgaacctgtttatctggtaatcaatataaacactgtaaaaacaagcatttcctccatcaatataatttagtgactctcaaatgatttatattcatttttacttagttttatgtaaaagagtattgctttgctgctgctcatgattgaatttctttttttttttttttttttttttttgagacagggtctctatcgcccaggctggagtacagtggtgccatctcagctcactgcgacctccacttccctggttcaagcgattctcctgcctcagcctcccgagtaactgggattacaggcatgcactaccacatccagctaattttgtatttttagaagagacagggtttcaccatattggctgggctggtttggaactcctgacctcaagggatccacccacctcagtctcccaaagtgctgggattagaggcatgagccactgcacctggcccatggttgaatttcttataactaggaaagcagatgattaaactttggtgcaagggtcacatatgtatttcctttcttttctttttttgtcattttttcttttgagacagaatttcactctttttgtccaggctggagtgcagtagcacaatcacagctcactgcagcctcaaactcctgggttcaaatgatcctcctgccttaacctcccaagaggctaggaatacaggtgcatgccaccacatccagctaatttcaattttttttttttttgtagagacagggtcttgctatgttgcttaggctggtcttgaacttctggccttaagtgatgctcctgcctcgcctctgaaagcattgaaattgtagacatgagacactgtgcctgactccccatgtgtatttcaatatctctttctttgttcctctaatatcacctacataaaagaaaggtcaagtcaacttttatttccctgaattttgatttagagtcagctcactcagagtgtttatgaataattctgttagaaaagatttgataatgctaatctgaataatgaaatatcatgcagagttctagatgtggaggtgcattgtgagtagaaacctcctgtgaaatgaagcagctgattctccttgtgatgcaaagacttacattctttatttctgttttcagggaggagagcactgttactaccagggccatatccgaggaaaccctgactcatttgttgcattgtcaacatgccacggacttcagtaagtgttcaaaaagttatttttactgtttgttttttcaataatttattttctttattatgaatgcactatagtagatatccctattttgtgtcaagaaatgactttaaattggtgatggatctgattttttttttctcttttgtattttataaaccaagcagatttttaaattagggttgcaaatggtcgggcgtggtggctcatgcctataatcccagcactttgggggggtctaggcaggcagatcacctgaggtcaggagttcgagaccagcccagccaacatggtgaaaccctgtctctactaaaaatacaaaaattagccgggcatggtggcaggtacctgtaatcccagctactcgggaggctgaggcaggagaatcacttgaacctgcgaggtgaaggttgcagtgagccaagaccatgccactgcactccagcctgtgggatagagcgagactctgattcaaaaaaaataaagaaagaaagaaagaaagaaaagtcctacattttgcaaaagaaagaaaaaatatatattgtcaagaaaaaagacaagcatactttaaggagatgctagactccatctcaaaaaaattaaataaaattagagctgcagaaaacagaggcttttgaatttcacaatgataccttaaaatgatatttgaagcatttttctagtttcatccaaattcagacaggagtgatttgggttaacttcggtgtctgtttctgtggatgtttagccccttgatattcttccctactccttctttatattagtttttatatttttgtcaaataatagcagtttcagtaaatggaaacgcctgactccttacacaaagagaaaaggctgctagtgatctcaagagctcatatgtctttgcccctttttttcagcctgaatcccacctaattcatagcaaatctgtgggagggtctgtcgtttctcagagatctccgaggaacaaagttcatccttcctcaaggccttgcttcctttctcataaccttctctatcaaataatgtttgctgatgtttaacatgggaatacatccacttcctccatcctgtcgataatgataatgcacaggtggttgtttcttacttgttttgtaaccccttataaagctaccgtgtcattcctcagcattctcttttaactaaatcgtttcatttccttcttgtttgttttactttttggcacagaacaatccagcactttaattttgttaaattttcgttgagaaactttaaaataattcctttttgttaccatcttagagatgtggcttttcatctaacaagcagttactgggtgtctcctgtgtgccagccctaggaatattaaggcgattgaaacacaagtcctgggagctcacagtctcatgaggaggccaaatctagcccatttcctgatgtggaacatgataggtatatttgctttttttttgagagagagagaggaaaaaaaaaaaaacaaaactgggaaaaatgcaagctaagcattgtcaccgaagaacaggtggcacctaagggctctggaaacatgccacctgaagacagtggagtgcaataggttggaatagcctatccaagggagagggttacactgacagatcttaaatctaggaaagagagctaatggacacggccagaaaatctagctagtctgcctgagtgacacctctggtcaggatctgggaataagcatattaggcagaaaggaaagaatataagtgtaagttaaataaccagagacaggaggccatgtgtctgagagcatggaagacttccatttccttgtttgtgctaaaagactactgtgaataaaggtgtacatttatttactttaaatacattatttgaagaaagaggtttttacaaacatggaatccatgcttaatatcagacagtctctgttttcttattaggaaaaagaaacattgaagtccttttcagcagtaaaattgttacatctgagctcaagacaagcacatctgtcacctaggaatagtacagtgagacctgttcacatttgtgacagcaagtgtatattgggggtaaaaaatgaagtgttttttttccccttttctctctcttaaaatctcaatccaaagtcctagtgtcagcatctttctcagtactcgttccagtctgccttctggttttccaaatggactcaatgttgtgagaatcagagagaagatatttgtgccttctaagggctataaatggacctgagaacctaagaatgatacctgttactaatcctactatagtcttgtaaagaaggattgaaaaataacttttaggccgggcacggtggctcacccctgtaatcccaggcatgagccaccatgcccacttttcttttttcttttcttttcttttttttcttttctcttctcttttctttttcttttcttttgttctttcattcattcgttcatttgttcgttcgttcattcattctttcttttgttcattcttttctgtcagagtctcactctgtcccacaggctgaagtgcagtggtatgatctcagctcgctgcagcctccgcctcccaggttcaagccattcttgtgcctcagcctcctgagtagctgggattacaggtggctgccagcatgcccatctaatttttgtattttcagtagagacggggttttgccatgttggccaggttggtctcgaactcctgacctcgtgatccgcccacctcagcctcccaaagtgctgagattacagggttattttaattaagtaaattttatgtctccttttaagaatgtttttatttaaaactaaataaaaataaacagaaaacctatcgtgtgtcttggaacattgtcagaattgtgtatgaccattttaggctttcttagacttttatgagcacataggataaatataaccttgtatcatcttgttgtttagtaattattgcttctcatcttgactttactttctggaagaaatattttggggggatgttatgaaatattgaataatgtatgttgtcccaattacagtggtttagatatgagatatattatgtcatccatgactcatcctttataaattaccaagtgcgtactgtttttttttcatttttgatttattaaattcagttcaataatataaataagggaaaatcagattcgtatatctttcccataaagaacctgcaaggtcacatttgtttggagtcaaaggactaataggcaatgttttgatcttggtgtgtttggtgttaatgcaaaaatcttgttactgtgggaaccttaaagcacggagttaagtttgagtttattgccctcttgtggaaatttgtaagaatggctttttcatttcaaaatcttattttgatacaaccttttgaaattttagctcaattggtctgtgacgacttggtcttagctataggtttttatcaagtatactgttatggactcaatataaaaattaggatttatataagtaaaacaaaaatatttcagttctcaaagcatataaaacacatgtattttttcattattaaggaattaataatggcatattatcatatagcaatctagagtcttctgagatacagatagtgtcagaatctgttgtcttcatattgcctacatgatgtttaagtccaataaaaaaatgactttctcattggacattaacctagtataaggataaataacactcagtactattttaagaaaataatctgcttgctactttgttggtgttgccacgtgaattttggcaaactatgatggtttcatatgactttctggatggatatggctagttctcagcaagggtagagagatactccctgccatatttggtctacgtttttgaaaggctccccctctgactccttgggcacatattgtcagtaatgtcttacaaactgcatctgtttatgtttaaattccaaatagaatgtcatccaaattcagaaagtacatgtggctgaaaacagtgcagctgtgagaataatcattctgtgagtatatagaagttgaggacatgtggaagatgttatagcaggaatgaaagaatttggatagaggcagaacttggaggccattataattatagctcatggaatttcaccaatttcactaaatcttcaatgaaagacaaatactagtttatgtttaggagcttggctgtcacataatcatttctaccaaaaactaaaaaattactacagctcatagctttgctaccctcagatgcctgaatgataagacaagtttctttaacatcataaagggcctgatctcagtaaaaggatcatgttcttctaaaagcagcagctatcagaatctgtctgagtgggagctgaggccatttgtatattgaagtgctctccagaggatttctcagatggctggtagccacccccagcctacgaggtccaaaatggaattttttatttttaaagaaatatagggtcttgctctgtcacccaggctggagtacagtggcacaatcatcaatcactgcagccttgaactcttgggttcaggtgatcctcccacctcagcctcccaagtagctgggactacaggtgtgtgcatcaccaggcccagctaactttttaaaaattttttgtagagagagagtcttgccactcactacgttgcccaggctggtctcaaactcctggcctcatgtgatttccccccgccttggccttccaaagtgttgggattccagatgtgagccccatgcccagctcaaaactgaactcttaaaggatttgcatccttccctctgcttcctgcttccctaggcccatcccgaaaagttctttctgcatcccccctgcctgccctcttttttttttttttttttttttttttgagacagggtctcactccattacctctttttttatcttgttaaatgacatgtccatttttccagttgctcaggtcaaaacttggagtcttcactaactcttctctgttttacgtactttgtttcaaatccatcagtaaatcctactggttgtaccttcaaaatatatctggaatttgaccaattctcaccacctctactattactgctctgatctaagccagcatcttctttcgcctggattattgcagtaacttccctgcttctatccttgctgtgctaaaaattattgtaacatagtatctggcatgatcattataaaacttaagaaagattgtatttcccatctgcttagaactttgcagtggctcttcatctctcttagagtaaaagccaaggccctaggaagtgcccacctagtatggcccccaagaccctctggcaccatttattgcccttcacctgattattttcttccctagaacttatcactgtcatatgtatgtgtatgtgtgtgtgtatatatatatataatatatatattataaataaataaataaatatatatatatatatatatatatatatatatatatagtaagtcctagaatacttatgagcaccacaaggacagagaattggtctgttttgtttgctattgtatccccagcacctagaacagtgcattgtaggtgctctgtaaacacgctgattgaatgaaggaatgcatgaatggaggtaggtagcaggttgcaaatgggcagttcgtggtcccatctgtctgggctctgttcctatttctgctcttactggttaaataatttggcaagttactttatctctttgggtttcagtttccttacttataaaataaggatagtcgttgtacttctcttgtagatttgtggaaaagattaaatgagtgtaaagtatttagcttgtggcaagttgttcaaatgtgttagctcttgttactagagcatcttccatgtttatggtaggtcgggcgttctcagtatagtccctgaaaacctgcatcaggatcacctggagcttatttaaaatgcaatttcctgggttccagtccataaatctgaggagagtcctgaaagagctgcgtttttactagctctccagatgactttttgcatatgaaaatcttggaattctatgttagaggaagaagtgatgggcaacagctagagcatggcaatcctgagcatggggtcaggtgaggatgaggtgactctacctataaggaatcagaaggaggggccttccctctcagtggtgtgtgtggtgtgtctggaggtgatggatgggactgggaaatgggcattgagaagcaaatgggccctctggctgctgctgattttaaaatgatcttgttctgggatgagagtcgatggccatgcctaattatttttttgtcgttggcagtgggatgttctatgacgggaaccacacatatctcattgagccagaagaaaatgacactactcaagtaagtgctccttctgtttgttgtggcaaatggaaatgtttatgctgagagcttttttcctctcctttttttaatttctactttatttcatttttatattttttagggttaagatagtaaacatatgtacagatgctcctcaacttatgatgggtctatgtcctgataaacctatcataagttaaaatattataagtaaaaaacgtatttaataccctgataaatgcatcataaagtcaaaaacatgtatgttggggactgtctgtatattttaaactaaatattgagtaagtcaaaaccacaagtgttttttaaaaaatttcttgccaggtgtggtggctcatgcctgtaatcccagcactattggaggcagaggtgggcatgaggtcaggagttagagaccagcctggccaacttggtgaaaccccgtctctactaaaatacaaaaattagccaggtgtggtggcatgcgcctgtaatcccagctacttgggaagttaaggcagaagtattgcttgaacctcctgccactgcgctccagcctgggtgacagaatgagactccgtctccaaaacaaacaaacaaacaaacaaaaaatttcttttgtttctttctcttttatattggaaatataatactttccctttgaggtgttctgaaatctctatttccatctcaaccctaatgtgttatgatctgtcttagtttgacttggctaccataacaaaatactgtagactgggtggcttaaacaacagaaactttatctcagttctgggcactgaaagtccaaggtgccatcagggttgacatctggtgagggctctttgcttgagttgcagatggctgccttctcactgtgttctcacatggcagagagagagagagagaactctggttgtctccacttgttataagggtaccagctatactgaataaggatctcacccttatgacctcatttaacatttatcacttcctcacaggccttatctccagacaaaattaccctgggtgccagggcctcaatatgagaagtctggggacacacacacattcagtccacaacaaatcaaatccacagagctgtgatttttcacccctcctctcttttctagattccagatttttctctattgtctattgcttttaaggctctatgctgatgaagtttagagaaacctgagtcatcttaatcctgtctctcactttagctgaaacattcatttcccacaaattagaagaagttgaattaatattatagactacacagaaacataatacactttcattctagctctgtacatacaaatgttcttcctcgtattacacaacattgcttaagcagagaggcaaattcttccaagaaacatgcatggctttgtcacccataaaccatcttgtttgggaaattctctgtattgtgtattattttatgggtacccactgctgcctgtcttgtcactttgcttgacagtatgatttttttaagataatatgaaaccggactatgacattctaatttttttttttagtaattggatgaagccagatgaaattatatttgagtgtttattaactttttagaagaaaaatgtgactttttatctcttgctttttcatatagcttgtatgacacttgaatttcagaacagggtccactttggacatttacttataccaggcatcctgctccccaatactatgaagattgttagctctgtagtctgcctaccaaagctctctgacttttaaaagggtgcagggatccgtgaaaggaatcagtaataaaaaaacattaagtcattttgccaaatgtcttatttgtccttgggggaatagattcattcatttgttttccattactgtaggctttggcttctctgtgaaggcatttttcttctcattggatgttgctctggtgctgagagaatacaggagtgaataggaggggttgggcaatggttcatcacctctctaaacccaggagaatgcataggcaagctgtggttcttttaagggtctccagctatgtttgcctaaggctggagataatcctgttgtacatgcttaatcactgttgcttgtgtcatttcaggaggatttccattttcattcagtttacaaatccagactgtttgaattttccttggatgatcttccatctggtatgatgttcatatagtgactttttatctaaaagacaacttcagtaatttatttaatgccttagaactaatctatatttggaatatcattagcccacatctgcttttgacatttttagagggagagccaagtcacgtcaagagggagaataaaatgcaaactgtcctcacagatgagtttggaaagatgtggaggaaaactttaaaacattttaaaattaaaaataaggcactaaaggagaaacaagattagagcaagaattggtctgtgagacaaagtacatacaaattcactctttgtgaaatactggtcttgtaaacatagggatgaactcttaatcatttccctatttattgttttccttgtctcttttttgctctagcattttaagaaagaactattatgggttaacttttattatcattatgtgttatttgtgaaattagtcatttcttctcatctatacctaaatggatctaggttaattttaagagtgtttgtctcccaagattacttatgatttactataataagttagaagaaaacaagaaatagacaaatgtcaaaaatacaaatttagtgaaatattttcaaaagtaagctaatttattttaggttgaataaatggacctagcaacctatgttgctttgagagtcgcttccaagtcttcacatgacaggaagggcagtgcatgcatactttgccctccttagtggagcagtgattatgcagggtgagttagcgtttgtctttggctgtgctggactcatttgttttcttctgaagacagacagcacactgaatatctttattcagaagatatctggatatctggtatggagatgcttcctccactatttagtgagccttattttaattttttttttttttttttgagacaaagtcttgctctatcgcccaggctggaatgcagtgacgcgacctcagctcactgcaacctccgcctcctgggttcaggcaattcttctgcctcagcctcccaagtagctgggaccacaggcacacaccattacgcctggctaatttttgtatttttagtagagacaggggtttcgccatattgggtaggctggtctcgaactcctgaccttgtgatccacctgcctcggcctcccaaagtgctgggtttacaggcgtgagccactgtgcccggcctgattattttaatttttaatctcgttttaatctttgcagcagccctgtaagattaatgttattcccggtttgtagatgaagaaacagagctcagctagtttgtcttttccagggtcccacagctagcaaggggtaaagttgagttttgaattatgacactatggtagagaagcacagagggaaacggagtaatcctaaactaatgcttagataatcacttagaagtttacattgtctcttcatcagaaaataaatgtttcctaatgttcctttctctctaaatgaagtttgtaactccttgtcctcctgtaattttcctaaagagaaatgaacattctctccccttctctcctgctgccagagggatagaagatttaatagaatttactattttgaaaaatcttcaaatgggaatatagatgctcttacctctcacagactttttagactgttctttcagtgatcttataaaactttttaaaatccctattctgataagaaaataagtcatgactagctgtgtgggaataaagctataatttaatgggtattactgggagcagtcaacattaattaatatttaaagtaataaataaagatttttccctaaagacttgactgtaggcttgctaggatataaccttatatatatatatatatctatctatatatatatatcttttttttttttgagaaaatcattcagggtttctttccagcagaaactttgatggtgacttggcagttttgctgttattaaaatgatttttagacacattctttaaaaactcaggtctgtttcaatcagtttctagttttcttttctcatcagaagttggcactgtcaattttgagagagtttgtctcccaacattacttatgatttactgtgataaatgagaagaaaacaagaaatggacaaataaatgtcaaaactgcaatttctgtgaaacagtttcaaaagtaagtttaattattatagattacataaagtttaactgggttgtagattatcaacatcatcatcttgttatgttttatatatttcccagcgatagacataggatcagctgttccccaaacttgctggactgtggaacatttgctttacatggcatgtacctgtctcaggactagtgtttctgagaacatattctgggaaaatcttatttcctgtggacacttatgcacccagttaaaaaaatatgcaatgaaatataaaagtcttgtgtaccattcaatgactttttacatacctacactcttgttgagagatagagcatgtccattaccccaataacttcctttgtaccctttgtagtcagtgcctcccacctctgccattccttttgtctgttgtagaactttatacagatggaatcatgtactatgtgcagcttcttttgtttagcacatgcctgtgaggtttatgttgtcaagagtagcaatagttcattcttttaaattattgaatatgttgtgtcctatgaatataccacttttttcaggggtgggggatggggtcttgctgtgttgcccaggctggagtgcaatagtgcgatctcggctcactgcagcctctgccccctgggttcaagcagttctcctgcctcaggctcccgagtagctgggactacaggcatgcactatcatgcctggctaatttttgtatttttagtagagacagggtttcaccatgttggtcaggctggtctcaaattcctgacctcaagtgatccacccgccttggcctcccagagtgctgggattactggcatgagccactgcgcccggcctataacacaatttttaacttattaagttgatggacatttaggttgtttccggtttttgactattatgagaaaagcaactatgcacgttattgtacaagtcttttctgtgagcacatattttcatttcttccagtaaatacctaggaataaaattgctgggccatagggtaggtacatgtttaactatgttgacagtgtcctcaaaccttagcatgcatcagaatcatctggaggactggtaaccacagattgctggccccatcttgagagttttaattcagtatatcttgggtgggattggagaatttgtatttccagtgcttcccaggtgatgctaatgctgctggtgctggaatcacactttgagaaccactgtttttttttaatatatatatattttttattatactttaagttctagggtacatgtgtacaacgtgcaggtttgttacatatgtatacatgtgccatgttggtgtgctgcacccattaactggtcatttacattagttatatctcctaatgctatccctccccccttcccccaccccacaacaggccctggtgtgtgatgttccccttcctgtgtccaagtgagaaccactgttttatgagaaattgctgaaccctttttccaaagtgggtacactcttttatatttgtgtcagcactctatgagagttttaattgttccacatcttgaccaacatttgctctgtcattctttaattttagctattctagtgtatgtggtggtatctcactttggttgaaatttgcatttttcttgtgattaatgatgtgtagtatatacttactcgccactaatcagaatttctgtcttttttgttgttaagttgtaggagtacttacatattctagatagaaggcctttgccaaatatgccttatgaatatatttttcccagtctttggcttgctcatttacttaatggcatcttatgatgaacagatgttttaaatttcatgaagtttaacattagtttttatcattattgctttctctatgctaagtaatttttgctagctcccaagttttgaagatattctctagtgttttcttctaaaaactctatagttttattttttatgtttagatctaggatcctcttcaaattactttttgtgcatggtgaaaagtaggggttaagttttattttattattttgtatgtggatacacaattattttaataccatttgttgaaaacagtttcctttcatcaatgaattgttttgatgtctttgttaaaaagtattaaaagtatgaatatgagtctatttcttgactcttattttatttggctacccttatcacactttgttttgcttactgtggctttatataagttttgaaatcaaataacgtaaatcctccaattctgttttttccaaaaatttttggctattctgggcccttcacatttccctacagattttagaacctgcttgtcaatttctataattctgggatttttattagaattgtattaaaagtatgggttaatgggggaaaacagcatattattagtagtgagactaaaatttctttcagtgtttggtcatttttagtgtagatattgtattatctattgctgtataagaaattactctaaaacttagtggctttaataaacaaatatttattacctcataatttctgagaatcaggaacctgggtgtggtttagctgggtgcctgtggcccacggtgtcatgagtttgtagcgtaactgtcagctgggactacagtttcatttgaaggctcaactgggaaggattagcttctgagctcactcacataattgttgtcaggcctcagtacctcaccacatgggcctctccacagggctgccccccaccaacctggtagctaacttgttccaggagatagtgagagaccaagagaagagagaatgagacagtatgcctaagacggaagccacagtctttttgttaacctgatctcaaaagtaacatctgatcacttttgctgtatagtatttattagaaatgagtcacagagtccagccttctctcaagggaatgagattatacagtgtcattgtattagttatctattgctgaggaattcatttttattatgtacagaaaaattagaaagtagctgagtaataaattaccacaaaatgcacctcttaagacaatacacacttattatctcacagtttctgtggatcaggagtccaaggatggcttagatgggttctctgtttcagagtcccttacaggctgcagtcaaggtgttttctaggactgcatctcatctcaaggctcaactgtggaaggatatgcagttgtcgttggcagaattcagttcttcttagcctcttagaccaagggccttggtttcttgctggcttttggctgatggttgctctctttctcacataggcctctccatagggaagctcacaacactagtgctcatgtaatgaaagccagtaaggaagagagtctctagcaagatgagttacaatcttgtatgatgttatcttgagaaatgacagttcatcacctttgctgtattccattggttggaagcaagttacaggttttactcacactcagagagagggcattacaaaagggcgtgagtaccaggaggtggagactattagaggtcatcttaaagtctgtcaaattcttctctttggcccccagtaattcctgtcccttttacctgcaaaatacattctcttcctccctaggtctctaagcatttcatcccgttatagcatctgctcaaagtctggaatctcattatctaaatcagatccaggtgtggatgagggtttttgggtgtaatttctcttagtccttctgtgtgtaaaactaaagagacaagttatctgccctatgtagtcccaggatccagtaatgggccagctatagacattcccttacaaaagagggaaaattcgagaaacaagaaagacactgacattgcagttctgaaattctgctgggcaaatgttgaccctttcttgactgggtttcaaggcctagaaataattctccatgactcttggctctgtgttctcaactcttaattctgctcatccttccttttccatgaaaggtagcacatatttgcagctgagtagttttatcagtctgctattctagtttgctaagagtttttatcaagaataggtgttgaattttgtcaaatgcttttctatgtctattacgggatcatataattttctcctttaatctgttaatgtgatgaattgtataaattgatgttttgaatatgaaactaatttgcattcttaaatgggccccaattggttatggtagattatatttgtgtgtattactgggtttgatttgcctatgttttgttaagcatttgtaaaatataggttcagaaagcatattggactgtagttttcttttctggttttagtaccagggttttactggtcttataagatgtgttaggaaaagtttccaaactcttttttttttctaagttggtgtaaaagtggtattatttcttccttaaatctttggtagaattcatcagtgaagccatctggccttgtggttttcttggaaagtttaattaagaattaaagttatttaatagatacaggattattcagattttctatatatacacacgttcaaggaatttcatctaaattaacaaatttattggcataaagctcttcataatatcctcgtattatctttttagtatctatagaatctgtagtgatttgctttctttattggtcaagccctgctgatcaattttattgatttttgtgtttaagttttgagtctcacttttttctatttgatttgtgtttagtttgctcttatttttctgggctcttaaggtggaagattagatcataatttaaacttttttttttcttttctaacataaccacttaaagctatgcatttcccttcaagcactaaatgccttacctgcatcccttgtattttgccttgtcatatttttatttactttaggtcaaaacattttctaaattaccatgtgatttcttctttgtcccatggattatttagaaatgtagagctcagtatcgaaatacttggttatttttttccaagcacctttttattatagattttttaatttaatagaattgcaataagagaaaatactctgtgtcatttcattttctttaaataaaatttattgggacttgttttatgatctatcataatgtctgtcttggtgaatgtttcatgtattcttgaaaaggatatgtattcttcaattattgggtaaagtgttaaaaatgccaacttagttaaattggttgatagtgttaagtcttctatatccatatgattctgtttactttttttttctttcaattactgagggaggattgttgaaatccttaactataactttgaatttgtctatttctcctttcaggtctgtcactttttacttcatgtattttaaaactctgttattaggtgaataaacatttaggagcattgtgtctttttgatgaatcatcccatttataattaggaaatagtttcctttctctcagatacttattgtcctgaagttacattgtctgatattaatatttccttcacagttctcttgtgattaatgtttgtaaggtgtatcttcttccatactttaaatttaaagtgcccctcttctaaacagcatgcagttaagtcttgcattaaaaaaaaaaaatccagtctggcaatctttgccttttaggcacaacatttagtctatttgcatttaatgtaattattgatatgagatgggttacttttgtaatcttgtttttctgtttgtcctattagttaattataaaggagaacttattccctttctcaacaaatcccttgtatgcccaggccatagcattctgaaaaatgacatgatgggagaatatttgaacatgaaataaagagagaacactaatttccttacccgattttattattcagcttcttggtcacaaatttctctgaccatgcttatttctcctttatgaacagtatccaaaaataatggtaatggttcaccttgagtgttttatagtattatttgtataataagccccttcaggttgctcaaccatcaaagtcttaggaaatctgtaccctgtggaaagattgcagctttcctttcactttgtagaaaaatcctcccttataaataacctaatcttatatttggagatgaatctatacgcataaacagttgatgtataattttcacatctgctaccaagagcagataaatcctgagatcaatttggttatgggcaaagaagaatataaattaattggaaaaaattagctcaaaactttggtgtcctataacaatttcttaataaattatgaacttgggaatgtgtgattatttattctacttctcattgctcctcttctttattttgctgcctctagaaggttagtaatggaggtgaaagtcaagttggctttttggaagatttccagtaaataaagtaatgatatttataagagaaatatgaaaaattttccagataaattagaacagaaataatgttctagattttgcaaattatattcatcctttatatgtttatttagtattaatatactacagttacttaatggtttgtgtgatcgttaagtgcaacattatgtattataaaattcataagaaggaagggcaggtaaaactttgccctgtattgaagaaatctgacaaatgcactaagttaaattaaatttaatttccttttagaatttcagcaagtaaacattactccatcaaaatttattttgaagccaagaccaaaaaggagtaaacggcaggtatgtattcacagtggtgtgtcgtgttattttaaaacaattgtcaactgccagtcatttgaatctacagtaagtctgtgtgagagggtgagtattagtttgggaatttgtcagggtgtgataaaccgtaagggtgatggatctgaagaagcagtagaaagggggccatgttgtttcacagatgcaaaaaggattcaagatagtggtgataatatgtttcttcatcatattatgggttatgaggctcctgcttgtggcaccttgggttctttctaccataggcttctttccttgcccagatatgtaccacatcgtggaatccacttgtatggtttatatccttgtatttattccctggaagataaccccttaggaatgaatcaatcaggttgtgaagccacagaatgcttttgtctcacttgggcaaaactttggagtccaggatataaaattaggtcatggactttatgattgtttgactggatcttggactagggaataataactgttgatatgacgctttaaaccaaatgaagtcggtactattattcccctttcactgaaagaaaaatgatgactctgtgacatgtgaaaatgacttactcgaatcatagagctggtaaacagtttagacaaaattaagagttgtggccatcagaatcaagatatcaccactgtggtggtgtgggcaggagagatggttattaaaaacacaagatgaagggaatagatctctagtaagatcaagaagttgaaggaaccaggtatcttctttttattaccttgaaataaaatatatgtttacagacagatttttattgtgaataattattgctaaattttattgaatacttaccttgtacctggccctattataagaattttaactatattaacacatttaaccctcaaaaaccttaagaggaaggtattatcacaggttaagtatcccttttccaaaatgcttgggaccggaagttttgcacattttgatttattttttggcagggggaggatttcagaatatttacattatacttagtgttttagcatccctaattcaaaaattagaaatctgaaatgctccagtgagcatttcttttgagtgtcctattggtgctcaaaaagtttttcattctggagcatttgggattttggattttcagatgagagatacttaacctataatatcctcattttactgataaggacattgagcataagaggatcaagaaactttcccaaagccacatagggtgactctgtggtagagctgggattctgacctaggaagcctggtctcagagaggtgcttataaccgcatatacgccatatattgcctctcagacccatgtgttccatgaattactactgtgacctttataagtgttgtgaatgtttatatatatatactcatatataaacatatgtgtgtgtatatatatatatatgaataggtaaagacatacgtatcttgaggcccagttagataaaataattaccatcaggatttaatgtgaaacagtatttttttgaattatggactgaaagaataggacaatattcttttgacatgtaccctgaagttcctcataaacatctcagcatctaatcatttgctaagtagacaaaaccttgatttctctttctgagaaagccatggacccatagaggtgaagtactataaaactgtgtggctaatatggcaactctttgacattaacaaaatgttgggatttgttgaaaaatttgctgtattaactagtctctcacaagtagcaaagcagctcctgttgccctaaaaacacccccctcccttaaaaaagaaaagaagactctcatcattggatgcactttagtgttattctttggtttccaacctcagaattgtatctattattccctatcaccttggtgttataatagttttttttttttaagtttttaagtttaggattgcagttagcaatgacaaaatccatgtgggagcatttttaaagttggttttaactgcaacactcaaaacaaacatatatgtattgatttaagtttgattgtatacccttatcgcaaaaatggaccttgggcaagtgagcaaaacgttttctggaaaagtttatattgaactatggcataaaggaaaaagctagctttacaaaccttgttaatgattatattataggctaactgtagagaacaaagagaatagctgccttagtggcttttccttagtggcttttccctgtaactttcattggtcattatttcgaaagagaagaaaacttgttggtgagcagagaaagctagctgtaatagataactcaagactgcctgggagttctcaaagctattctaacaaagaccccatgtcatttggggatcccctgaaacgtcctagatgaaggcacatgactcactcccagtttggagattaaataataaaagtgccaatcactccagtccctgtaccctctcggagatcctcagaggacctgaaattaaacccaaaagaatgctcttcatatgttactattttcaagatagactgttaaatgaaaatcgctggaggcagaaaggagtgaaataaacggaagtacaaaataaaggacatattcacatttagttttatgtgcagaagtatttttggaaggaaccagtaacttgctatatccattgtgggggaaggactaggaactgagtaggtggagaatagaggtgagaggaagacattcatcttctgcccttttatactttttaaattttctgagtcatgtaaatttattaccaactcagaaactaagcaaattgatgaaaaattttttaaatgctgaaggaataaaaagggaaaattttgttttgtcagtttcttccatattttttagcttttcgcagccaagtttagagggctgaattaggtgctgtttcctttcctgtgttacagcttcgtcgatatcctcgtaatgtagaagaagaaaccaaatacattgaactgatgattgtgaatgatcaccttatggtaggatttgctgttgtttttaagcctgtttgtgcctagggtaaaactggtgagtgcaaaaatatgtttagaaaaaacaagaagcccatcaagttgtaacctggagaaggtatttgtataatcaaatatatttgttaactagcaacaacctgcaattaggaaatattcataggtggaaataactagcagtaacttttgagttttcaaaaatactttgtgactcatagtatcaacttttgagtttgcttgattagtagaggtactaatatttgaatctccacttaataaaatgacaaggtttaaaaaaatggaaattccattatatattgaaaaagtgaggcaccaattatgagacattttagttcgcggggtacacctttatcttaataaaagaaaagcagcttttctattttggtcttactgtgcagaaatcatatggaaatgcttacatagctaaccatttagcttaggatgaagtttcttaggataagaacttgacaaaactttcatgttgttgaatcaaattattttgacccatagtgtttatattcagttaatgggcatattgcaggcagtatgactacattcatagcacagcaatgagttataatgctaattgttctatgtaaccaaagttttaaactaaaaatgtttaatgatgcatattgctgaattttacttaagttcaggtacaagtgcattttaatttactttgaactacttatttgaggaaaaaatgatcatttatttatgtatgattaaatacataatttagatcttaattattacagttgctaataataataataacaacacaatcaggattgagtgctgcttccttgttcaagctaggtctaagttttatctttccacctatttgaatccagtgaatgtttctgttccctaggatttttataaaataagttataacaacatatattttgaacattttagatcgtcacaaattcagatatccatagacatcagtagacatataacgtaagtgaaattaaccagatataagacagtattaggtgggtaaggcctgtggtgaaatgaatggtgcatggcctgtctaaggggagcaactgcctctcagtgtttgccagttattaccaggtgagaatgctaattttaactgaagccagaaattggattttacatgatatttcctgatttttaaaacacgattgagaccaaccaaagatatatgtgatccacatctgccctgtatgccacctcgttgtgacctttatcttagaggtttcttcttgctgaataagtcttgcagaacttttaaatttgtttgcttttagcagtgttcacatccactttactgtctatacccctacttagatttgtatgtcttgcaattcatagacaactttcatatgttttatcattttgaataacaatcccaataaaaataaacttatgaaatggatggattgggtattttttacttcatctcccagatgaataaattgaggcctcaatcctttaagagacttgtctcaggcaacacagcagataaagaacttgatctcagctctgactctgacattgttttacagacaacacatttttacagaaaagattttttttttttttacatttttagggatctttcaattgcaccatgttttctctgatgagatgattgttttctgatcactttgcaagaccttcacttgttttcttttgctttcagtttaaaaaacatcggctttccgttgtacataccaatacctatgcgaaatctgtggtgaacatggcagatttagtaagtatcaaccccgttcattattgccctagaagattcttatttcctaattgctaatagaatggataatatgattcttatagttttactgctctatgttgcacttcagccaaggtgtctagtaagttccgggtgaccttgcaatagactttattgactttgatgtctggctgggaagaggaactggtcgaagttatccatagatatgcttgaaattccatcctatgtttttcacactgtaaaaacaaaggttgtgtcatacccctaacaaaggtattcacagtgacttataacgatggagaaacagtacaatagttgtgcctttaagagtgcctggtgctgtggcagtgatggaactaaataattccactatacctccatacttcccaaatcttcccttgatgaggctgcgctagtaccttcttcacaagtctaatcagagccagtcagcttgtatagaaattatttctttggagagtcttcattgctccatttttggctaggggaactcaagcatgcatgaattctttttccaggataccagaaaacagattcaggtggaaccttgaatagggtgcaggtatttgtcaaaaagggatcttttgtttccaaaaagtgctctgttctttgggtattggtcaacaatttcattctctgttactcaagggaaatgcatgtaaattagaaagttatctccctttaactaaaactcaaagaagtttccatgaaaggagttttgtagtcctgttcataaactatttgattttaccacatgtacagctgatgtgttcattttattaatatactagatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgtacgtaacttctgtaatgatgtattactttttttgattccatgttaaatgctttattgtgactgaaatgtatcctttctgctacataacacaattaggatttgacatggcagatggcagatagatttggaaaaagttttcaagtatagattgcttaaaattgccatgaaaatgtaaaagttttaattttgagttattttattatttaatgtttaatttttcaagatatttaaatagagcatttactgagtaaaaatactgctaatactcatatatagtattcttaactacagataaattatattctttaaagttactgtcttttaaatgttaatgttttctctgtttttggttctaagatgagagcttagtatttctggaatttatttttaattttttctcactcttatgttctttttttgatagcatgcatatttgacgtaatagcaaattatatatagtagaattttaaaaatctatcatctaaagtcagagctgttgaagaaagttataaaaggaagaaaagatgtattttggggtaactttatatataattccaaatttagagaaaagttgcaagaatactacaaggaaattgcatatgccctctattcagattcatcaattattcacattttccccatttgtttcataattttcttccattctccctcccttccttccattcatccatccttcagttttttttttgtttttttttgttttttttcctgaacctcttgaaagtaagttgaagacacttactggggatttattattaaatagtatatattctctaagagtaaaaagacattctcttatataaccacagtaaattattaaaaccagaaaatttaacacaaacataatacttttatgtaacccatggtctatattcaaatttcaccaattacctcaataatgtcttttaaagctaattttccccatccaaatccaatccaggatcacacattgcatttaatcatcatgtctctttagtctcctttaatctgaaagatttcctcagctttcctttgtctattttgagtttaatacttttgaagagtataggccaattattttattgactgttcctcattatgggaatgcctgatgttaagatatgtatttttggcagaaataccagagaagtgattttgtgtctgtctcagagtacatcatatcaaccaattattttttaatagatatacttcaatttaagatatttattaatcttgcaagaaaacatccctcataaacctttttctttggttacatgtataaacaattttcacattcttcccttgcaatgtgaatatattgtatagaaatcttatgtatagagaaaataaatgtagtaaactaataatgaggggtgctatgatgtttgaactgtgaacagtaagcatttttcatttccttttctaaaaggggaagtcaatttgagagtagccggagcggggcagcttatattggtgggatttgctcgttgctgaaaggaggaggcgtgaatgaagtaggtgtgaacatctgtacaatacaaagtggtatgatggctgaaaatgttttcctcatacttaagagataatttctcagtattcacatactccagatgttagattgctatattacaaatcagtatggtggcctggcacaatggcttatttctgtaattccagcactttgggaggctgaggtggacaaattgcttgagatgaggagtttgagacaagcctgggtaacatggcaaaatcctgtctttatcaaaaatacaaaaataggctgggtgtggtagcgtgtgcctgtagccccagctactggggaggctgaagtgggaggatggcttaagcctgggaggcagaggttgtattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttggggataagaaaaatagagtaggttttccaaagggtttcttttactcctaaggcactaaacctactagagatgatcaaaaagaaaatacttgcatttttaagaggctgcaaattgaaaaagatatcctcagttcttcttaagtttctattggccgaagatcatcactacctcctgttactcatttcatttgttttctgaagctacattctattccacttgaggggaatttcaggattacaactggatacaaagatgaacaagttctaaaaaaatttacagatttaattttattttgtattatccaaaagacggatttaattatataccaatattgaatttttcaagaatgtcactggtgaaatttggactcagatatacatttccaaaacccaaaagctgtgattatttcctgacttctagtattccctgtaagacctaatcaaacatggatttttgtttcttactactttttcccaaatgcatattcagtgctggctacagtgtgttcagcctcttctaaagaaattgcttagaaattacttattttcagcgatattgtgacatttttctctggttctttgtcagtgacaatttggatttacatatattttatttttgtttttgtttttcagtttgggaaaactgatttaatggctgttacacttgcccagtcattagcccataatattggtattatctcagacaaaagaaagttagcaagtggtaagttttagtacatgtgtggttagttgtatttaaaatagactatttgtgaaatattttggagagtaaaattttttgatttagttgcttgatgaaaggaatttgaacgatagtaaaagataaacatccagcgcacaaactgttgttttccaaagtaatacaaagaaatatttacattataggtggaaatttctatgactataataaactttaaagccgtgtgataataaattcaagctgaatttaaccttataagggacaaaattagcccagtttgttcatcattaatggtttagtagagaattctaggcatataggtttcagacgtactggtttttttatgttttatttaaaacatctctgaacatggccacagaggtagagtttccctgtcaggatcagacctgataaaaagcttagttaatatatggacctagtaaaatatgctaggtttggtatctatgaagaatgtcttttctcaagtaggtaaagtcactttaccctgaatggtcaaatactatgtatttaccttaaaaatttgattatttccatttttatttcagtaacaaacatcataaatattatttttataatctggaatcccagcactttgggaggctgaggcaggcgggtggatcacctgaggtcaggtgttcgagaccagctttgccaacatggtgaaaccctgtctatactagaaatagaaaaattagccgggtgtggtggcaggctcttatagtaccagctactcgggaggctgaggcaggagaatcacttgaacccaggaggcggaggttgcggtgagccaagatcacaccattgcacttcagcctgggccacagagcgagactccatctcaaaaaaaaaaaaaaaaaaaaaaaaaagctattaccatgtatagagtacctattatatgccagatgattgagtgccagtattacttccatttagatactcatttaattctccaggtaattctacaggacacccatttttagccccattttacagatgaagtgactagctcttacaagtataatgtctctaagattacacatatatcaaatggcaaactcaggttttgaaccctagtatttctgattctgaaacccttctgcctaaccaataatatattacactgccttctaccagaaaccttggtgtgtgcagagactttcaaaaatggtcaagaaattataatagttctcataaaggcctgtgaaactgagatcctgtaatagtgccataaagttcttcattcttccattggtatttgattgtctttcatttaagccattttaaataaatggtttaaatatggccatttgttaaaatacaagggtttttttggggcaaaaattatataatcttgatagggtcaaagtatatttttgttgcatattacataaaaaaactattgtaagatgaattagaaagaagttactactttttaaaaggcattttaaggaataaagtggagataattattttaaaacagaaactactttaatgcaactgtgttcactttataacaaggcatgtgtattaattttctcttaggtgaatgtaaatgcgaggacacgtggtccgggtgcataatgggagacactgggtgagccacttgtatttgaaaataactcagtcttacattccctgctgtgctgttgtcttcttaggaatatgacactcaataacttagtgcatggaatctagcacttataaaatatttttgcaaaataacctcttatttataaaaacaattgatgtcaattaagttggtagacctcaaagatttttttttctttagccttacatctaggctataaacgtaagaaatgagggacaactttgtttttggtggcttacctgctaattccctttccttttatttccttcaattctaattaaatggtttataaacagtagtgtgctggtaagttaactcttgaaaacaaaaattagaaaacagcctggatttgtagctttctcacatttctgaggtgtaaatagtcccacaatggctgacttcaagccattactgatggcttcataatgtggtattactgaaaagggagttgggaagagaaatgtacaatctgctctcccgagaaaggttttcatttttatactgtcctccctttcacacgctcagtcatcaatgcttgtcttttattcttgtaaataaattttacagttattccttttattccaagcttatcattactgccctagtttaaactttgaccatcttttgctgttattattttaataacatttcaaatactgagtataaattcggttcagtgtttgggtgatgggcgcaccaaaatctcacaaaacgccactaaagaacttactcttgtaaccaaataccacctgttcccccaaaatctttggaaataaaaaaatttggaatgttattaaaataataacagcaaaagatggtaaaagtttaaactaggacaataatgataagcttggaatcatcatcattaaaaatgtatgaagaatagaacagtggatacttatacacccattatccagcttttaaaaagtaaaatactgcatttgtggttaaatctcccttctgtcctccattattaattcccagccccagccaaggtaaccaccatctaagtttggttcctatcattctcaagtcattctttatacttttactgtatagtatgtatgtgtgttggagtaaaacatagcatttggtttgcatgttttcagtttatgtgaaatacatcatgctgtatgtattcttctgtgacttgctgttttttatcaatatgtttgtgagatttatccatcctgttaatatacaattcttgttcattaaatgccattctcctgctgagaaattgtgtgagtctctgatgtctaaagaatgtggttcataatcttaacttcattatttagatgcccataatctttcttcattttcatttgcaatctccttttcccctactattcatgattggtttgcttaccataatagtacaggagtttctagttttttcaatttgctaaccataatactacatagattttcagcttcttaaatacttgctcaccataattgtacattaattaccaacttcatttgatttcctcaatatattctatttatctggaatgcctttcccttttttctctatctaaccagatttctaaccatctgagatttgttgtaattttaacccctgcattagaatttaatcatgtgtacttatgcttcctttcacaaattagttataaatttttgagggattacttattatactaacacatatttcagacctcacatcataatcctttgtacaaacttgattttcaacaaatatttcttgattgtgtttgaattttgaactcgcaggatatgtataacgaggaaaataaatgatagaggaaatatatatgcaaacatctgtttaaaatatttttccagccaggcatggtggctcatggctgtaatcccatcactttgagaggctgaggcaggcagatcacttgagcccaagagtttgagaccaacctgagcaacatggtgaaactacatctctacaaaaaatacaaaaattaaccagtcgtggtggcacacacctgtagtcccagctacttgggaggctgaggtgggaggatcgcctgattccagggaggttgaggctgcggtgagccatgattgtgccactgaatgccagcatgggtgacagagtgagatcctgtctcaaataataataaagtaaaatatttctccaaaaatctttggactttttgtttagtaatgacaggaaatgataaaagttctatagttgcagtttcaacaattacgaaatttcatactagagattcttgtcttttaaatcctacatagtatatttgattatcctgattattaaaatgtttaatagataatctgcatagcactaagcataatatacagtgaagtcaaatggctaccttcagatacgtacagctgtgtacattggaattcttcttaaagagatgcaagcaagagaaaagccgtttgtataaaactatgggatatgacgctataatttgattgcaccaaatatcaccaaacagcagtaattatggacatttgttcccatgggtacgttccctaccatttctactttctgaagttctgtacagctaaatattagaaagcagggttgaaatgaataccttcagtcctatttaaaggtatgaaaattaaaatttgaagaatgcactgaatacaatagctatattattctgtgaaacagaagttgtggggacagaggcaggagagagacatgatatctgccttcagataattgaaggggctatgttaaggcagaggaataagactttacatagttaagaatacagaactgttcagaagttagaggtcagatgtggcaaaataaaggtaagaacaatccacaaatgttcaactgttcatatattttaaaagcttccctgttggggagtttactgtcactgccaagggttggagaacagactgagcttcctcccagctctgcagtgggcaggagggtgggcttggctgtgacccctgagggtgcttttacagagaggcctctttgtaggaggcttaactagactttgacttctaagagtcctacactaagagttagtgactttttactttggcagtatggatccaactcaggttttgaccagtaggataaagagggactttggggctgggcatggtggctcacgcctgtaatcccagcactttgggaggccgaggtgggtggatcctctgaggtcaggagttcgagaccagcctggccaacatggcgaaaccccgtctctactaaaagtacaaaaattagctggatatgatggcaggcgcctctaatcccagctactaaggaggctgaggcaggaaaattgcttgaacccaggaggcagaggttgcaatgagccaagatcatgccactgcactccagcctgggtgacaagagtgagactccatctcaataaataaataaataaataaataaataaataaataaataaaaggaggggctttgaaaaaagacctatttaaatttgataactctggcagagatatgttggatagattagaggaaaaggtgataaaaacattggctggagtaaaagcattgcaaggaaaaaaggaagtaatattgttaccatgaaacagatggcttggttggtcacttactgggtatcaacttaattatcataaccaaggaagattaaatgaaagggattttattacttttaacaagcaagtagaataccatggatagttcccaaagcagtgtatccctgagctggaggctgtgtcaggttttataagcatagggtaatgaggtgtgatctgattggatcttgcaatgaggtggtgctgggaggcatgatcggactggatgccagagctcaatctgattggatactggatcctgtcattcagtgtatattagtttgtttttcattgttataaatgaaaacctgagattgggtaatttataaagaaaagaggcttacttggctcacagttctgcaggctgtacaagcatggcaccagcatctgcttggcttctggtgagatctcaggaagcttttactcatggtagaaggcaaggggaagcaggtgtgtcacatggcaagagagggagcaggggagaagggagggggtgctaggctctttttaacaaccgaatctcgtgtaaacttattaccagccatttcctcttggagggcactaagccattcttgggaggactccctcattagaccccactctcaacattggggtcatattttaacatgagattttgaggggacaaacatccaaactttatcatcgtgtctgctgcttgattcagtccctgcttctcagctgagcacttaggttcctcctgtggttgcaccattggttcatctgagcatggtcaggctatgtgacctaagggtccacggcaactgaaaaacaattcataacattattacataaaagttgaaccagattggtctgatgcagccacaatgtgtgtaagaaactttcaaatgaagaataaagtttgtcttgtcagaatttgttacttgaaaaaaacctggttcctttgcctggcaagaacaaacaactcttcacaggaatgcaagttttggctggcccagtggctcatgcctataatcccagaactttgggaggatcgcttgagcccaggagttcgagaccagcctgggcaacgtggggaaactttgtacaaacttaaaaattagctgggcatggtggcacatgcctgtagtcccagctactcgggaggctgaggtgggagaatcacttgaccccaggaggtccaggctgcagtgagtggagatcacaccactgcactccagcctgggcaacagagtgagacccctgcctgaaaaaagaaaatgcaggttttgatcagtgagagttttattactagtcacaagtaaagagagctctgagagtattcactagacgagtgtcttcctgagggaaagcaacaggagggttttatggggaggtggaggggggagagggtgtgtcattgcatgcagaggaggggtcccagtggtgcagatgcagtgaatcattatgccagcacataggtttcaagttatagtaatgaagctatggttcctcccgtggtggagactttagcatggtaatgaggaaagtttacttgggttcatttataaattgtcagtgtttgtcgggagctggttccagctgactaggtgaccacattccacacaaagtgtgggaaagagcaggctgcaaggcaggaggctgtaaaacaggctgattgctcaagttgattaaattcctgtagtatctggaaaccctccttgtctgcttagaggaagtggaggtgaaggaagtaaaggagttcagacaacttaaacccaagacagctttatttggagagtttggcatgaagccctttaaaaatgagtttagggtaaataatcattataaattccattaattaataacaaagtattaactactgtgtttagaagaagtagggatataaatggacagtttttgcaggctactgggaaactttataaaaactactcattcttaccttgttttttttccctttttatcaaagctcaatgtaaaacaatatttaaaaaatatagaaaataaaatcttggtggcttttctccagtaataaccatggttgatattaaaatactgctgtattttaattcagtatttaacactgtatagtcagcatttttctgagtctgttcttcaatactatgatcattaataactacatggtattctgttttattaatatatatcacagtttagttatatatatatcacagtttagttaacagttcttactgttgaacatttaggttatgctttcgttatatcctgttataaattgtgccaccacaaatatctttgttcgtacatctttgtgcacgtagccaatcatttcctcaagaaaaatttctaaaagtagaattactagatccaaaggtgtgctctttttgaagattcttaatgcatgttgccaaattattctctaatcaagatcttttttctattgaccttttattagtttttttaagaatacatttttttaaaaaaaacctcaaacctgaagaagagttgcaagattaataacaaagaaactttttgtccggtggatcataaattgcttagtatgccattactcctaaataccttactttgcattttctacaaagaagtacatcctcctacataaccactatacaaccagtaaaattatctaattcttagccatcattcaggattgtcccaggtttcaatactgtcatttgtagcaaaaggaatcacatttggtttttgtgtctctttagcttctttcagtctggaacagctcctctttctttgacttttaagacctgacatatttatattataggtcagttattttgtggaatgctctgcagtttggattctagctcagttttaatatttagggaagactcattataaaataaatttttcccaactctccttgatttaacttgaatgcacatgcaaataatgaaaaacccacagcaactattagtcaccaaatgaggaatttaaaaataatattgattggccgggcgtggtggctcacacctgtaatcccagcactttgggaggccgaggcgggcggatcacaaagtcaggagatcgagaccatcctggctaacacgatgaaaccccgtctctactaaaaatacaaaaaattagctgggcatggtggcgggcgcctgtagtcccagctactcgggaggctgaggcaggagaatggcgtgaacccgggaggtggagcttgcagtgagccaagatcgtgccactgcactccagcctgggcgacagagctagactccgtctcaaaaaaaaaaaaagaaataatattgactgaacaaaactcttatagattgaatataaatgtcatacataagtagactttattccctcattttaaagagtaatatacaattttaagtcttcagttttcagacattcacaaatgagaaagatgagttgaacccagctattgcttttcttctcttttatagctattatcttcctaaaaagttcacccagtgtaatattgaagagtatcatgacttcctgaatagtggaggtggtgcctgccttttcaacaaaccttctaaggtaataagtgtggttaataaggtttataatattaattatcaacctttctaaaatattacaaatacacattttcagctattgaatcttagagagcttttcaacttgccctgtatgtacatattctagatatgctatatatctgcatattcaaagtcagctttaatgttgggcattttgggctattctgatgggaatagaaagcaggtagaaataagtgtttgctgtctgaaaaatttccactttctttttatatagccaagtgatgattcagagttagtttacaaaaatggttttattacttttcttttttattttcttgatgtttattttttttggttacctaatcacaactcatacaggtagaaggtgggggcttatctaccctcatcactccctatcactgcctttctgaatgagcagtatgttaaaattacaagtatttctcagtatgaaaaacaagtcttcttaaagcagaaatggagaaagtcttggactttgtcacaggcttttacaacttgcagcacatcctctggttactgactagaaagaaggtcttcctcctgcattttgaagactttgcatgttaaaaaagaatgctttgtccttgcgaattatgtgaactgtgaaatgcttctgtgcaccacagggatatgcaccattgcctttgtaatcatttaatttacctggtttaattttctgttcactacagtgtaatttagaaaatgtatcatactgaattgcgaagcaaattgacaattttaagactcttcgaaagattggaaagaacatttgaactgtatcactgctgccataaatactaaacagttcaagtctttttaccaaaataattgattattataaacccagagtaagagaataagtgtggttatcatttggataagtttccatttttgctgttttttatttgttatgatcagtttcgaccaaaaatgaaatatagacaaaagttgactcatttgtagaagagagaatatttaaaatcaagtgggttttgttgttgttgtatatattctttattttgttgtttttttcctctaattagttatgaaagtgtatgtgtgcacgtgtgtatccatctgtttactggtgtgtgtacattttcattctataatacgtaaactttgattagcttttgaatgaatattaggtatctggcatataacaattatttactaattttgcctgtcaccataggatacattatattcaaaagagaacaaagttgatgaagagctaaacaataaaacagacctaaaacatactcttggacaggccaaaatttgcttcaatctctggggaaaatttaattttagttcgctgcaaaactatcttaataggaggagctgttttttttattaagtcgatcaatggatatactaattttttgatgcttttctcattgtctatgaaatagtttcctgtatcagaaggagatatagtaataaagggttttttcacagatgactaaacttaatcctcaacaattttctgatgtggatggacaactattattattattattattcctgttttagatattaagttctctgagatattaaatagtttacccaacgtaagtacttgagccaagattttaatctagacatctgactccaaattcccctgcttccagtttgaaatgaattttcaggagagactctggcttgattttagtgaatggttagatcatctttaattttgatgacatttaccagaccctatgtggtgtgtatgttatatatataaatatataggtaaactatttactatgtatattaaatatgaaaaggaaacagaagtagacacttctgttttaaagttccaagttctgagctcatgctttctagtttaggaaaataaaactatattttagaatgactggcagggcaggtatatttgggtatggcacttatggtctctcaaagtctttgatgttgatttttctatattttagttcactttttggttttcctcacagcttcttgatcctcctgagtgtggcaatggcttcattgaaactggagaggagtgtgattgtggaaccccggccgtaagtctctggttgttttgatgatattttctaggtaattcagggtcattccaggtccacacactgagatgtatggagcaaatgtcatgcctggaattttataggatttgtggaagaaaaattattgtgagtttgtacatttattttagaaaatatcctgttactttcaggaaagtgacaccgttttctgatgttttgaaaatgtttatattccttaggaatgtgtccttgaaggagcagagtgttgtaagaaatgcaccttgactcaagactctcaatgcagtgacggtctttgctgtaaaaagtgcaaggtaaataaacattaatgaccatttgacagaaaaaaaggacatacttgattaaatcattaaggctgggtaaatataatctaataacagaaatagtatctaacatatattaaatgagtaagtgccaggtgctttataggatcttcacaaaatcttgtgtggtgtagttgcttattattattcccatctaaaagatgagaatactaaggcttgtagtggttaagtagtttgcccaaggtcttacaccaagtaagttggggaactagggcctgaaccctgttaatcttcagaggctgtcctttccatactttctgtggagcatgcacattaaatgaaaccaggtgttactaatgtttaaatgatgtttacctttcttggtaaagccaaggagactttcagtagatcttttcttgttgctcagcttggtgtatctcttgcattagctgctgaggaaacaagggagtactttgagacatgataataccatgcatatattattggtcctgcaagtttagaatgcatctttacacactttatgttttcatcctcccagcagcatcctcatacctatctccaaatatttaagcctttacatcaatactaacatttgaggcttacttcccctaaagaaatctaattcttgttttctcatacaaaatctggtgtaatagtctacgttatttctatctgtctctcactttactctgtacatttcatggagcagagccaggcacttagacagtaattggtatacattctcagtaaatatttgttgagtgaatgaataaatatgcactctcttagtgataatttgctgattgagtaactttaaagagttaaaggaggatgggatatgaaactatcatagtaagtatctactgtgtgccagagattatgctaaggacttttgtatcatcttatatctgaatttctcaactctggcactattgacatttttggctggataatcctttgttgtaagggtatgtcttgtgcattgtagaatatttagcagtatctctgcattccacccattaggtgccagcagcacccctcctagatgggacagccaaaaatgtccccagacactgccaaatgttcccttgtgggtaaaatcacccctggtggagaccactctctgagataatgctcacaagcacacttttgggatgggcattattatcttgatttttacagttaagcaaactcagtctcaaggaagttaaataacctctatacaggctcacttagccagtaaggaatagatgtacagttatgccccagatctgctggcagcagtttctgttgtttccactctaccactgtgtctcctggcagctttttaagacgagcaggcactggcagagatctctgaaagcactctgttaaaaagaagattaaaccaaatgtgaaagacattctttgattttggctaccacccctgtttattctgtcagctttttccactgccgtaacaagacatcctgaattatttatcttaatcctcaatgttttaagtctgcccatctacaaaatgcatttaattacactgttttccctttgatttatacaactaggctccctgtgatataattatttcaaggaacaagtagaaaataatactattaaaatacataaaataaaatggcatgactgccatccctcaaagtaagttatagctgtaccagtcaagagtcaagtgagatcttttttgccactttctttaccatcctccctaactctcacctgccaccctagactcctagggcagccagaggcaggacagtgaatggaggagggagaatagaagaaaaagataagaaactgtgtgtatctctatttttttctacctgtatttataatagtgtatctataagccagcattggcatgctttttctataaagagccagatagtaaatagtttaggctttgtgatcataaagtttctgttgcagctcagctctgcctttgaaagcagcctttgaaaatacagaaacaaatgggcatagctgtgttccaataaaactttatttataaagataggcaatcagtgaagtttgacccatgggccacagtttgcagaccactgctgttaaagagtgcttgtttacttgtttattacttttcttctcccattataatacaagggtatttattggcaaggattttggttgatttatatactgctgtatcctagcacttagtgcaaatcctccctccctattctttcttttagaagtttcctggaacttcttgaacattatgcactcctctaaactaccccaaatttgctcatatttctaccctagatattctaaaatgttggcttgtcttagtcccaaggaagaagagaaacgtgaaattaaattttcttatttccttatttttaacccacattaagatgcaagttcctgatgagcagggttcttgtgttttgttctccattgagttcccagtagttagaacagtgcttggcacgttattaaatatttgatgaatggatgaatgaatacatattttgtttgggtcttctaaaaaaaaatacttgttgaaatccagattggagtttatagtgggcagtgcatgttctaggaacagcaggagactcaaatgcctgtagagttctgagcagctagagaagataaagcttatctagaaagtgagggaagcagaataacatgtgcctttgtgtgagcagacacaaagcatgtaaggatacagccctgaatgctaacattttggatagagaaaaagagaaggattgagaagggaaggggaagtactttaactatatatctcaggtctgtttcattttaatgagtactcctgcaattcacatttttaacctaatgaagttaaacatttatttgtataactctcacacttgcaagaagtatttgagatgatggaaaacagaaaaacaaaaatgcctatatgaagacttaaataatagaaacactagaaaataataaaagaccaagatctaaatccatgtaaaaatgaggcaggggagaagaagggtagaagaaacatgggaggaaatagctttgtcagaaaatctaatttttgtggttcaacccaaaatgtaattttttgattcttggtagataaggcagaaaaggataatgtgataaaagtgtcggtgagaatgaagagtaaagggtaaattcaaaagctattagtacagaaaaattactagaacctggactaactggcctgtcttgtggaatttagcagtataatataaggcttatgtgtaatgactatggaaattacatcatacacaagaaactgtttcttaaaactattaaaataaaatttttttcagtaactgtggttttgacagattaccatcttacagtagtttaaggtatttctagccaaacaattttcattttgttttttttagatgatattgtaagatttttttttctccctacagtttcacacgttgatttttgttcattttagtttcagcctatgggcactgtgtgccgagaagcagtaaatgattgtgatattcgtgaaacgtgctcaggaaattcaagccaggtaatttacaaaataactgctctaaaacttatgggaaaaagtgggggtatctttagtgcactgaccctcaaagagaaatgtaaatgaacaagatgctcgtgtctctttcacatcatttctccattttttttaggaatttaagtttcagtgattgaagcttgagcagattttgaacataattttgtcttaacgttgaactaacctcagactgcgtgcatgccttaactattttgtttttgtattaagtaggtagtacaaggcattttcttttcatctacttagtaaaggaagaaacaaataaactctcttcagctgattgaacaagaagtcagtggaggcagggactcacaaacacactggattcttagagaggacccttttctttctcttgactcttatctatgatagcttgcatcgcctcagccatcaatagctgctcttgaattttatagcacttagttatagatagacaagctagagaaattgaataaactttggtgggagttcacagatttcaaaatggtcactgtacatacagacggtcctcactttgaagggtagtgccaaaccataaaaatgaccatgcaagctgagactatgcaaagtcattttaataatcaaaggaaaatactgcacttgttttgcagtcctcaaaaaatgctgtcagattattaaaaactctcttactgttggttttaaatggataggaaggtgaaagaatagtatttatttagcatactgtacattaaaagagaaacattgagaattaaaggattttatttctttgtaaaaaccttaggagtagtttgaatagagcttgccttcttataagctttatgatatagagtgagcatattttctatgccttgttgaactgtcacacccttttctaagtttggatcagctttcaacattttacaacattttattctttgtgctttcaatgtcatgagatatccctgagagatgtgaagatgtgaatgtgaagtttcttgctggcgttaccccctctgggacatcgtcacctatatgtcacaatcaccttattcaccgatgtcattaagtcctccttcagcaagttcctctggttgcatgtctagaggctcttgaacagcaatattgacattcccacagtcagcaatttttttctgtaactccatttacaagttcaatttgcatttcacttctggtgtcatcacttttctttgctgcactttcatctctgttggccagtttcctctcttggtattccgtttttgcaaaatggcacatgatatcatcagaagacaaagaggcaacataattgcatgctttgctgtctgtttatactcattcaatattgccttataatttttcataattgctgcaaggaaaaaaggattataaagtgtgcccttttctgacattcttaaagtggactttggcttgaaagtcattatttttagtataagggctatgtttcttctcatggcaaaagaaaggaaactagttattgctccatttatgcagacttactctttgtttattgtccccttctctttcttgctctgaaaaatagtatatctgtatgaatcaagatacttttaaatgtatcattaattgagtctatggtagtcagttctttttatttgctgctatgtaatcaactgtttttgcctctggtagattcatattttcaggggcaagtgtacccattgtttttcctcttgctttctcttttatttttttaatttattttttaccaaatacccagacttcaaggacatccacttgctcttgacctcctttgcattttgttttatagatggtataagggactagccatattaacaaatatgtttttaaaagtgaaaacattaaagggtttagctcagccttatattttgcactgcatttcattcatagttgttctctttttcctagtgtgcccctaatattcataaaatggatggatattcatgtgatggtgttcaggtaggtcacttcatttttacctatgtttttcacatgtaccagcatgaaaggaatactgaaatcttatcaaaataggaagatcaatttaaatgtttgtaatcaattctgaagataaaaggcctctctactattcatctattatttttcccaatcatagtttctttttcagttatctgacataagcagatattgcatcgctaatgggtatttgcttttccgttttagggaatttgctttggaggaagatgcaaaaccagagatagacaatgcaaatacatttgggggcaaagtaagtaaatagtgtggcttgatcattgttaaagcatgatgtcaggcggacttctcaaggacgtgtgtgctggaagtaaatttttgactactttatgactgggggattctcaaagctaccacaggtcttagcaggggcatgtttctggaaattagagtaaggcacccctttgagaagcagccccacacatcttggctagttggcagtgcctgtggacgagacagaaagtgcctttgctgccaggcagatggagcccatgccagggtgcacagcttggagaatagagcaaacctggatttcagctccatgtatactcttctcagctgagtgccctgaagctaaagcttcacaaccatatgggatggacgtggaccctggacaggacgtccttaacttagaacagcagcattttatctagagtcatttttttcctccttggatatttttcttaaactctagttggctttcctagttacgcacttctgctaaagtggctttgctgtatcagaaagaaatgttaatgtttagcctttaaagtctgtcagattttcaaaggaaaatatatgatatttagatttaaattatactctatttaaatgtttatttaaatgttgagtaatgtattgtttcctagaagtactactagcccaaacttttggaagcagtttttgttttaaactgtttcaggagacaatttgtagtaggaaaaaggctataaaaataatgataattcttaatagttataagtaggtgccacaatccttttaggaggggaagtgtatgctctctttaagcaattggaaacattgggatgggaaaacatttagtcaggcaggtttgtactccgaaaaaagatatcatttttgttttatccacttgagcaaaaatagtagctgacaacaagaagtaggaaacataactaccgacataactattgttttttttaaaaatataccaacaattatcctttgattagtttgcattttgtcctaattcttagataactctatcaactgtccctggttttagaaaagataaaagcctgaaaaagatactgatgtaccttaaaatgttatttgacttccagagatttagcatgaattcaagcttgtcttaaagcaaagtaaaattgcttttgatagctgctaagaagtggggagcaaggtagaaattgtaccactgtttcttgaatctaattacaggatataactattataataaacttgtctttatgattaacaaaatatgctgaatgagaaattcatgtattatatttagcactgagattaaagaatagagtatatattcaaggaaatatttgttattgccttccctaattattggccaaattcttttgttgttgttgttgttgttgttgagatggagtcttgctttgttgccaggctggagtgcagtgatgtgatctcagctcactgcaccctctgcctcccgggttcaagcgatttccctgcctcagcctcccaagtagctgggactacaggtgcacaccaccacacccagctaattttttttgtattttagtagagacggggtttcaccatgttggccagggtggtctcgatctcctgacttcatgatctgcccgaattattggccaaattctaaggagtgtttgtttttgtagcctacagcctgagtcccaacagagaactaaatacatttgtttactaaatttcaaatgagctttaatgaaaacctatctgagtcatggatatatatgatccatggtaaaactgtgaaccgttcgttggtaacatttttggaattgataacactgtagtgatgaagagtccttatattacaatttttcttttctgcaaagcttttgagcagccaaatcgtacttccctcactgatagaaaatttttttctgccttagaggtgacagcatcagacaaatattgctatgagaaactgaatattgaagggacggagaagggtaactgtgggaaagacaaagacacatggatacagtgcaacaaacggtgaggtggagacgtcagcccagaattcatcccttggtcaattacaagtgtacttttttgagtgactaggaagtttctgctttctgcatcacacaaagtgtgctcttgcctccttaacctcatctcttcccagtgttccagcatcacctgtgcagagggcttccaaatcttgaacatgtgtgctcacctctctcctaaggcccaggtcatacttgcccccacctcaggattttcttacctagaagacaccttttagcatctcaaaggcaaaagaacttaaagccaccagaatatgcactgagtgctgttgaattgaattaactggctctaactttcccaaaccaccccctttttgccaaaggtctcaatatttcactgtccttctgtctagaagccttaaagtgatccttccctctacacattgtccaaatgctaaattacatccattcttccctttgctttgccaccatttgtctttaattcatgtattcacttacgttcctattaccattacctgaactaagacctatattaatccttcaactattacaaaattcttttaacagttttctgtgccagcattccctagtgtactactatcagaataatcttttgggtcttttttactgtcaattctttgttgaaagttcactggttccacatgactaattaatagtgagaacagtacccagcactgattgagtgaacactgtgtgctaagcactgtatcacactttacataagctatgccatttaatcttcatggcagtcctcccattttatggaggaggaaactgagacacagttaatttgtccgaagtcatgtatatgggatgtaataataagcagaattagaatttggagagtatgatttcagaactctctcttcaccattttgctgaatgtcatagtcttgttaacaaattaaatggaaccttagcttggcactgcacctattcaacaattgtccccaacctacactttttgtcatttcatttatattcttccaaatctagcaaaccttaccattccgaatatgtccctacctccatgcctacatttatgctctataatcctccagaagcaccctttaactcataccatcatcagccaaaaatatacctattcttcaaagcccagcttgggaaacactttctatatataaatttctttatgatttactctagaaataaattatctctctcttctttgaacttccacagccctttgtacttatttgtccgtaattttgttttataagttgtttatgtgtgtgatttatcttcttatttagagtataattttcttgtgaataaagatcatatctaattgtctttatatatcctgattacataggttcatatacataaatgacattcaaaaaagttttgaatgaatatctcttctctgttgagaaagcatttttgtttatgatagatacagtaaaatgataacataattttaaaaagcatttttaaagaataaagtaatacattcttttctatgttggtgaaaaatacaggttctaatttttcttttttctccatgtggtaaagtctgatacttttgtatataatcttgctgacttactaattactcttcacaagatattttaaaaatatgtttattgttatctctactaataattaaaatgtgttggatataaataatatgtaagatagtattaacaacagtaaagatattttataagttaagttagaatcatatgtaatagttggggaagtactgaaatatattgaagaaaggataatgagcctttgtagttggcagtctgtaaaataaatgcagcctataatttcttctttaattctagggcaacaggttgaaaaaaacatctgtattccaaaagaatgctcatccaaatatcattcaattaccaattaaaaaaaaaattgtctgggcacagcatctcatgcttataatcccagtgctttgggagggtgaggagggaggttgcttggggtcaggaattcaaggccagcctgggcaacatagtgagaccctgtctctgtgaaaaatttaaaagttagttgggtctggtagcatacacctgtagtcccagctacctgggaggctgaggcaggaggaccactggaatcaggagtttgaggctgcagtgagccatgattacaccactacactccaacttggacaacagagtaagaccctgactctaagaaaaaaaaaaaaaaaagaagaagaagaagaaatagattagtatatccagtattgtgttatgggaaaagagatttcaatataaaagaagccaatttgatggattctttaaatacttgaactaatggacagtaaagaaaaagctagaaaacaattgagattttggtacatcagtaagagtttcagtgaagacactttttagagcaggtggcacactaatttggacttattttatttcacttggcatatgagtagataatatacttgatgaaaaccaaatgctaaaatgagagaagattattctaactgtacatggtttgctatatatttgggaaaagaagtaattggtaatcttttgatacagggatgtgctttgtggttaccttttgtgtaccaatattggcaatatcccaaggcttggagaactcgatggtgaaatcacatctactttagttgtgcagcaaggaagaacattaaactgcaggtaattatctaaccattctgtaagaatctgagtcatcttatttctcaggaatgcagtttaggattccttccgttttcaattaatgtacatgttagtaggtcgaaatataatctagtctatagagacgattgagtaaatcctaacagagaagagataaaaagaagataaaaaatagttgaatgaagaatattgtgtgattactagagttaggtttagattggtcagtaaagtcttatagagtttggtttccaaacttacagaatttggaaaatgaatgaggacttctaggtaaatcagtgtattaaatatatgcatctacttttgctcccttatgaaatctcactaaaatgataccaaatggatctttttttagagttcatatatccacagggaggcatagaaagagagaagagataatagcaacaatattttgttatgtataaagcaaatggatgtgtggcacatgacttatcaaagctgagaaagctgaattcctaagtcagtaatgaggaaaactgagaatcaatccaagatatactcttacttccccacaggctcagaaattggcagcatcatctactttaggaagagggagggaaggagtggagggaaggggctgaaatacagaaaatagatgaaaggctgttaaaaaagcagttagatactcagattacttccccaactcagctaaacgggatttgccaccctcccatggaagattggagctttatactctatagagaataaacgaggaggtttctaagctggaggacagcaagcaatatttatataagggttgtagggaagtagtccaacctcagtggtaccgatttccagtcatctatttggtctcctaattcaaatatgagcagattatcagagatgtgaaaaaaagtctgtaacatgaaaaaaaaaagacaaaaacaatgagacaatgaaggggaaaaaaacaaaaccacttatcaatatttatgagagataagagacttctataatgaaacaagaaaatagggtgctgtttttttaaacagggaacattcagaaagaaaaaatttagtagttgaaattatcttccagaaagtagggtaaaaaggcaaagaaatggaacatagagaaaatcttacacattaggatagcaataacaacagaggaaacagcagggaggaaattttcaatgagtaactcaagagaattgtctagaaataaaggacttgagtttccatattaacaggctcaccaagtgctgaatacaatgagtggaattagaggtacatctaaacatatcattatgaaattttagaaccttagaacaaagcaaagaattctggaagtttccagagaggagaaaaaaatcaaagacttaagaattaaaatggtttaggatttggcaacaggagccctgggagtcagaagacaatagagaaaattatttccaaactagaattttgtactctggcaaaatatcaaacaagtgtgagggtagaaaataaagacatgtttagttatgctacaaatttctcaggaaagtactagaaattgcactccaccaaaacaaagtaaaccaagaaagagaaagacagggaatataggaaacaacataccacaaagagagaccgggcaatccccaagttgatagtgaggcgaaagtcaagatttacagcgctacgaaaccggcacatgtggacagtcagcacagacaacagcaggccagaaactccaggagaccttcataaataacaaaagaatgaattaagagtagaaaatggttttcttctaggatgagtatctggaagaatatctagagaggcagagaactgctttattgtgtttaaaaacaatttatctgttgattctttaaactatatgcatatgtaattttgataaaaataaatgaagtgaatggggattgaatgtaaatggcctaaataccccatttaaaaggcaccagagtgacaagttggagaaaaataagaccccaaggtgtgctgtcttcaagagagccatctcatatgcagtgacatctatagactcaaaatgaaaggatgtgggaaaatctagcaagcaaatggaaatcagaaaaaaagcagggttgcaatcctaatttcagacaaaacagactttaagccaacaaagatacagaaagacaaagaagggcattatgtaatggtagagggttcaattcaacaagaagagctaactaccctaaatatatatgcacccaacacaggagcacccagcttcatcaagcaagttcttagagacctacaaagagacttaaactccctcacaataacagtaggagacttcaacacttcactgatagtattagatagatcatcaaggcagaaaattaacaaagatattcaggacctgaagtcaatattggaccaaatggatctgatagacctctacagaactctccacccaaaaacaacacagtatatattcttctaatcatcacatggcccatactctaaaattgaccacacaattggacataaaacaatcctcagcaaatgctagctagagcactaaaatcataccaaacccactcttggaccacagcacaatacaaatagaaatcgagacttaaattttttttcaaaaccatgcaattatatggaaattaagcaacctggtcctgaaatgacttttaggtaaataatgaaattaaggcagaaatcaagaagttctttgaaactaatgagaaaaaagatacaaaatacaagaatctctgggacacagctaaggcagtgttaagagggcaatttatagccctaaatgccctcatcaaaaagttagaaagctctcaaattaacaatctaacatcacaactaaaagaactagagaagcaagaacaaaccaaccccaaagctagcagaagacaagaaataaccaaaatcagagctgacctgaaagagactgagacatgaaaagccaggtaaaatatcaacaaatctaggagtttattttttggaaaaattaataagataggtcactagatagactaataaagaagaaaagagagaagatccaaattaatacatcagaaacgacaaaggggatgttacgactcaccccacagaaatacaaacaatcatcagagactactacgaacacctgtggcacacaaactagaaaatctagaagagatggataaatgcctggacatgtgtatacgtttccaagactgaatcaggaagaaattgatttcctgaacagaccaataacaagctccaaaattgaaccagtaataaatagcctaccaaccaaaaaaaaggccaggaccagatagactcacagctgaattctaccagatgtacgaagaagagctggcaccattcctactgaaactattcaaaaaaattgaggaggagtgactcctccctatttcattctatgaggccagtatcatcctcatacaaaaacatggcagagactctacaaaaaaagaaaatttcagcccattatccttgatgaacattgattcaaaaatcctcaacaaaatacttgcaaaccaaattgagtagcacatcaaaaatcatatccaccataatcaggtaggctttgttcccgggttccaagtttggttcaacatacgcaaattagtaaatgtgatttttcacataaacagaactaaagacaaaaaccacatgattatctcaatagatgcaaaaaagggttttgataaaatccaacatcctttcatgttaaaaactctcaataaactacgtattaaaggaacatacctcaaaataagagccatctatgacaaacccacagccaacatcatactgaataggcaaaagctggaagcattctccttgaaaacttacacaggacaaagatgtcctctctcaccactcctattcaacatagtattggaagtcctggccagagcaattaggcaagagtgaaaaataagggaaatccaaataagaagagaggaagtcaaactattgctctttgctgatgacgtgattctatatctagaaaaccccatagtctcgacctaaaagctctttcagctgataaacaacttcagcaaagttttaggatacaaaatcagcatacaaaaatcactagcattctcatgcaccaacaatagccaagctgagggtcaaatcaggaatgcaattccattcacaattgccataaaaataataaagtacccaggaatacagctagtcagggaggtaaaaaatctctgcaatgggaattacaaaacactgctcaaagaaatcagagatgccacaaacaaaaggaaaaacattccgtggttgtgaatcagaagaataaatattattcaaatggccatactgccaaagcaatttacagattaaatgctattgctatcaaactatcgatgacattcttcacagaactagaaaaagctcttaaaattcacagggaactaaaaagctggaggtatcacgttgctcaacttcaaactatagtacagggctacagtaaccaaaacagcatggtactggtacaaaaacagatacatagaccaatggaacagaatagagagcccagaaataaagtcgcacacctgcaaccatctgatcttcgatgaagctgacaaaaacaagtaatggggtactgggtatatacccaaaggattataaatcatgctgctataaagacacatgcccacgtatgtttattgcggcactattcacaacagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactaccacaaggacaaaaaccaaacaccgtgtgttctcactcataggtgggaattgaacaatgagaacacttggacacaggaaggggagcatcacacaccggggcctgtcatggggcagggggaagggggagagatagcattaggagatatacctaatgtaaatgacgagttactgggtgcagcacaccagcatggtgcatatatatatgtaacaaacctgcacgttgtgcacatgtaccctagaacttaaagtataagaataataataataaaaaaccaacccccccacccaaaaaaaatcacttcatttctaattctcaaataaattcaacatatttggaaaaaaaaaaaaaacaagtaatggggaaaggactccctattcaataaatggtgctgggataactggctagccatatgcagaagattgaaactggacccctttcttacaccatatacaaaaataaactcaagatagattgaagacttaaatataaaactcaaaagtataaaaaccctggaagacaacttaggcaatactgttttggacataagaatagtcaaagatttcattatgaagacaccagaagcaatcataacaagcaaaaattgacaaatggaatctaattaaactaaagtgcttctgcacagcaaaagtaactatcaacagagtaaacagacaacctacagaatgggaaaattcttttgtaaactatacatttgacaaaggtctaatatccagcatctatgaggaacttaaatttacaagaaaaaacaaccccattaaaaagtgggcaaaggacatgaacagacacttttcaaaagaagacatccatttggtcaaagagcatgtgaaaaaagatcgatatcactgatcattagagaaattcaaataaaaaccaccataagataccatctcacaccagtcagaatgattattattaaaacgtcaaaaaataacatgctggcaaggtcgcagacaaaggggaacatttacacacctttggtgggagtgtaaattagtttaaccattgtggaaggcagtgtggcgattcttcaaagacctaaaaacaaatactattcgacccagcaatcctattactgggtataaacccaaaggaatataaatcattctaccataaagacacaggcacacgtatgttcattgcagcactgttcacagtctcaaagacatggaatcaacctaaatgcccatcagtggcagactggataaagaaaatgtgtaatacacacacacacacacacacacacacacacacacacacacacacacacacaccatggaatactatgcagccataaaaaagaacaagatcatgtccttcacagggacatggatggagctggaggccgtcatccttagtaaactaacacaggaacagaaaaccaaataccacatgttctcacttataagtgggagctaaatgatgagaacacatggacacaaagaagggagcaacagacactgggacctatttgagggatgtgatgaggaggagggagtggatgagaaaaaataactattgagtactaggcttagtagctggatgatgaaatattctgcacgacaaaccctcatgacatgagtttacctatattacaatcctgcacatgtacccctgaacataaaataaaagtttaaaaaatggtgacttttatagtagcattgacatggccccatatgaataaattgtgaatatatattttcaatgcttaccgaggttttaaaaaacatttctaaataatatatgcaggtttgctatattgaatagtgatatacaatagtttagtcattctcaaatgtaattggtacatatgcaatctttttgggtcagccaacttatcaaattacatactagtaataatgccttacttaccttttgcttggtagcccaggtgaaatgataaacctgtttcaattcaggccccagttatagtaattacattcaaatcctaaactttatcaatttctccaaaaggaattagatcaaaagattcaatagctttctctgagattgaactggcttatgctactggtctttaataagtaataaatagaatagaggaagcaatattgcctgcttttaagtttttgagcatattttcaaaatgaaggtgaattaatagattcattttttgctctcaatttgtttttagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtaagtatccagtaccttgtcagaatctatttcttttatatcacagaaatagacaggaccctaaactatttatttttcttaattatggaaaaaaatgatttttcatatttctagttggtatataaatactaattcaattatagttatttgaatatttctgttgtataatctgagaaagcctggggataaggaaatgaataatctttctaaccaaattctcccatccttcttttctgtgttactatgatctcatataatataatgccaactttttacaagtgaactaggagataaattttaacaaactataatgggattttaagaaagagaataaaaattggatgtgatggccacagtatttaaaaacgatgtggtctgggcactgacaaatctcaacagacttgtcagattgtacacactgctgtagccacaccagcgtgtacaagctgaggataagtcctagaaataaaaacaataacttagggaaatgtttcttacagatgagtagaaaaaaacggcatttgaaagacttttaattctattctttaagttatatattctttcagttatatatcagataatgtgtatcctgtacaggtaagtttacaggttaaatattcatcctctactagggataaagttttgtcagtttcaattaggaattcctataccatcaaaaaagagtttgttctatttctttcagcatgtgctatggcattctttttatttttgttccagattctttgcttgaactgttgtattatccagttaagataaaggatccctgttttggaattgtaagccttcattcctggtctttccatgcttgtcctcagggatattccaagaatttatttagggaagtaactaattgttacttcttgccaaagcataggaattctcatggcatataagagtagagcagacatgtactaagtagctctgctcctatgaaggagtcttccaagtcttcttttcttaatctaagaggatgttaggggataagaggaaaagaataatggaatttttcttgatcatccatgctaatgaataagcatgtcttatccatcttaagattctgaaacaaaacacaagagaccaaacatagttgtgcttggtaaacatttgtttaattaattagtaaaagaataatcaatgcaaataaatcagatggcaaatcaacatccagataatttacaataattatgcataatataattatgtattcacaataattatgcataattatatttggggtaattttaacttacagcaactctatatttgtgtcaaaaaattaatataagaaaaattaatacaagtaaatattatttttgtactatatatcatgtagttaggagtgtgggcttgcaatcatatagcctgggtttgaatcccaactctgctttttattagctgggtaacattgggcaaatttcttcgcctttgtgactcaatttcttcctctgtaaaatggagataataatagtgcccactttaaagaattgtgcgaagaaggagttaacttgtaaaacacttaaaacaagactgggatatggcaagtgttcaataaatgtaagctatgctatttattatgattactgtatactgggcatcattgtctgttcttgtcactatatcgctgatacctgacatatgatatagcaactgatgcttgaagaagccaggcgacctgattaaggtcccttagtaagacaggagtgatatggtgaatcaaatccaggccttttgattttaagcctaaacctttttcgttctgcctatttgttaatctgtagctctgattgaggctgtgttatagttacatttagatgtggatgtatgttatgttcctgaaaattagatcagacaagacagaaacccctgtagtaaaaacctgtctcaggaggaactttgctcatcttcaacctaacttaactctctcctgcttctctattcaaggttgttttgaattagatttaggtgtatattctgtttcctgagtggactaatgaagagagattattttcctataatataaaaaaaaatggtgtcaattttatatgaatcttttttctatactcaattcgtgggagttcttagttcccctgaccctgacatagctagtatctacagcatgggttgaagtgctaaggttgtatagccttgtggaactttcttctcagcccactgcaaaacatcaggtctcccctcttcatcagacttttatttcattttgcttcctaaaaaatgaataacatttttgcatgaagacccttactatggaaggaaggaaacctttgtattagataattgacagatgattatatttctgcttagctttttaaatcttccttataaaatttaagttagtgaaagtcaaaacaataatttctttgattttttttttagatgtagatcaatttctctgttaaaattcatcgttccctttgggtcagttgttggtctctaggaaacatttgcttgaggtactggagggagaaataatgtaattagtattaagaagaacatactaataattttttggaattaccacattctaagcatataataataagaaattagtgtttatttttcatgcttctgtaccagagagttgacatttactctagcttgattttggatctcaggtttgcagtaatgagctgaagtgtgtgtgtaacagacactggataggttctgattgcaacacttacttccctcacaatgatgatgcaaagactggtatcactctgtctggcaatggtaagtacttaatttggtaacattatgtagtctttatacacaaagagaaagctgctctctgaaaacttttatttgagttatttttatgataatcagaaatacattctcataataatgaattatacaactggggtccattttatgaaactgattatgtccattaaattgtaatgatatgtaatattacgtataacttagtctatttgatttagccttatcttgtcctacttcattctgagatttttctgaggctgtcaattaaccctaacatttctttcaaatgtggaagtagtcataactcttaattgtgtgcatttagaggaataattttatatttttgaactgaataaagaagaaacaattaaagaattggttttaaaatattttaatattctttattatagaatctcattgttgttcaaccccagttctgtagcctgaactggctacagttagtaatcctggccaaggttcctggtggggctttaagaacatggataagaaataacaggtgcagtcctaaaagctagggtggcccaaatgggggtatagaaatcaaatgcagacagttgaaagaacttatacattggaggcaaatgtccccctttaaaatatttcatcatttcattattgagtattcttttatacaagataatgctcaaatcctaaagttcagtcactttcaaaggatgagaaaaaaggaatatgttcattctaatagtccagaaagggtaaacagttttagctaatatgacttttataaagaaaatcataggatgattaagattttagagtccctagtcttagcagtggtagtgtggagcttgttccagtaattaattcaaagacaataatatttagatagatggatttaaatgacgtgtcaaaagccataccattacttagaaataaacaagactaacatctaagtttattgatccctgttaagtccctggaaaaaaaggaagggggggcagacatgctaggtcttgaagtaagaaaattctagtgacccaaggaatcctctggcatttgcatctgtgcatcccacagaggacctggcaggttggagtccactagtctgctcagatgacctagccctgctgtctgacatgaattctgagggctcccagacagagagactgccactactatcatggagaattgaaatcttctcaagtagcccatgactcctgacctctgatgtataaaaggatgcctcaggagtggagcaggcaaagatggatctaagctactctggatgaaagctctgcagttaaccatgtggcacaaatcattatcagcaaaacaggccttctggtgtcagagccaggcctcattcagatcagccttttctgcctttgagccctcatttgagcttattgaccaagcctttgactcatggtgccattctgctgtgatgatccccttaaagattatatctcagcctgcctgacaatggatactggcacaacaatgccatcactgtgttctgagcttcaatcccgccctggattctgcctgcctgtctctctgccagtgtggtgctgcctctcctgccacatcagctccaatcctccagctcactcaactctttttcctctggggtttccttctctagaatgccacagccatcattgcccagacggggaattacaagcccagtgtttctatcacctacatcacctgggcagtaatcacagaagtctgtggacatgttttctcccttaagaagcttgtattcactttgagagagacaaaatataacacacacaaaaccgagagcagtaaggaccttgcgttagttgtcaaaatggagtgatatgcacaataacatttctagaatttctgagaaagaggtaaggatcaaaaggaacacagattttctacaagttcctccctaagtttcattactcttccctcttttagtttaatgacatcatggtttctggaaaatacaactgtgcaaaatgcacttggacaagaattaaaaaggacatttgccaaaaattatttttaaaacaactgatatggattgctgaattatggttgattttttctttcctttgaaaaatactcatttttgaaaacaaacagtgttgttagtgtgatgattacaaaactgaacaataaagtttctgaaaggattttataccactgatcttccttctttcttttttttcctctcaggtgttgctggcaccaatatcataataggcataattgctggcaccattttagtgctggccctcatattaggaataactgcgtggggttataagtaagtgaaatgtctcagtcttgttactattgaaatatacttctaaacattttgattacatgaaaacatctagaaagttttgtatcattggttgaatatacttgcaatgaaaatcagcttggctcagcagccagtcaatgcttattcttggcatggcgagaagtgataataacatcattttttagattttgagacaacttccttctattgtaaaagaactgagtattatttaaaaatccttgaagtgaattgaaaccagtctaaatttgtaaaaactggtaagttgtaacttttgaagagaatttaataaccttaaacattttgctcagtaaaggccttcaaacattgtaaacttatttatctatctaatgtgttcaattttcttttcatgatttatataatctgaaaagaaaccagagtattcaatttcctttttaagtgctttaatcttatgatgtgaaaaatttctttgtattcaaataactaatttaagtttaataagttaaaatgtaaatatagtaaaccttaaattttctttaatatttcaacttaaaatcatattctgctgatccttgatgatgatgttccagtccacaggcctggggtttttctccatttggaaggcctgcagcttgtgctaggcattctgggcattacctcatttcatagcacatttttcctcatggatcaaacttaggtaactcaaagttttgggaattagaatcaaaattttagacatttaccccatgccttttaatggacttgcctttgttccataagttaatatatgtcaaacactcaaagtagtacctggcccacagtaagcactatgtaattgtttgctattattatcacttaacatggtcttaaaccaattgcaccaaaggaaacatctttatagtgtacatggtaattgcttgtgaggtcaaaaccatcaaagagtttctttggctaaaaagggagagcagttagtttactggcaggataagctttgtatgctgcaagcattaataatacaggcatttgtggaagactatatattaatgagtagcgcagagagcatattacagtttggcaaaacattacagtttgacatggcatgtcatagtgaaggagagtacagcacagtagtaagcttttccctgattaaatgagcatctagccctgtaccatgtagtcttccacaaattcttgtatcattaatgcttgtagcatacaaaacttatcctggcagtaaactaattgctctcccttttcagctaaataaactctttcataattttgacctcacaagcaattgccatatatacttacaaaagtgttacctttggcgcagttggcttaagaccatgttaggtgataataataagttcatagcagatgcttaaaacctatgggcctctttggtgtgcaggttactgggtgtatttcacctcagcataacatttggagttatcaaatcatatatctgataggaaggcttctctttttgtcatttgatttctcctcacaccagaagcaaattagctctgtgttggaatcacaccatttctccaaattaatgcatgatttaagtagtaattgtcatcacaagcattattgtgttgaagtagctcagttgtttcatttggctgtgtgaaaatggaaagaaaaaattgttccttctggagtgtgtgattttctgccacctagtgatggaagtggatatttcatttttacaatcttggaaaaacctaccttttagaaacctaaacgctcatattacttattaaattatgtgtctatttgcctttattgattagaatgaaaatcactttttttctgcaggtgacttcttatttttatggcattcttttgagatctgttcattcctcaatatatacactttgcaactttaataagatccacttagctggaaactcatttaagttgattttagcttaaggaaaaagacacaccttgtgcatactacagtatcttctttataaataactagcccaaatagctaaagttttaatgtttctaaaattattcagaatatgtttaggaatatagtgggaatgtagatattttaatagaggaattaaattcatgaatatgatgttttacttattctatttgcaatttaaaaccccatttagaacctgagaactcattttctcattagtttgtccagttaaactttctaccccttctccaagccttggggtggagaatagcaggaattaaaaaaaaaaataaagtagaatgctcatttggaaccgtatggctcaggaaatcagattgaaggaataaaaagcaaaacatgttgaatagaaaaataccaggcttatttttcccccatctgatagtttccaggatgaaaaataataacaaattggcacctttgccgtcatgtgcccgttatcaaacgtgatatgtataatgtggatgaaatagactggcaagtaaagatgttaccaatgaaatccatatgaaaacattatccttgatcttagaggaagcagcccaaaactactcacttgcatgacctttctaacgtgtctccaaaatattaacacttaattatgtcaagatagaaagttagcagtgaactcttgaaaagtcactggtactgtactaccacaccctgtagagcaattttttaataagatccacttagttggaaactcatttaagtcgattttagcttatggttaaataaacacagagactaaacattgaacaagtatttccaatgtgaagcttcagcgagtaagtagtaatcacttaggagatccttaacagtcacgaattgactcactcctatttatcatacctgatgaaataaaatgttctggtattcatttatattcccctatttgaaattcttaggaataactatagtttggggtttatattccattaggaatgaattataattttatttctgtaaaaagttatttatataagtaacttgattcattaatttcattaagtcaatgtatgtttgaagacctgtgtttgaaataagatttactttagagcagtgattgatgttgagaaaacaattactctttaatgactgcagcatatttatgtttttaaaagtggacaattgtttgacaatattgtcactgactctttgttgcttctcctgatgatgaggtgacatttttgtgtgtgcattcccattttaattctgtaattcagaatcctctagtgaagacttttcaatgaaagctagagcttttatgtttagagctccctcttgatgtccttccagaggtaactaactcttatgtttttccctctttctcttcttgtccatgaaaagaaactatcgagaacagaggtatgtaatacaaataatgtgaacataaaactgaaaggtttgactcatattagcattgttggaattcatacatgcaattataattaagttcactttgtttttatgtataataatcatacactaatcgatttttcattatcttgaggtaattttaatgatggtgctgtgaaatatagcaatttaaaatagatctgtcatttaattttaatggatcttttatccaacgatactacaattagtggagtcttgcttattttttaatagtaatatatatagaaattgattttttccatctaaaacaaacttcctctatgttaaggtgtcccatttgtttacattaatattagcttttcttcatgtttgtaacactcttattgcctaatactttctgagggaatttatttattactgtttttatattaataatatccattcataagtgacaaagtttatttgggcagtgttgctgttgggaatgttctagcatttcgtgagcctgtttatctctgcataaggaattttttgtattgattaggtaactgcacatttaaagaaagaatttgcatagttggaataataaaaatgcctatattcttgagaaagtcagacaccctgtatagcataaccgtaaaaatctatgtttaaccaacagcttaaaagagatacaaaatgttcatgttgttctataacaattgcctattttatctgaatctaaattagcacataatattggaatgcactcttcacttttcccacttaaaaagttactagtgctgttagctattgataaaaaatattaaaatattatcctggaaactgataacctagaccaggtcttacacatgataatggtatttagttctatactcatggtatttatgcagattcctatttacttaaccttttccattgttgagttgcatgcttgtgacaggttatgaataaggtgtataaatgtggtaatttgtcatgctccatcacaactttcatttttttcacaaatcaaaaatttaaactttactcttttttaaataaattaaaattcccataaggctttaaccataggtatctgtagaatctgtataaatatatagtgcccatgggttaccatttgaaatcctggtcagtttgtgtagacaacagaaaatattgacctttccctagagtgactaactcatcattaatggaaaaagtaaaactgggacaaaattacaatttaagaacaaccagatttcttcatgatgtgttttaaactcttgtgtccaaaagcgcttgcttagagcaggagccgccgtttagactttctgttgggtagaggttgattgatcgtattagaaatctaagtttggtgagtttctttagtggaaaatagaattaggcaaataagattaaaaagttaatgattcagcttcatttccacaggaactaaggctataatgtaatttaatattgctgaatatatgaaaatgaaagtgaaatgtctcataggcaacataagcaaagctagcacagtgctctaagatgtgttctcattagggattctatccagaataagggaattgcccacactttaaaaaaatgattaatattgaaaagtatgcacaaatttcttgttctaactcaatatgtagagagatatcgttaagaacattttcacatgaagaatctcctttatgtgcctgatataatttcatgtctcctggtgttactgagtcatcatttcattgatctggctactcttttggaatctagtccatcatattttgagagttgtcacatcttcagtggatatttattttatatattttgatatatgtcaacacaaccttttttttgtccttgcccataactaatgaatattaggtttgtacagtaggtctcaaagtggagaaatggcaaagaatagactttagatcaggaagttgtgaatgtataagtgttttctaaatgagtttcctttttgagaatatatgttagtgattatagacaaagtggtaaggccaacagaccaaagcatgcattaaaaaatattcaatcttataaaaatatctatagacattcaagtaaagatcttcccaattccaaaatataccaggaagtaaaattaaggattttgagttgttattgattttaaatgaggtttttctttgaggttccatggtagggagaccagtccacaaggaatcagaaatctactagtatgtggtattggaaaatcaaactttcctcaactctgaaatcaagtaaggttctttgtaatctgtaaagcattatggtgacgggaagttattagcatgtggtcttggaagactgtatttctctgatctttgaatgaaagaggtgaatgcagttgttctcaaagaggaaggcagcattcattgacatgagtgaggctcacacatactggttgaggtggtggaaatgtcggtgaatgtaaacttttgctttgacactaaatgcaagacctaataagtataatagcctgttatcagattcttaatactgttgtaatggctcagaagtaccaaaatgggcataactttccaattcctggagaggacaggcaagtagttctgtgagtgaatttgataaccagataaattttctcttctgagaatgagtcctcaaggttttcagtatagagaaggattatattctatgttttcttgcaagtttgacaaacagatgtgaagcagacccacgttttttttctttttgttcacaaactttgtaatagaaagaaaccggaagctccattctgggtcatagtgaaggcagaactccacatatgtgcagcatcactttaaatctgccagtgtcttataatgggcagaattgtggaacaaaggagccatagccttagacattaggtaattagaatgatggttatatttatcctttcatttaaaatattcaggaaggaaaacttccccaattttttcagttgatattattgtttatattatagcacaattgctttaggtcttagaagctatatgacttgtaatgagaattataagtggattttagtttttagggtaagtttgcaaatagcaatagaataagaaacagtaactgaacttagatacataaaacattcatatttagctgaaatcttattctcttcctttgtctgagatgaacacacaccattatgattgatgagaaatataaaaaataattagattatatctttttgatttatggtttcactttaagcagaatgccctccccttccccatttcttttctctctcacctgttttagccactttattttctacttgtgaacttctcatcttttttccaaacctttcttagtttgtttttatattattattattatttcggtgatattcctgcatctgtcaatgttacttggtacacattatacagtatttcttaaaacagtaaagtagcaatttaataagagacagcccagatgccaaccaagcattggagaaatgcctccttcagcactaaagttaagagttggttaaatggttttttcctccaacattttaagtatgcataagaattattaagataaatataattcaattgatgcttttaggaaagattagacttctctcataacaggaccattagcctaaaggttttggggtgatcaagaaacagtcttacttgatgtttaaatttagaatgctaacataacaactagatgatttataattatgaacacattaagagttgtcttctgaagtggaataagaataagcaagcaataagcatagtattgtagacctggagagaaataattgtataaattagctcccccagagtcattaagttacaggggttgatccttacctagagaataggaaataccttcaaaagaatgttatttaatgggatgtatcgattcaaaacacaaaatgaaatgccaaagttgtacagagaagaaaaagacaacatgtaattaatgtggggagagatacgttttgagggggaaaaaaactagttacataagtgtttattatattttggctattgttcactaaaaatcatacatgtctaaaatatttgcatgtaatatgagaaatttgaggtaattttcccattataaaatttagcactaatcaggccacctactgtggtgatcacttttagtttccaaaatttgatgaaataagaaagcactcaagatttaggaagaaagccgtaaagataataaaggactggaaaaagaagtttgatttaaaattttaaaaggatcatttacttagtcatttatgacaacaaatgatgaaaagttattttatttaccatgggggcttgatattctctgttaaagcaagaagaattagctttgttatgatatgtaattaataattgtaaaaaagacaaatttctaaatgaaggatgttaaacattattattagtagtagtattgttattattatttttttgagatggagtttcgctctgtcacccaagctggagtgcagtggcgcgatctcggctcactgcaacctccgcctcccaggttcaagcgattctcctgcctcagcctcctgagtagctggcattacaagtgcgtgccaccacacctggctaatttttttgtatttttagtagagatggggtttcaccatgttggtcaggctggtctcgaattcctgacctcgtgatccgcccacctcagccttccagaaacattattcttaagagatctttaacgaaattcataacctatcactgacatttaccatgtgaagaaagttacatgcattccttatggaattttagggaaaagccagtgaatttccatcttttggagactttgcagtgtgatagataagaatctaatctgctcaacctaatgaaaacaaggtggtgctccagaagtacattgaactgaaactgactgaaacccacagtttatgatgtatttagcatttagggtgtttgggcactgtgtaaaaaatgaccatggacttcagagaagttacattgaagggataataaaacgtgttcagttaaaaacacaaaacaaaactgggccccatccattgtgaaacatagtccatctacatcctcagtgtcagctaagtgaggccttacttaatgtttaaatttaaatgttaaagagaaggcgatttgtgggatagaatactgggaatggtcaagtgtagttcagtgctcttgtataatagcttgtctttattttttacttattttatttattttatttattttttgagacagagtcttgctctgttgcccaggctggagtgcaatggtgcgatctcggctcactgcaacctctgcctcccaagttcaagcacttcttgtgcctcagccacctgagtagctgggattacaggtgtgtgccaccacacccagctaatttttgtatttattgtagagatggagttttaccatgttggccaggctagtctccaactcccaacctcaagtgatctgcccgcttcggcctcccatagtgctgggattacaggcgtgagccaccacgcccagcctggtctttaattgacttgaatttggtgaggcacatctcatcagtttataaagattatcagtaaagatagtagtgataaatgggatttgttaaccatagatattattattggaaatgtgttcatgggattcttttacaaatattaatgtaatacaaaagggaagttttctccccaaggcaaaaactagaactctgattttattgacagcattttttttcaagcactaatggaatattttactgatacaaggtaaaatagaaaatattaataaagatctcttacaggggaagatatagctggtgtcatgtaacaatataaatgtgaagtttcatattattatcctataaaattaatgttttatatactggggaaaagaaagaataactattatgagctgaagtcatttacagaattaaaaatattttggaggaatcatatcaaaaagttataggtggaattaatcctacattactaatttcatgagaaattctactttctttagtaaacataaaagagagtagattaaatcacacaagttaaaatatgtgcttcatactaactgaaaaatctttcagattcacagacgtgtgtaactaaatagcattaaaataatatgagagtattcaatcattcaacagaatgaatgaccaagtattttaaacatttacaacaatatggcaaaaatttaagcaagcaaacacctgaaaatggcattttggggggattaaattcagcatcagcaaataatcaaaattataatggtaaataaggagaaaccaaataagaaaaagaaaagttagcaaatttgtgcttttgctagagatttaattaagcatagctttgttaaaaattctcagtccagcactagtttgtggcacctccaacaatagtactgaatagaaaagaatcaagttttaggtgcagttggctatttggaggctacactactgacaaatgaccagattagctattgcaggaaggttaactgggggccttatctaaaattttctatctgattacattaggagaagtaataaaaatctgttccaatcttaatttattgaaaatcagatgacttgggtcaataacagtgcagattaaatacattttcacttgggcactcctactacagtagagagagagaactaaggtcacccaccaactacctataaatatacttctatagtttcagcaaaaattcagttatttttttcaaccttttcttgctcttgttaaattatcttccttcacatgttccactgaacagttataaaattacctttttgatttaactttgaatctttccatttcttcgtatttctgttaaatgaataatgaagctctaaattgaacatcaaactctaatagtgatttatttggatgaaattctagaatagtttaaaagtcaatcagttcttttcagaccaaatccaggttgcattatgtgatgtttagaaattataaatagtttattcaccacaaagaaaaagaaagctatgcttaatctgggtagggactatctgtcctaacacaccttcgacatattttttttttaaaaaaagacaaaaatgcacttaacattttcaagtataatgaagttaccatgaaaacactcatattttcatatttttccccaaagcaaggctttattcatccaaatgataaaagacttttgtaattgcatttctggcctctacagttagaatgactttaacttgtctcatttattgataattttatgtgttgtgatagatttgattcatgtagatcattatccctacctctcttttttcctgaaataatatttgtatatgtctgtgttcatgtgtgtgtcttgttttctgactctgaaatgtttattatgccttagacagttaccccagggagattatgtaaaaaagcctggagatggtgactctttttatagcgacattcctcccggagtcagcacaaactcagcatctagttctaagaagaggtctgcttttctgtcgcattttcagatttctacctgttccatcacacattattccattagtcagaacatttcattattttgcagcaggtttgattacttcttccttctttcttgaatgttaaaaaatagtatcctttgttctttgattactctacttcaaaatgccatatgctcagaaccactcattatacaaatcaggccacaaaatcaaaacaaagcaaaccaaacaataactctgaatctatatagaaacctcagggtttttcagtcttgctttatatggcttaagaaactatacatagtatttaataatatttaaatggtgagctttatgtcatgtttggtagtcaaagaaaaaggttactgtcatgcttcaataaaagcaactgttaaataaattggtgatataagtgctgcattgagtattttttaattttatatatatcaaagctaagctcgctatgaaacaaagattgcttctctgtgaatcatatatttgagtattgtgattttgccttttttggggggtgattatttctagactttataagttacaacttagttgacaaattaagtgtgcttaattttgcctgagttttataatagtacaggtgggattaatatattatttatgtcttagacactgatgctatattcttattctagcatcttaaggtgtatgacaccatttaaaattctgcatgctttgtaactgcttaataaaataaatgaaaagaagaaataaatagttggcatgttttaggaaatgagacctatgttcacattgaaggaagcaaaaatattcttgtgggagaatttatttatttaaagttgccaataagagtataatggacaggaaaaaaggtttggtagccctgctcatgcctttgggcacattagctacttttcagagtgaaggggaagatgctagtttattggaggaaacatgacctgttccggagttctgtatagagtggatcatctgtaaatattctgcaatgtctctcagtctttgtaaatgttaatcaggaaggagaatagaaggaattagtgagacctgggaactctactttatgtggaactttcttaagcatgaaggataattttcacttagataatgtagcttccagcaaaagtagaaacactagttgtcgccaaaggagtatgtttctacagaataatgttttaaaaaatgtattcttttaatttatggagggcttgttggctaagagaagactagggttctacttgaattctctgatacaaatattttcttgatagaatattaaattttaaattaaacaacatggtaaattagtggagaaattaatggtttccagcagaatttctgttgttcttttgtacaaaatatgagtcattctgtgagtagcaaatgatgttgagaaattccaacctagggaattcatatggagtagttgtgctgagttccatttattttcactgatcagtagaaggctttttttgaaatagaaattatttctattattattccattaaccagattccattaaccaatattccattaaattattccattaaccagaataatatgtggaaaagatttttaagtatagtgctattttctaaagttcctataaaagagtttaaaatatccatttgaataattcccagattttagaaaaatctcagtgggttatgattcttaagcagttaaaagttcttaagatttctctgaagtatatgtagcttgttaaaattcttgtgtggtacaaggtaggtgtgtaaattttgcttcttttagatcattcatttaaagatggtaggacacaaatagcaggtgggctcaatggtacatgggctttgtgagaggcactgtcatgataaacatctgattcagttcagttattgaacagttagccaacatgtactacacttttttggaccatatttgtggagaaaaatgccaattcttagaaaataattttattacttaagaaaatctaaataatgctttgataaatgttaaccaggttcacttgagcaaatctttatgtaatctcttggaagtccatgttctcataatatttgagtggaaaccattgctttacaattaagaaacatctatggtgggaccccattataactctgctgctggggtgatgctgaaatacatagtgaatttgctctgtggttgctgtgttctggggaatgtaaattggcttgcattgtgtcttgatacttttcatttatatactattgtaatggggttccattgtatttgacttttcttaaattggatgttgtgtaattctgccttcttcatgaagactttcatgttctcttcattctttcatttcagattttttctttcttgatttattttatttaatgcacagtaatgcttagaagttttgcttactgatctcaaaacattcatttggttacatttttgaacaatttatcaatattttcaatttcaggtcaaatgggctctctcattcttggagtgaaaggattccagacacaaaacatatttcagacatctgtgaaaatgggcgacctcgaagtaactcttggcaaggtagaggctggcattctgaatctgtctgtccacataatcaagttctatattctgtggcccctggttgtaaagacttttatttctttgaagctctttagctcttctcccaacagagaggagaatatgtagaatgagagcctagtttttatctggatgggaaatgatgggattcggcagcaccaggacactagacactttgtgaaatttaatttgagaaagctgtacagtgtgacaaacccggtgttccacagtggtgctgcttatcaattatacccacttgaaatgcctcgtaattagacatagggcaatcacttatttacatggaaatctagctctaaaccgtctttttcaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgtaaaccatgtctccggtcttggttttgtcttttaaattcttttttgccctttaaaaattaaccatggcttttctctcttacataggcatctccacaactgttcccataccaatattcattgatagtgggggtctcacctgcaggctttttcctccagtcacctgccattgtggggtcttggttctatatgaagggaatttgataacattcctttcttctcatcatctgggattcaaccatttcaaagggtcacccttcctctccccaatactcacacagccttgtaagcatcggggaaaaattcccattgtactagagcatgatactgctcatgatctaaaaccaccactatgaggtcttcatggctgcaatctaagcattctctcagactaatggaataagtttcccttttaaattttctatctgagaacatttaaaagggcattttcctaaacttgctctttaactgaatcattgtcactaaatgcaacattatccgttttaaatgatagccatgcatttactttttttttaaggggggtgggtttagaagtcacatttaaagtcatttataatgaagtaaataatgtatttgttttgtttgtttctccacttaagaaagtacaagcaaaacaaaacctcctcaaatctttatctcccttcatggaataaaacacatccttagtatccttttggactgaacttgccacctgactttttttacccattctattttatccttcctaaaattttttacttatttctcactctagcgatagttattatttccaggatctctattgcttcttcatgccttaatatttggaaagtctgaatagcaggtatttgttaactgcttgtcaaaaacttatgttagcttttccgtcatataccctgcctttttcagtccaggaataataacattgccctgaaatttggaccttccacctgaatggtattgtcttgtaagtggcttgtcaacatggatactttatagacacagtagacaatttcaagtgataccattgcatggtccagaatggcatcatagaattccatcataaataactaatgtgttagagtttatcttatatattcccaaagcgcttggatgctttagggctcattgttgataaactcttcttggaatgttgtttggtttgttttgcatgaggtcacctagtaagagctccttaacttattttagttgctcacaggtgtacagataaaattgcaaaatgttctttagaacttccttgtttactgtttagtgttctaacagcatttcctataacaagacttcaaaaactcctaagttaaaaaaaaaatcagtattatgttaaagctatgagcttaggacctaacgcacatttggtgtttaacaatattcatacagtgttttctagagcagttacttatttttttaaatgttgtgtataatttccactcacattgtatgattaaaattgtaatactacagatggcctttgagaaatcttgcctatgagataattaaattataatatttaatatgacattataataggatcatctttatgagggagaagtattaaggacttcctcagatttttcagacttttctgattttggttacatgactcatgttaattaaatggatccaagtctgtaaagctgaccataattctcacataccttcttgtataggaactgtctctctatatatacacatgtatatatacatatatatatatatatttatacatacacacacacgtatatattttcttacaaggattcctgataggtagcatatcaagaattatgtttgcaaacttttaatactttccatatttaagtaatcccatttgcttctgatagtataataccatttgtgtgactacaagaggagcagaattaccacagacaaatatatcttttatttttttcatataagaggtgtttcaggtccattactcaaaattccctttagtacctcattattccaaaagatgatgaaaaattgggacatgaattaaaacatgcaccataaaggcatgctctgctaattaacaaaataaaatgtcctcatatattgtattgtttttccagtcaaaacttttgcatcttcctcattgttgtacatgatgtaaaaacattttttggcttagactttgtattatatattgtgtttttacaggagggagccccaagcacctgagcctgggcactccctcgcccagacagtcccatcccaaggcataagcccagggggctctgacagcccccagacagggagtctggatcacaggtcagtctccacctgccccttcattctgggctgccacttaatctccttacaagtcctttccttggctgagaacagggtcatttgatctttgagcgagccctcatgtttgccagaggtgctcctggtccagccagcaccagctaattttcctttgcctttccatcctggaaaacacaaagagctcccctatcccatctaacgccatttttttttgcatgtcgcgctatatgccaagtcaagccacataggtagatttactgcaatatgataaaatcccatcactccagccaccatgaccttgagatatcaggaagctcaccatgaagacattttcatgggcagatccccagaaagaacaaaaaattgggagttgttttcagtgaagaactctctggtgaagtgaccacagccttctgaaatgctccctcaaacagaggaaaaagtccatcaagtgcaagtcaagccatgttgttgtagcattcatggaatagctgtggcaccagtactttgagtttctaagattgtcagtgaaaggaacaaatgtctcctcccggaagtggccgtctgcctgtgggtgactcacttcgctgtgtggctatgtttcacctgattatagctgcatgggctttttctacggttttccccaggccggagcattcactagccttcatttgtggctgcacttggctttttgactttttctttttgttgagagtctcagtggaaatctttatgcaagttttaattggctatctgtgaaagcacaagttggcaatgattatggctaaaggcaaaactagtgtgagttgtttctgagtcaggagatactatcttaccaaaaatggtcttataagcagaaaaagcaactgaacccttctttcagaagggaatttcacaatgttattttgtatagtacctcgattatggctaaaaatgagggaaagggctgtggaaaaaataacctgatatttttatataattggaaatgtagtcttccatgtttatgacgagctcaataactaaatatgggagaaagaaggaaaatgtaaccagaaataaataatgtattttataatttcccctggtttgtttacaaataacttacgttttatagagcttgaatctttattgtctatagtagccctagaagttgctttttaaatgaaaaaaaaatgaaaagtaaaacttccaaattcttccagtatggaatttgttaaatctacattattttacaagggcaaactctgaaggggatgtatttttgcttggctcccagggtaaaaatcaaaggaaactctggggaaaaccaacaactgaagacctccctccaatttttttacctttaaaatttgcacagtaattctgatggaaacattgccagatccatcagggaaatgctaactaaggtcattattattctctggcagtcattcacacaattcatggtcagacacttggaaggcaacctctgagggttggttcctaatggaaacatgagcactttattctggagtgcacaaagaagaggaaggaacactgcagctgcaactaaattactaaacccagcttcaagatcatggaggcctatttagaccacacaatgtgcattgaggctccaggatcagaagagtgggaccctatctgctccttgcagagccaactggaacatactttcatgttgactccagcttgagaccctctatagagagtaagacagtggtcacgtaaaagccttcttatattggaaagagaactttgttccttttaattgttcttagggtgttgtatgcccaaatgccagattggaattgcagccatctgagtattttcaaaaagcatcattatcatttaaaaaccaaagagccaaatgagaggtggcctggaaaaagccactttagaggtgggtgaatgggactgctgactgtactgtgattgaaagggagcttctaattcactttgggaagccactggaaaaggctttcccagaaatgttgaatatattgtagaatgccttgattgagccttgttgtagctgagattattctcatgtcattgtatagactgcctcataatcacccaacatccattctggtttatttgccatggtcacttgcatttggagggtgaagacatccttgctaagcttgtgctgtgtattttcagattttctatcttgttctgctttctttgttccttccattgctttctgcaggtatttaaacccatggttcaaaagagactataatgtagctaagtgggtagaagatgtgaataaaaacactgaaggaccatactttaggtattttataaattaatttttatatccttctcaaactctcccagcacatacaaatactgtagtgtgactggctctctatcttgtatctcccaatacaagttcctataggtggaaaggggtccttgtttatttgctgccttttgactctgtttttgcttcgtgagcaagtctggttcttttctgaatgtttcaaataaagccatttgaaagggttgtcatttagtgcatgtccctatcaccatcttaagctttttagtagctttctcttcattttatgctatgtagtgttctatgggcatgaaacatactttccactaataaagaagcactattaacctgaacaatttagtttctagaatctagcagtttcataatgcatttttcctacttactgcctaagagtgcatagtgcatacaaaaactcacggaaaaacgtataaagaaactaagtgaaatgtgatgggattttacttggagtagaaacaatgatttggtctaactggaaaattactgagacaacattgaccacatgggagtatgtggaatgagtttaggttttatttgttcagtataaccatttcctaccagagaaaggctgtgctgagaagtgttatacagattctcaacaaagcatgtaagaaattttttatgcttataaaaatgttgttatctaatacttcaaatagaacaggaagcagctgaaaatatattcttgactcacaaaatagaagaatatcgctacattttagaaactatcaaatttactcagttcactgcagctctgtgtaacattacaggtcagaaagaatttccaagagttcgtaatggcattttttacccttatataatatcaaagtgattttctagaggtaaatgtccactttatatctgactactttgtggacaactaaggtaaaggagaaatatgtactcaattactacctcttctgaacacaattttacaataaactttcatgttactgattgccatgacttgggtcaacattgaacagatatcaaaatatgtatgtgtttttaactctcagcacccgtataaggtggactctctcttccagtgtaccatttagtttagttatgcatagtttgagaaaatgattagacctacctgccttttaatttgatccataacatttgcatataccccaaggaaagcgtaactcctgcctgctcacaaaaatatatcctgcttttataccccatctttccctcctgccctgtccctctgcttgtcccacactttcccacactgaacctcatacacatacactcacattcaaacatcccaccctcatctgtagctcccaagatggccaacatcaggaagacaggtaagatgattttgactgttatttggaatcttggctcacctgcagtcctatttctcctttctgttttcctcaggcttgtgggcagattgtaatttgtaccagccatggaaccaaaacagaatgactttcatcctatatgggttagggcttttattcccaaatggatttagcatttttgcagcaataatttgtgaaatggtaccccggaagagttgattcacctcccctgggtgagctgagtagtttatgtggctctcagagaaagaggtcacgtttcttaaaatcagcacccaggtctgcccagaagctgcatgactaaatgcaatttggatggggaaatgcttcagcacccctgattgcacgtgcaaaactgcaaggacaattttagagggttcctttgttttctcttctaatatgagatgttggttcctacagtagatagtgaaattaagaattaattgttaaaatcatatttatgtttaaaggttagacaaagttctgtggacagttataatttaattgacattttttagttaataagggtgataagatttgaaattcaatacagaatttctgtggtggtggtaaataattgagatggcccagaacgtttaacacagtgattctaatgcaagggagaatttcatccaccctctgtgcaagccaagcctcacataggagacccaaagtgcatccacaccttggcttgtgccttgccaaccctatgcttaggctcagatctgcttcatctgtggccaggtcattcaggattacccttcctgtcaaaaccaccactgagggcaaaggtcaccttattgttttttgtagagacgggatctcaccatgttgctcaagctggtctcaaactcctgggctcaagcaatccacctgcctcagcctcccagagtgctgggattacacccctgtggtgttggctttgcggcatccttatcaaaatgcaatctgcagcaaactggttcaaaatatagtccagcatttaaaatatagtggccacactgctagagagagcaaggcaaatgcctaaatagatatcaagtgatcagagtgcctctgctgtgcccccttatccagtttcgatatgatggtggttgctcaggttgtcctctgcatgaattcaggccaccaggaaggagcaagtgagatcaggacaagagcattatctcgccacacccagatcctggatgcagttctgttataagctctcagaaggtagccttactctcgggtattatcccattgattactcacttcatcagggttttcgagtccacttccatgattctatggaatttttggtgactctgaaaagaaacgaataattacaactatcatgtatccagtgcctatgatatacctttattcctcacatcctagagtgtaagcattcttattacctttctgtagatggaggaaactgaggtagaaagagtaattcaaggtggcacagctagtaagtgtcagaaccagaactagagcctgactctgaatccaaaatctgtaccttttccatttcaccttaattaaaagtagcagagtggatactgatgacttgaatcctctcttagtacacttaacaaattctcctggatctaggccaggcgcagtggctcacgcctgtaatcccagcactttgggaggccaaggtgggcagatcatgaggtcaggagattaagaccatcctggccaacatggtgaaaccccatctctactaaaaatacaaaaattagctgggtatggtggtgtgcgcttgtaatcccagctacttgggaggctgaggcgggagaatcgcttgaacctgggaggcggaggttgtagtgagccgagatcacaccactgtactccagcctggcgacagagtgagactctgtctcaaaaaaataaataaaaataaaataacaaattctcctggatcaacctactataaaactcacatatgaacacaagtgaataagaggtggacttgtgtccctctccatgtgactggcctggtttttagcctgtccttgggtgcagaactgaactgaggttggccttacaggcatatatacagaaggtaatcccaggaagtttgatgtagccccaagaggcaccacaatccattggcacacaaacatacctttattgtgtaattctaatagggtatccattatggtaattatagtttttaaaaatacagtaatgggctgggtggggtgcctcatgcctataattccagcactttgggaggccgagatgggtggatcatttgaggtcaggagtttgagaccagcctggccatcatggtgagaccctgtctctcctgaaaatagaaaaattagccgggggtggtggcgcattcctatagtcccagctactcgggaggctgaggcaggagaatcgcttgaacccaggaggcagaggctgtggtgagctgagatcacaccaaatgcacttcagactgggtgacagagtgagactccatctcaaaaaataaaataaaataaaatgcagtaataataatggttgacttgtatccaatgatgcacttcactttttaagtgaatgagctgggctggtgcctggctttaagtgaaagccaggctggaactgccgggcaagtagtcaataaaggtcagaaaagagcctggagatcgttttgaagaaacgttttccttagacatttgtgagaaattttgagtttattttccctaaagtgttttaccgtaccgtggtctctactcctattttgactcctgctctggtgctctccatcttcccaaaataatcacttttatgctgtcacataccacccagcctccaggaccctttcccctgctaaaaccttcctgctgggcttctcttcccctcagggtccaagatgtcaattaacaagagtgttattattctttacttctattttgactcctgctctggtgctctcatccccccaagataatcaattttataccagcctccaggaccctttcccctgctaaaactttcctgctcagcttctcttcttcccctcaaggtccaaggtgtcaattaactagtgtaactagcgtgttattttaagaagtagtatatgtgcaatttctttggggttctggagaaaatctcctgtttttgttctaacttaattggctttgcccatagaaagatatttgaggggaagactggaccttcagcacccctcattggaatggctttgtccatgtatcaggctggccatttggacccatggccaagttaaagctggaatgactgtgaagctaaaagctaatagctaatggtgtggacacacatgctgcagcagattaaaaagatgccttgttttgcatgatcccctaaagtaaacaagatttaattatttgtttgtgtaccttactagctttcctaaagttggatattttatcagtagtgattaggctaaaaagctgacgccaggttaatagtcctcattttagaaagatgcatttaaatatctaaatgcagaagtttgccattatcttacatgtaccaaatttgtttcttaaagatcatagtcctatttaaagtgtttttctaaaataaaataatttcttaattaaaaaaatatgaagtacattgctttaatagaactttagagaatttgaagtactagtattagttacacccatccgctcggcaatgaagagcattaacataggagaaatcaaacagctgctgtgttctaaatgttcatgcaaaggagtggtcctagccatttttcaaaaataggagttacagattaaaagtgaattgtaccattcttcattcttaaaatctatcaagaatgttcactactactatcttagggtgtgtgggaaaaattattttcaaactttagcttgaattcagtgtccataaaatggaaattagtatgaaaactatggcagaaccagagcaaaggatattatacgcatgcaaaccaaaatttaaaacaaggaaggaaaaaagacacctttatgctattgaatgcagtgtaggcagtagatcttgacctacctagtgctacccccgcccctcccactaacattcccaggctggatcagtcacagcagatgaggtacattctactgaaataaacacttttgctataaggtggcagtgtaaccagttcaatgtgggtttttaccaccttgcaccatggattaaggagcagtggatgtgtagtggtaacgtttgtgaatggaatagctactacagttatcacatctgtttttcattgatatcttatgagcagacattttttactcagctgttttcttttttcactttaaagacaaattagcaatagataggggcttgtctagtatgttcagcttagtcacaaattaccactacacatgcaaaatcaatcaagtacagcataatacagcagcagcttacatagaaatgctgattgtagggactaattagaccatttttgtatgttctcatcagactttgtttggctggaactctgcactccttactgcttgcatgtttactaatttattaaaagccctgtatttgcctttgttccttcacaactaacacactggcctctgaatgcatgagtgttgtgtaaactggtgtgtgatttagcaactaataaatatatcagttgtaatggattttaagatcttaagagaaaattggaattatcgtacttaaacatttttacattaagtggttaaaaataaggcacaatattaatattttatacacataatttaccattataagctcttagaataatttcatcccttctgcattttagctttttatctattctataggatacatttttagtggcttgtagttgaaaagtatcattctatgttctaacatttaaataatccattgcagtcatgaaattaggaagataaaattgcagcatttcactgttgagaatgacagaatatcttcccagtagttaaatctttgcagtagtggtatatgaaagttagaagtcagagggtttgttctgaacacacttttcagatatttgaaaaatgttaggcaatcacatgatacttaattcatgttctcaacatctcaggactttatctcctgccaagtctccttcttcatcaactgggtctattgcctccagcagaaaatacccttacccaatgcctccacttcctgatgaggacaagaaagtgaaccgacaaagtgccagggtatgtggaaacctcttccatgtgcgtacatgctcagtcattatcatttatctatgagtttatattttaaaagagagaaccatttttcctcccttgttcctaagaaaatgaaaaaatcaaacttgaaaataaggagattcttgagacttttggcttcagatttatatttgcaaatagtttaatctgcattgatacagtctaggtacattttgtgtaattaattgctatatatttaattattgtagctaatttattaaaacctacagtaaacaaaacagtgtattttgctatatcaccttttacattttaatcacactgccactgtctcacaacattcctgaaacatatcagtatgtgaaattcgagatacagtggagcttagagaggcagactggtcctcagagacttaagtgaaagatgtaaccaaagaataattacctttattgatgtccaggctctgttgtggtcatttacactgtaatgttcatcttcttagaaataatgttgcaaaaaaataaaataaagcttataagcctcggcagctttagctgctggttagactctttggtcttcagagatgtttcggaatctctttgatcccaaacctaaattatgtgattcaaggtaaacgtggatcattcaaattttaattttaactcagagtcagtaagaaggcacaaataattaaaagctgtgtagatcactataatccaaaagtctttaaaaactaccagcagtgttttgttaatcataaaaaattaccattatatgttaatatgagaaatggtaaaagataacaagacaattcagattcccagcactcagctttctgaattaacaaaagacttcttgatagatacctagttgttcatgatgtcatgtgtgataatgaaatctgagactgaggtcattcctgccctcctcaaataattgtctaagtgtagcaacccactttctgctaaattgtctgcatccctgttttgttccatcaagttagggacattccctcagctgttgtcatgtcagagtttgggttattggagatgttaccacacaagagcctgtaaaaatgatagctccctagaaaaaatgactggccctgggctgagcaggtgaccacaaaggctctggctgctgggattgttacctgaaaagtctgatttgttctatgcactgtggaacagccacataagcatgtggcagaatcctaccaaatacacagcccctgtctctgggctgtctctgtgggctgtggagagtggaacaagcagatcttcctatcagcagcccctctgttaccaccacatagacgtgggccaaggcatgcctagtgctgaaagtgatgtttggcaattgctcattttttctcactggagtaatcatgacattcaggtttttcccaatgttgttcatttgtccctcccttctttctcctgtcacatattatttttaatctttataaaacaatattgaggaaacttcagctctctgaggccagagtctaatccctttagccctccagaccattatctgagcatcagttcagatcgtctttgctccagacccaccacaagccccatttaactcctctccaccaccagtgtcacccattcacgaagatcctcacagttcagatattcctgtggtttacaaggggttggtgtcttttcaataaaaagggcatataaaatgacctaaggtagatagcatggtggctttaccacagtcctgtggagtaggcagacatgggcattcagaacaagatttccatgaagatttgggagaacatattaagggaacctatatagaaacatctacttactcacttggctttttctcctttttctttcccagaaactcattatatatacagcgacatgcaccaaatgtccagtaaaaatggaatttggatggaattggatacaacctaagtcactgtgttcataggctttatttgtttatgtttataataattatatctaaattctattgcctggaaacatatttcatcagcttgatcttctttttaaattggtcttccttttctggtgaactgagttgcattcatatctgatcatgtcacacttgttattagtccattaaggtgattgctgaacattgtagaaatttgaccggaacagggccaatataaagagctcatggcaaaagcaaggagagggtaagagggacagaatgaatgaagggacatcctgccttgaatgtatccttccactgtgatacctcagcttgtgagagagaaccttttatttattttattttattttattttatttgagatggagtctcgctcagtcgcccaggctatagtgcaatgtcgcgatctcggctcactgcaagctccgcctcccgggttcacgccattctcctgcctcagcctcccgagtagctgggactacaggtgcccgccaccacgcccggctaattttttttgtatttttagtaaagacggggtttcaccgtgttatgcaggatggtctcgatctcctgacctcgtgatctgcccatctcggcctcccaaagtgctgggattacaggcgtgagccaccacgcccggctgagagaactattttttaaggaggtagtgatagaagtggagtgtatggcagtgattttcaagtgggtgatggtggaattgatggaatcacacttccctgatgtcagtggttttctgtcgtggctgcacaagggaatcatctgcaaagcttttaaaatattcttacgcctgagtcccacccagagagattttgatttagttggtctggtgtggtgcctgggaagtggaattgtagaaacctccccagattaatgtaatgtgcagctgaggttgagaaccactgctctagctggctgtctcagaatcctggggaaaggaagggcatgtgtagcttaaaaaataatattttaaattcttttatttcatttgagacacaatattgactctattcaaaatgtttagtaacattaaatgaggatgtgatggtttttgtatcaaaagatggctgctgttaaaaaggttgagacacaggttttgaggaaacagagagctaaaagttggagtgtttattctatccactttttagactttgcaagagtgtgcatccacaatcacatatatatggatggaatcactgaatctttttcatctcctattcagaatacatctgcttcctgctttcacaatgtgcaattttgctcttttctgttgtgcagctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctgtgaaatgaatgacttgttttaacaaaaacaactttgacactgttgattaagaatatttgtcatcactgggatgtgaatcccaacaagtcattctgcactgactctgaagcaagatgacggaagattctactgtttgagttgagcagcttcaaccattcataaagggttaagttagatctaaaccacagagatgcagcatctgcgaagttacactaacagctggtgggggaaagaatctgatgctttgaaacatatatttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggta

SEQ ID NO: 13188 - DNA, 266748 bp, Human; identical to SEQ ID NO: 13187

SEQ ID NO: 13189 - DNA, 17907 bp, Human
tgcagccataaaaaatgatgagttcatgtcctttgtagggacatggatgaaattggaaatcatcattctcagtaaactatcgcaagaccaaaaaaccaaacaccgcatattctcactcataggtgggaactgaacgatgagatcacatggacacaggaaggggaatatcacactctggggactgtggtggggtggggggaggggagagggatagcattgggagatatacctaatgctagatgacgagttagtgggtgcagcgcaccagcatggcacatgtatacatatgtaaccaacctgcacaatgttcacatgtaccctaaaacttaaagtgtaattaaaaaaaaaattcaattctttagcagtaaagcagtgggaagatgtctaaggacaactgatatgccaattcgtatagccgtttatccacgaagctaattctgcagtacttaaaaatattttatatgctttatacttctttcaaacttgagtcttgagcttgtactcaacatcgagttcggccctgacatctactctttatagtcggttacctctttctgaagaaacaggcttccaaagagagaccaggggactcattagatgtctcatctaccttgatgattgctaccttgatgattgaaaacagtaacctgcttcctgaatcaaacacaaaacaggcaacatgcagtgtctttgctatgccacaacagggactattagaatttttctcacaattcggactttggttttcaaaagggcttgcgagggaagttacacacaagagaaaaacaatgaaccgaatgaggacaatagcccacgaatttagaatggaggaagcccgtccaccacagcgaaaaagcacagtaccacattggcgggtgctccaatatttgtgaaatgttgatgaccctttaaatgtttctgtgcaacctccacaacaaatactgtgaatcttgcttattaatgcgtttctcaatacgttaaaattcaggaaatcattaagtctagtccttaacagtgaagggcaagcaattttctgtcattgaaattacacaaaacaaaacaaaaagctcacgcctgaattgcttcggactattcaactgggagatagaaaaatatatgaagtaaagaagaataacctacatagaagttcctatctcttatcttcctgaatacttaccagtacactattagtttgttctaaacttttcttatataaaaagtagctgaatacttttagggaaatggattgttttgtctgaatcatccagataattcaaacaattcattttcctaagaacgatatgtgtgagtctgtcctgcccggaaaatgccctctgtcctacttaggacacaagtcacgctcagcttaaacaggcaaggaattgtcccctaggaaggaaatacgccgttgtcgttcagtgaactctgcaaccaacagcaagccaaactctcccttgcacacagttcgtcaagttaattcttattttccaagggcgctttcgtatttccatctttcaaagactccttcacccactggcacctaaggcttgccctaacgcatccagcccctgcctcgcgatggtgcgctccgcttataatagctccgtcctgtccaataaagttgtttaaaataagaaatgtgccagataatagccaagtccgaaggaaaaaaaaaaaaaaagaattcctggggtggtgtattggtgttggaatgtgccattagttttggagggaggaaagtccctggtgtgaattgcctcgcaggtcgtaggccaccactggaccttcagtcgtgcactgcattagcgccgtaatggcaaagatacgaagaagcgcgcaggcaggggagccacggccgcgcgcacaggcaagagctggagacgactgcggagcgcgtcccccacgcccgcgtggtgcgctctggggcggccccctagcggcagggcggggcggggcagggggcggagaggcctggcgcacagggcgagggcggctgcggcgcagtctgcagcatggcgtacccggggcatcctggcgccggcggcgggtactacccaggcggggtaagtgctgactgcgcgggatcgcggcccaggcggctccggggcgctaagaggccaccttggagatgctgcggccagcggggtgaggcgctgctgggcggctacccgggctccttccgccctcggcttctccctgcgctcgcggcctcgccctaggcccctggggttcggcctctccccacgtttccccgtcccttctcctggatggccctgcggggccaaggtgagggtggattgggaccctagaagcccaccctgcggcttctcggatacgcggcgtgaaatcgtgttaattgggtgttggctgacccccaccccaccccacccccgccttcttggttgcctcccagagcaacaacagtcattttattctagaatgatataccttcctccctttaaaaaacaaacaaacaaacaaacaaacaaacaaaaaaaaaacgagtgagaagggggacggaaaaaaagggaaaacctgctgaagtaaaagacctgtaggaaggcagcctcgccgggcgtctgggatgcgcgttgtcttgggaactgtttccgagacaggcaatgttccctcgccacccacgagatacagcccggccggacaccttactcttccctaggctacacccgtctcagaatgttaccaactccagccttccatcgttcataaaacgctcttaaaataccataaatgctgtaacaacaaaaggagaatttgaagccctgccattcgttggcttacctagtttgcactcacctcagtaaccttcaggttaatagggattttaaaagttgctttacatatgtagacatcactttcacagcaactctttatggtctaagtcgccagtttttaaattacggggtgtgaatggaagagaggggtggagtgttggcagagtgtgcccggtggtggggaggtgagccttgtgaagggcgggcaggcgggcagttgtctggccttgcacaaaagccctcagtggtgaaagaagaaaacttgattcggcagaatgacgtgtatgtgtttcctgtttcacagtatggaggggctcccggagggcctgcgtttcccggacaaactcaggatccgctgtatggttactttgctgctgtagctggacaggttagcttttccctttaatattaaagagccgttattgtctgcatttgtggtagcttttgatatagtgacacagaaaagcgaacttcctgtggtactgagtccctttgcttctgcaaaagaaaaaaaaagttgtttcttattttagttttttatttctgaatgttcagaataaatgaggacaaagtgttactcgtatttatgtgagttcagttcgaaagcaaacttgtggttgaattaaagggtccaggatggtttcaagcgaaaaaattcaagatctggtaaatataaacgcttgtttgtacaacttaaagacatatattagtaattacatagctcgattctaatgggcactttctttgggttgaacttgattgctaatcattcacccccttaggaaatatggtaaaaacccaccagcttctaaataaggaagttactgttcccttcttagtatcagaaagttaatcttgtgaacagtgtagtttctctttgatgcagatgctgttactaggtcagcccctccatgtccttattaggtgttctggcctgttgacccagagaagcaattaaggtcagctccccaagacctttcacttgtctgcattctgagttgtatgacaggtgctatcttacattgacaggtgctatcttacattgagagaggacacttccctagttcatgaggtcactgtgtgcagtaaatatactgttggtataacccagacacgtccagaggagatgtttgttcttatgaattcaacctagttttgttttgaccaaaagctagaaatagcaaaatcttaatgtgaaaactgtagaatattatgggataaaaaacctaagaccacttttaaggtagtactctaagaaatacagcttaagaaattgaatggaaaatatagtctaaaactggaagaccttccccttaagtatctacttaaactgttaatgatctgtatctttgaaaccacaaggcatggcaaacctcaagactagcattcttagattgccagtgcctccagcatgtaagtgactccacctgcttagctttcagcagccctggcctgtattcagcatacccattgtctttcaaattgctgatcttgctcctcatttataacttataatacccagtgacttgaagatttaggtattttattttaaagtccctaaaaatcacatatatctagttctttcccagttcagccagtgaatgggcactgggaacctaatgtgaatcttccagatgtatttgtgctctgaaaaaaatgattcactatatcataagaaaaagtgaccaaggaggcctttttctgtttgaaccaagccttctatttattgatgtctgctttgtaccttgctctctccacccccatcaaaaaaaaatattttaaaatgtttagctgtagcagtttgctagctcagattgagagaagagtagttgccaagacagactctttctttcatcattaaattacttttggaagtgggttaaggaaaagaatgcccacttttggaaggcattccttttaataaaaaaaaggcattccttttaaataaaaaaaagatactgattttctttgttgttattgcttcattgaatgctgaaggtaaacaacttgaaagtacaaatcactattatgattcctctaattttttttcaaaaggatgggcagatagatgctgatgaattgcagagatgtctgacacagtctggcattgctggaggatacaaacgtaagttgacagtcccaaagtttgtctaaatatactcttgtgtttcctatcttagctgttacttgtgattacagccttcaagaaaactgagcttgtcggatctagcaaagtttagaattccgaaagctaaaatacagtactatttcaaaatgttgatttgaaaacagtttttaaatcactccaggctgggcacagtggctcacacctgtaatcccagtacttcagaggcccaggcaggaggatcgcttgaagccaagagtttttggctgcagtaatctatgattgtaccactgcactccagcctgagcaacagagcaagaccttgtctttaaaataataataataataaattattccatcctacctgccaatctagtggatttctcagatttgggttttgtgtacctagaaccagtgagacagtttgggtggcctccttcacagaggacaaggtagggtgctgaaatggaatctgccaggtcaggggtcattaactgacattaggaactgatatttactgttatttgccaagagcctactctgccctgacctggtggcacttagggctttgagttgctgccctgcacccctggtccctgagtggcctatcctgcactcctggtctctgagctttgggcatgctcctgctaacataagtggttgccatgacatccctcaggtctttcctcttccacttcatagaatgtattcaggctaagtgggaagtggcctttctacttactggacctgctgctccataattcagcccttaccctacccctgccttttgaacactctgccatgagctgagagtaatgaaatactgcaaagatgctccatccctggcagggcacagtggctcacacctgtaatcccagcactttaggagactgaggtgggaggattgcttgagcccgggagttcaagactagcctgggcaacatagtgaaaccttgtctctgcaaaaaatttaaaaattagccaggcatggtggcatgcacctgtggtcccagctactcaggaggctgaggtgggaggattatacaagcccaggaggcggaggttgcagtgagccaagattgtgccactgcactccagcctgggtgacagcctgtctcagaaaatccaaaaaattgctgcatcccaactgggggcttctcatcatccaacacatatgaagtggttcctcttgaaattagatcttgaacatgatagatttccagggtagagaataatgtcttagttcaaatacattaccaacttctttgccagttgttaattgagacaaaacatcaaactgaagacccaatttcatggttagctgtggattaaaatgttcaaactagaattcacagctgtgaatttatagtggcctttttttaaaaactatttgacatggcatgtattagatggctgtctttgaactctttgcatttgttttcattatcctttgttttatgtgactttagtatcctattactcttaactaattagaggaattaatacaaacgaagaacctttcaagttcctgttatttaatctagtcctaaacaaaataagcactttttggattaggggatgttattctttactgtgtaggcagtacatttaaattgttaattgttacgcaattgagctggtaaacaaggtaggcctgcctattagcagggtttatcaaagtgcagtgagatcacagcatggcctgttattctacatcctttcagtagatgaggtgtggcagattttagaatctgactaacaaaatgggttgtatattgttagagagcagtccttttaaaatttcattgagaaagccacatttagtgatggccttagatcaatgcattaaagagaaagcatttcctgaatcatggggcctatgtgattgaatccatttgcctactctctggtggccgtactgaaccacagaaccatcctgcctatgaggtgtcagtgttttgtaatgcagatattatatggccattagtcttttaaacccaacttccaaaccaaaaagcacaggtccgaattggatgagcaggtgggatactccagctcagagcctatgggcccttcttaaccagtttaaaaggaagcagtcatacctagaggtggagttggtgagagaagttgtgttccagtcagtaagattgtaattcagcttctcttttttccctgaatttagttgttcgtctgtgataaggttgagagaaacagctggaggtagggctttccttctaggtccattatattgtatgtttctgtgagaagaaaagatgtttgaggcattctagtagaatgaacagaagagaagaaaaagagtaaaggtaaattacagcagagattctttggaaattattaaaattaacattatttaatttaaataatttcaaaatgttgaattaataattttaattataatttatagttataattatatgtagttacatttacgtaactaatatataatacttataattttaattaattttaaataattatttaaaatagaattaacactaataaaagctatattattaacaaaattgagaaagagttttccttaccaaaacttattggacatcagcgttctagttcattggaactgtctagaatggtgtattttttgttcattcacttttgttcactgccatctcactgccctttcagatccttctcacaaaagatgaccagattcctgatcttcctgatctgtccctctcctcctcagtctttactaacagcttagaaggaattcaaggtcctctgtaatgcaccctcccctgaccaaacatattttctcccactccttttgtactctttgaaagtcatattgagctattcacttacgctttgcctgtcctaggccttctacttctctctttgcttatgctggtccttagctgtcaccaaatgcccccatcattcttgtcattcaaggcttggcttaaattctttgtcttctataaagtctttcttgattctcttactgggaaggagcttctcacttctcaatcccttctggtactttctggcccctccattataattcagcactctaccatgattagggttatatgtgtatgtgacttatcttttccttagactgtcagctaggacggtatgcagtttcacaactgtatctgcaaagttcctgttaccctgagccctgaacataataagtacttaacagtggctgttgagttaatgaatatggaaaattttctgtgtcagaaaaattatagccctgtagccttattggctttttgatttaagattatacattaatttttgagcattagtaaagatcagaaaattttattcaaaaaacattccttcttagacgatctaagagggttgtacatataaagtgcagggctctacagcttcctgcgtgggggtgagaatttggtgccatccatccataccagtgcatttttagtgaatacttcctatgagctaggtgctggctctgtagccacaatcaatgcctgggtgttgggaaaagcactgggataagagagaggctgtggaatcacatagaatgggcacataacccagacaggagtcaggaaagttttccttgcagaattgatacctaagctgagcagaaatgaggccgaccatgaagtgagtgggatggggaagttgtgtcctaggttgttagaacagcatgtgcagaagacccagaaatagcgtggttcagtcaagaaattgagaaattctccatgaagatagtgtacggggttgaacaagagtaagagatgagcctgacttgcaaaataagtgtgttaccttatgtaccagttaaggtgcttggactttatcctgagagcagtagatcactgatactgggttttgcataggagagcacatactacccctgactgtaaagactaataaattgggggacatggaagtaaaacaagagtcagggatgcccattagggagctgctggagtcatacaggtgagagaaatgctaactaaggagacagtggggctggaaatggactctacagctgtttagaaggtgattgattattggtggagagggaattgaggaggctcccaggtttctggcttgggttactgctgagtggatgggggtgccattcattaacagagacagagaagctgtctgcctcatagccccttcaataccttcatgtgagcccaacacagttggctctgcgctgtggttgtcaggccgtccagagcagttcttaaactttagcagcattggcatcacctggaaagcttacaaaaaccagattgctgggtcatgccctagagtttctcattcagaggtctggagtgagtcctgagaatttcacctctaacaggtttccatgtgatgctggttcaggttgaaccagcttctttaacatgaatatctatcacctgcacatctgctaaaattcagcttctgattttattggtgtagggtaagggctgagattctgcagttcttcaagctcctgggtgatgctaatatggctggtccaggaatcacactttgagtagaatggtggtctcaaccttggctgctcactagaatcatctgaaaagctttttaaaaatacaaatacctgggtcccacactcagagttcctgatttaattgttctatggtgcagcccaggtatcagaatcttttaaagctttgattcagataagcacaagtgtggagaactacagctccagattagagggacttcatacctccacacaacttaaaagtcagaatgaagaatctaccagctctttcccaaactgtaaaaagtgcttcctcctcctctcacctcagagaatattatctgtggatcaaatggagattgaaggaccaaaatagaaatagtcactagtcttttatttccagtaaagcatatgccaaacacaggaatctattaaatgtgtaaaacctatagtttgcactgttgggagacattacagtaatgagcgcagttgtgttttaatttcagtttggtttgagaaaaaatatgaagctacaaagagctgttaaaaatgttctgtgtgttaacaagcttgcagaatttataccagcttttcccacgtgacccttgtcacttctgccatttagcgttgtagcttctttgtacctatacaatttcttcagtcattgattcccattaattcaatgtaagaggtggtttttaatttcctaatgcttaggttaccagtaaccacacccattgcatgtgctctggtttggttacataagtgaggtaccaaaatgccctcataatactcctaaactgtaggtaaattaaaaaggcttctgaatagtggccaccactgaattggtcatggggtcttatctagagtactcttatttaacacataattctaacaaccatatttatctggtttcatatataagctaagaggtcatagactatttgaggtaggaggttactgctcagtacctgacattgaagggaaaatagaaaaacaagtaatcagacacaaaattagcaaaaccagcaatttatagtcatttatgagtaggaacaaagcaaccctgacttcccacccaccatgttggatataatacattatggttcgttatggtgacttgaactcgctatattacagtttcaaagcaagaaagtatgaacagtactatgtaatacttttttttttttgagatggagtcttgccctgtcacccaggctggagtgcagtggcatgatctcagctcactgtaaccgcctcctcccaggtgcaagcaattctcctgcctcaaccttctgagtagctgagattacaggtgtgtgccaccaggcctggctaatttttatatttttagtagagacgagtttttgccatgttggccaggctggtctcaaactcctgacctcaggtgatccgcctgtctcggcaccccccaaagtgctgggattacaggcgtgagccaccatacccggactatgtaatactttttaaaaggaattctgtcaaagttatttaaatcaaatttgggttcctagcaaaaaatcttctttatggagaaaaggctactttgaagttccatatgattagtcacacgtaaattgatagcatataaaaataaaagtgtataataatcatatttctaattaatttgaatgtatccagtgtaatgtgaatttttggatttgtgttaatatgtatgtacttttcttgatttaacagcttttaacctggagacttgccggcttatggtttcaatgctggatgtatcctttactttgattgttgtctagaataattttttctaaaattctaaaggaattcatcttagaattaatatctagtaaacacaaagtaataaatgatcactaaaaagctttctgaaataattagcttctattatagggtggaatttggtgtgaataaaggaagaaaagaaatttagtaaacagaatgttgttcaggaatttaaggaaacatcagagtattatagaacaagtacagagtccagagtgtcaggacagctttttttctttaacattgattcctctgcaagtgatgggatttttcacatcccacttgttggactgagtttaggtagtgctgactatccagtgcattccatcccacctcatttgtctgggggcactaaacaagggaatattagtaccagagatgatgctaggacagaagggcaaacagcatagcctgaagcacccacaaagtacagcctagttccagtaacaagaccgctttttataagtggttcacaatggcaacgctatttccttataatcaagtcatgtaagttatcttttccccacagtaaaaattggcacttgagctttttctccatagcccctttctatttttaaatcattaattttacatcataccaagaataatctacaataacttttttagccattgaatattgaattccccttatccttgatctttcatttaatccttagaaaatatcgcaaaatacagctctaatccttgattacagttcagagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggtaggtatggcttactagaactctccattcattggtagaagtaagttgatttttatttttaaaaccaggctgggtgcagtggctcacacctgtaatcccagcactttgggaggccaaggagggtggattgcctgagctcgggagttcgagaccagcctgggcaacacagtaaaaccccgactctactaaaatacagaaacattagctgggcgtggtggcatgcacctgcagtcccagctactcgggaggctaagacaggagaatcacttgaacacaggaggcagaggttgctgtgagccgagatcacaccactgcactccagcctgggcgagagtgagactccctctcgtaaataaataaataaataaataattgctacctgaaggcagtttctgttttcttagaaattgtgtgtgttcataattaatatgagtctgcagtcttaaaaaataaaatagtgcttgattattttattttttaatgagcttctgcaatcctttaacctttttactggatggcttttcttttaggatttaggttgagtccccaggctgtgaattcaattgcaaaacgatacagcaccaatggaaagatcaccttcgacgactacatcgcctgctgcgtcaaactgagggctcttacaggtgagttctataaggtcgtgtcatcaccacaagccaagacacagtttttattacatttcatctctcagtgcttctcaacttttattcttcccaaattttttcttgctttagtagtttttttcagattactattaagcatatctggcaaaataattttttggttttttttccagaatttattttagattagtaagtaatctgccattaaaataaacaattaaattttactaaaatgttctaaaacacaatcagctaacttgtgcatttttgatcagataataatgaatttttccccagaatgtgaaatatttggaaagagtgaaattaaaataaaatccttttctatagggcagagctgaaatggtagagaaactgattacagcccatttgttatattggggactctttatctgtttcttaagcagtatctttgttattaagaagctagaaattcggtgcttttatcacaatgaagtaatggccatggaagttgcacagcttttactgactttgggtaaggtattttctccagatctaaaaaaacaaaaaaacaaaaaacacagctggccaacttctgcctgttactttgttgcatattaaatcttttactattcatatagttggcttctttgctttggtcttttgtttatgttaattggttgcacaatttaaatgttactgcaatgtgaattcaatgccaaaataactaacttttatgattttagaaaaaccatttaaagaaaaaccataaattttactgtgttgttttacagacagctttcgaagacgggatactgctcagcaaggtgttgtgaatttcccatatgatgatgtaagtcttagaaattaagagatacagtagatgaaaaggatgtacaccagatgggtatccctttgaaattagctgttaagaatatcttaaggttaaggatgccagagacataagggattcaaaagttagaaagagttatcatccagaatttattaatttcatttattagtcttaactatagtgagaccatgatttgatttgcattcagagacctgggttcaagacccagcttgttgtatttattagctgggtcacttaagcaggtttcttaattgctgtgacactatatgaataaagaagatatagtagtaatgcctttttcactgagccattgtaagatttctattagaaatgcccttgaaaaacactatgcagatatactatctgcttttgtcttctgtaaacaaatcatgtcagtcactgagaatagataacagctcaatagttttgcatacctatgttcttcattgagggcataaggcaggcaacaacttaaatcacaattttttttttttttttgagatggagtctcgctctgttgcccaggttggagtgcagtggcgcaatgtcagctcactgcaacctccacgtctcgggttctagcgattctcctgcctcagcctcctgagggactataggcatgtgccaccatacctggttaagtttttttgtatttttagtagagacggggtttcactgtgttagccaggatggtctcgatctcctgtccttgtgatctgtccgcttaggcctcccaaagtgctgggattacaggcgtgagccactgctcccggctaaatcacaatttaaaacaagttatttactaaacagccaaactaaacaagggtagggtaaggccatgtaatcagtgtgaacataacctagtgccatctttgatggcattagctggatgtatataacaaagctagagagattggttacttgtttcttcagtttttgctcagccattgatttaaaaacaaaaaacaaacaaacaaaaaaacttgtagaattgaaatgactgtaatcactgaatattccattctccattacaaaatataagatgcatgtatttttggtttagcagctgctgcagttataagtacacttttaaaagcttagtatgtgtgtgtgaatatgcttattttacctgcttaagggtgtgttctctttaacatgcgttaacttcttagttgacagtccccttgctgtttctaaagatcagaaggctgcctggggaatggaaagaaagaccatgggctttgacttcagatggggctacttaaaagatttctaaacatcctgatccttattttccttttctctaaaatagggataatcaccttgaccttgcaatagagctgcaagggttagcagtgcacaataccttagtagtgtagggaacactgatagagcagaatctattgctttatgtttagcggggaagccaacatttcacagcaaatactggtatttctaatctcaggtatctgaagggttagctgttctgtttctgtgcatacatacacttgcatgctacaatttgttttaataaagcagattttaaggcaataaactgtttaaggtgttccattagagtaatggggtaatactgtgtggtttggaaatccccacgtaatacaacagtataaactccagttgtttgtgtttgtggtaagtgtctttgaccacggccatttctagtcttggatattatttggaatttaaataattattcaaataattatttaaattatttatccattgaagttatatctgctttctctaagaagttttgatgtgagaaaccctgtggattttatattagactgcttccctaaaaaaaggaaacttttccatctatcatttactcatatcttagaaagttgtaggggttgttttacccgtgttcaaattagaaaaccaaatgtaagctgccagaaataggctgtgccgtataagtgctttgaggtctgtcatataatgctgatttttctttcagttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcactattaattttttaaaatattgttaaaatatatattattcaaacctaacatataactatggcaagttagttagcccaggttacatatcagaatgtgaagcagcctgctatatattacacagtgactatagattgcatcatctccgtatattgtctgtgaggccataaagctctgcttgagtctgggctatctagaaaagggccaaaaaggggctcagaggattaggaggcagggagctcaccttcagtgtcctagcacctgctgtttggtttcaactcaccagggtcctctgaggaaatcatagtttaaggaaatggtaatttcctggttgaggataagcagtagagaaggcccttgctgaaggatatgggccatatttgaacaagtcccaaggtgtgctgcatcagttgtggttctgaattggctttggggtgaatacaaaagcatccctctgacattatattagtttgttcgcacactgctaaagacattacccaagactgggtaatttacgaaggaaagaggtttgactcacagttccacatggctggggaggcctcaggaaacttacttataattatggcgggaggggaagcaggcaccttcttcacaaggcagcaggagatggaaatgcaagcagggaagtgccagatgcttataaagccatcagatctcatgagaactcactatcacaagaacatcatgggggaaaccgcccccatgatccaatcccttccctccctcgatgtaaggcttacaggtccctccctggacacatggggattacaattcgagatgagatttgggtggggacacagagccaaaccatattagacatcattcagttaattccgttttaattattgatacctcaaaacgaatctcttaatctcctccccttctgctttcacccattctttccaaaagcatggagcatagttttcagtatgtccctgcagttagaaa

SEQ ID NO: 13190 - DNA, 36154 bp, Human
agtctaaccgcatagggtgcaactatgttactgtccttcctcttcacggcaaataagacacacaattcatctttcacaagaccataaaatgggacttccttttttaaaaaaaagttcctcaatagaagcatgcttaaaaatctttcccacatcctctaaaccttccaaagatccagtcttcccttcattatactttcctacaataacaaatttttttgaaagagtacactcaacctgtctgaacttcaagattataatttttatctagtactgtacttatctctgccacctactcaaattacccttaaggaaaccaaggatacctgaaacgccaaaatcaaatacttatttttcaagtcttaaccttatctgtcctggggatgaaggaactggtgcagtgttcactagaatgatagtaattatggagctcttaaggagctctactctgtgccaggcactgtactaagcattcaaaaatgttcatttaatcttcacaacatccctgagaagtactacccccttttaatagattaaaattggggctcaaaattacccagaggccaagtagttagtgaagcccatatgattccaatgtttgcagtctcttcccaattctgtggcattttctccatctctttcactatttcatcaacgacgcttataatcaattctcttatttcacatgctctccttggcaatttcatttcctcccaaagctttaactacattctatattagtgcttcccaactttttaaatctttctgtaaatataaacattttgtgctctctgtagcttatattttgaaaataagttttttcccatagaaattacaatattgaatatgtttgttcaaactacacttccttccaccactcaagatctgttaacctctaatgaattgccccatgattgacatcaatagaccttgatgcagaaatattttattggagagatatcaaatcaatctctatttcctcttcccatgtccacttctgctagacatttctctcgagtcataaacatctttaactgtctaataagcatagttccatgactgtcgccccaggcccttcaacataaacctgtctaaaaccaaactctcatttcccttagcaaacctgttctctgcgttctccagctaatcttgtcacaacccacccttgtctattctttaaggtacctacctgcaaaaccgtaacgctgatactctgacttccttgagctaccaggtaaaaaaatcaaccactacaggagtgcctattatggcctggagtagaggaatgcaaaatagttcaaaatatcctcttcctcctgaagaaacagatttttttttttttttggagaggcatgttccaacttataaaattaaaatatattcacaagcattttaatttgatctttaatctctgttttacaggaaaaaaaaatgagatgttactttccactccttcattgttgaaataaacttacactcaactaaaagaaaacaggtctgaatacaataaaagtcaacaggacagcgcaaatagccaactacccaaggacacaaagtgacctggaggcgttctgcggtggcgctgccgtcaaggccggggccgcctggccagaccctccctcagacgccccccggggccgccctcactcccgcacgtccctctgcagctgtcctcagccggtggggtcggcagtgaccgcgggaaaaccccgcttgctgtgcgacccagggcgcgctgagcaggggctgcggctgccgccgctgtccggctccggttccggccccggccccgggcccggccagagctgagtccggactcagccaaagcccctcgccttcagcttcccagacgtccgaccagtggaaaattagcatacctggggcagaaggcagctgcagggccggcagtcctggcaaacctagaaggcgggaataaccctggtgacgggcggggccgggctccggcgctaactgcatccactaggtttggtcaacacagagccgcgccaactctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtaagaagcccctcctccgcctgcagtccctttaatcctttcctcccctcgtggttccaccattgattcttcagacttctcccgccgggtcctcagcttcttttcttctgaccggcctctggggtctgaaggaaggagcccccgttcagtgttttgcctaagaaggaacggatcctgacccggcccctcgagcgctctgccgtttacagcggcggtcccagattgattcccggtcgtgccttcggttgaaaactagcaaacaatgtgcagatccgggacctcgccgggactgcggcgctgtctgctcccgggctctcgcatatgctaagcctccgcccgggcccttggaggcgacggactgcatcctcaatttaaagtcagacgcgctcgtggcttttcgcttcaggattagattgagtgattgtgggtggatttttggtcttacccttgaaagtttattttcctttcctcataagttgggggaaagcattgtatttcaaacaccccattgctggtttcaacattacaaacagggaaacaaaagcaaatttccattttcagtcactttatttggtgaaacattccagcacctaagttttttgtacaggtgtttgtgtgtgtgtagtaactaccaatttaagaacagattgcgtttgaaaaattaatttttaaagcagttgcttggatctcagatctgtttctaatgaaaataatgaaaggtttagttcttcgtaatggaccgttaagttcttaatacgtagacaaattgtatgtgaaatggaccgtttagttgttaatatgcagacaaactttatatgaaactaaaacttgagcagtctgaaacccttgaggactaggttattctgcgtaacagaggattctttcatcgctaaatgaagtttaaacaccagttttgaatgttcagcagaatggcagatgctcaataaatagttgagtattaaatatccccatggagtttacatcctaaaaaaagaaaatctttcaaaagagttttatatagttccgtgcctcaggaataaacacacgaatatttcttgctgagtcaactattattttacaatatgcggtctgtgaaagtatatagggcattttgcctctatcctaagtagtactacaaagaaatacatttcaatgctaataacttaaactggtagggttgtaaggatttttattctgtaatattgtataatgaaatattttaaaaatagtaaaagtgtctgtgtaaaacatctgattctaaacatctttaataggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggaggggtaagtgaaaaccgtacactggcatagaaggaaaaatttgtaactagtactttctactgtgtaatcatttaaatttttcattttggaaaacgcttctattagcaccaagcttaacatttttatcagctgtttatcgttaacaaaaaaccatttgttttaaccttttgtggactgacagacctttcaggtttctctgattagcagtctagtgtaaagttcttagagtgtaagactcccctgtcctagtggaactgctcattgactgcttactgtaatgttggaatgtcctccagataacagcaatttcttgattatgaatcttggggagctacataagtttgtctggactagtgtaacagttaagaatgttactacagaacagccatgcaaaccacagttaaaattgttcctgagtgatacagatgttgtttcaacagaatgaatgttattaaaggaaaagaaatttgcattaagaatctggaataccttctttcctaccttatacactgattagatgattgggaaattagaaaactcaggcaaaattctaggaccttaataggattaaggttgatattggctgaattttggcaaatgaggtaattaagatttttttctgtttaaaaggttcatgctggactttgactttctgaaggtctgcgtctttgaatgtctaaactgatcctttcattcccagactagtaacttttcaatttatttttatttttattttgagacggagtctcattctatatggcctaggttggagtgcagtggtgcgatctcagctcactgcaacctcctcctctcaggttcaagtgattcttgtgcctcagcctctgtctcctgagtagctacgattacaggcatgtgccaccactcctgggtaatttttgtatttttagtagagtcagggtttcaccgtgttgcccaggctggtctcaaacttctaacctcaggtgatttgcccacctcagccttctaaagcgctgggattgcaagcatgagccctccaggcccagccgattcccagactagaaacttatcagaagaacatgtgctaacaggtttcctggaactgttaatatattttatttacttatctctgaaaagttattctacttttttactattcattttgttaaactaaaacactgtcacatgcttgtaatagttgtatttatggtaatgatcatatgacagcattcttaaaggtcatgttttctaggcctgccaccctattgactatacacctattaagagtatcttaatgtgttaaggaccttagacattgagtaaaaaataccccttcatcttagaaacaaagtacttgaggtccagagaaagtaaatggcccaattagagcagtattagcttcttaattcccacagcaacatagtacctgcaccattctgttcctctagcaatcaatggctacaaatggctatctggctggtaattcacacctgtaatcctagcacttttggaggccaaggcaggtagatgacttgaggccaggagttcaagaccagcctgggcaacatggcaaaactccatgtctactgaaaaatacaaaaattagccaagcatggtggtgcatgcctgtagtcccagctattcgggaggccgaggcatgagcatcacttgaacctgggaggcggaggttgcagtgagccaagattgtgccactgtaccccagtatgagtgacagtgagaccctatgtccaaaaaaaaaaaaaaaaggtagctcaaagtagctatctgatacagtttgatgacaattttctcaaatatgatgaacaacccattaactctaggtctaatggtctaaatcagtgatacttagatttgtgtttttatcagtagaaccctttaaacaaaataatattcagaagtccaatgtgtaaagcctgtaaaaagggaaccccttgggctaaaacagcagtacagaggctaaagcaagaactacttgccccgtcaccttctttcttctatctccacagcagttcctgaggtaattgcaagaaacaaattttgaattacttctgccatacataatagttgagggaccttttggttttacatacttagtctttacccctgaaatgattgaagtagaccagtgaagttaggagcatattaagggtgtaagttcccaaattttcctttggatttcccaaaaatccaaagctgtggattttcaatggaatttgatttattaactttctcctaaaaaatgtcttatttattgaattctgatcttcccatactatcttttctataattaatgatatttaatcctcaggtcctggtttctgtcttcagcacatttactgtttctatcactaaaaaagattttgtcataacgatcttctacatgagttaatttatcttcacatcattactttaggtgcctttttaattcaccatttcacgtactttggtttctataatctcggtgaaaacatcttaatatcccatttatctgcagagtatgcttctgacaaatttaaccactgagagcacagcacccagattctgatataaaggggaaatacctttaatagtgcaagaaaagtaggtgttacagaaccatctaaggaggacatgggatcagccacagttaggtccatgtctaaatagttttggctaaaataaggcaattggagaggaacagaaatgtaggccgataccttggcgtattagcttgaactgtaaaatgtttgatgttcgtcatgatcaccttgagtcatcagaaaatacgttttgagtttactctttaaatggcatagattcaacaatatctaatacattgaagaccctggtaaaattgattcaacaaatgtttgagtatgatgtgcactgcactctgtgttttggtagattcaaaaatgaatccagccaggctcggaggctcacgcatgtaatcctagcactttgggaggctgagttaggcggatcacttgaggtcaggagtttgagaccagcctggccaacatggtgaaaccccatctctactaaaaatacaaaaatttagctgggcatggtggcgcacacttgtaatcccagctactggggaggctgaggcaggagaatctcttgaacctgggggttggaggttgcagtgagccaagattgtgccactgcactccacctgggcaacagagcgagactgtgtctcaaaagaaaaataaaataaaaaatgaatccttatgtccatcccatcctcatgttctaacctagctagagatgacattggtacaagtaattgtgttaataatacaacatagaatgtcaagagaaaggagagattagttccagctgaggaattgtgggttttgttcacacacaactggaacacggctttgaagaatgatgaagatttgggcatgtgggaattcattcaaaaattattccaccactgtctccagtatatcagcactattttagatcctagagatacaaaaataagtaaaatataaccctctaggtattctttgtctagtggaaacctcagacaactgaataatttatgttagagtgttgtcaatgctttgacagaaatatgtagaaattgctattagaacacagagataggaatgattaactctgccgtttggaatcaacagagataaagtttgagctggatcttgaagtcttagttagcaaggcaaatagacatactaaatagaggaaagcatatttaaaatatatgtcaatgcagtttgtttgtacaactactaatgttgcagtgggatttgagcttaggatataggtgggggaagtgacagcaaacaaaattatattagggctagattgcaaagggcgttttattcactctaaggagttttaactatgtaagaaattaaaaaccaaaggaaataagtggtactaacataagaacagacatacagaccaatagagtagaacagagaacccagaaataaacccttgcatatatggctaatggattttcaagaagggtgccaagaccattcattggggaaaagatgatcttttcaacagctggtgctgggaaaactggatatctacatgcagaaaaatgaagttggacctttactgtcatatgcgtaaatgagctcaaaatggatctaagatttatttgtaagaactgaaactcttagtggaaaatatagggagagatcttcatgacattggatttggcagtgatttcttggatatgataccaaaatcatgtgcaacaaatgaaaagtatgaaattggacttcatcaggattaagaacttttgtgcctcaaaggacattttcaggagtgaaagaacgcacagaattgcaggaaatctttgcaaattgtacatctgctaagggattaatatccagaatacttatataaagaacttctgtgacccaagaacaaaaggacaaatggcccaatttaaaaatgggcagaggaactgaaaagacatttactcagaaaagatatactaatggcagataagtacatgaaaaaatgttcaacgtcactaatcattagggaaatgtcaatcagtaatcacttaacacctgttaggatggttactgttaaccagaaaaataacaagtgttaacaaagatttgaagaagtagaacccttgtgcactctgagtggtagtgtaacacgatatagccaccatacaaaatagtatgggtagtttctgaaaaaagtaaaaaattgaattactatatgattttgcaattccatttctggctatacatacaaaataattgaaagcagggtctcaaagatatttattattcacaatagctaaaaagtgtgaacagccttaatgtccaacaagtaaatagataaagaagaggttgtatatacatacaatagaatattattcagctttaaaaaggaatgaaattctaatacatgctacaacatgggtgaaccacaaaaaacgtgctaagtgaaggaagccagttacaaaagaacaaatgtaggattccattatatgagttatctagaatagccaatttcagagatggaaagtagaataaaggttatgaggggctgggaaaaatgaggaatgaggagttactgtttaatgggtacagactttcagtttgggatcatggaaaagttatagaaatgttttagtagtgatggttgcataatgtgagtgtacttactgccgttaaattgtacacttaaaaatggttaaaatggctaattttatatttatcacaataaaagtgtataggagatcgggtttcttatgaaaaattagaacctctgacattattagggcctcatatttatgaaaatgaaggcagtatttgatgtgtgaattatttgtattattgcctggcccttataggcatttgagtctaatccctggaataaataaatgtaggtacattatttactgttcaatgaaaatgaatgttggtcggaaaagaaatgatttgcacttaaccaaggaggccactggtctcagtagcaaatgctgcttaatgcttagatgaagttaacttatctgttacacacttcatttttattatcatttatagtgtgggatcctatagaaaatagatacagctatttaaaatattctgagaagtctttcatggatgtaaattgttactgcttattaatgattcacagtttacttctgcttagtgggtatttatagtatacatatttatactatgtatttttctaataatattagtaattctacttagtatttacttctccctatttttattttcctgaccctggcgatctttaataaccttcactttggtacatgtctttataagtaaattcagatacttaggcggtggttttcaaacattttagtaaagaaattctattcaaacagtcttacactcttaagcgtaaaggttccctccatcctgtaagttgaagcctcaagggaaggtgtaataatgattgatttagacttgtattgtctgctatggtaaccattagtgatatgtggctattaaatttaaagtctttaaaatcaaatttaaaaatcagtggcttgagctaggcgcagtagtgtgtgcctgtactctcaggtacttgggaggttgaggtaggaggctctcttgagcccaagagttcagggccaacctgggcaacataacaagaccccatctcttaagaaacaaaaaattcagtggcttaatcacactaccaaggccatttcaaatgctttggtaagttgtattggacactgctgctttagatcatgggcttgagtcagaatgcctatgttcaaattatattatttgctactgggtaacattaagcaagtcacctctcttcactttttatcctgcagaaaatgtagatagtatcatgaggctgttccatagattaagttaattaacatatataaagtatttaagaatagtatccagcacatgctgctgttgtgctgttataggagctcttatacttcctcagagatctaggttcagaaaaatacagtataaaaaccaccaatttacgaaataattgcatcaaattgaaattttttactgtgcttggcatatgaaacagtttatggtttttatgacctagttgaaaataccttggtggcatgtgcctatagtcccagctgttcagaaggccaaggcgggaggatcacttgagaacagggggttgaggctgcagtgagctatgattgtgccactgcactctagcctggataacacagtgagaccgtgtttcttaaaacaaatttataaataaaaatactttgttctcttctagcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtaagtctcttaaatatgctttgagactcagaagggctatatcctgaagatctcctggtttttaatagcaaggtggcagtagagtttacttatgtagaacatttgcaaagccacatgatgtgtggctctctagtcctcaataaagttgctgtcttttaggaaggtgggtttttcctaatagttcttgtgtaatcatactctgattgcttaggtatacccttgtatttagggatggcgtgtagtttttagaataatttacaactaaaaagttaagagcagatcattctttgaagaagaaatagaaacctttttaattttcagagcaggggtcagcaaactctggcccatgggccaaatctagtctgttgccttttttgtacaacctgcaggttaagcatggtttttacattttcaaatagttgtgtaaaaatatcaaaagaatattttgtgacaagtagaaattttatgacattcagatttcattgtcataatgttttattggaacacagccatacctgtttgtttaggtataatctgtagttgttgtgttttaggcagaattgaatagttgctgtagagaccatatggccaacaaagcttaaaatgtgtactgtctggtcctttgcataaaaaggttgccagcccctattctagaattattgaaatcacatccctaccactccatggccagtaaattgaaagatgcaaggaaagacaaattaaattgatttaattgggtgtgaggtgggataggatcaaatgagagataaaatgtttatttcagtttttaggttgaagtgtaattaagttattattttacaatattctcctcgacttacctattatagccatttgaaaattaaggaaaatgaggagaaaacagaagaaatgagtcagaaaggagctatcacttgaaaaaagagatacaatacatagaagaaagaatggaaaagagatcaagaaaggaccatgcattctctgagttaatgcttttttggagcaaggagacaatacaccagcgattccaaaataattgttggttatggcatttcaacgagttttcctagtactttatttaaaaagtgaagtaacggctgggtgcggtggctcacgcctgtaatcccagcactttgggaggctgaggtgggtgaatcacgaggtcaggagttcaagaccagcctggccaacatagtgaaaccacatctctacttaaaaaaaatacaaaaattagccgggcatgatggtgcgtgcctgtagtcccagctacttgggaggctggggcaggagaatcacttgaacccgggaggcagaggttgcaatgagctgagatcacaccactgtactctagcttgagcgacacagcaagactttgtctccaaaaaaaaaaaaaaaaaaaaaaaggtgaaataacatgtgaaaacagtatataaaatttattgtttttctgaaatctctgatttaataggaactaaaatgtaagccaattaattataaagaattccagtgaaacctagctattttatttttcatgttgaatagaatttactacaaaaccaaagaggtcacccaaaaaagagaaactttttaatatgagacccaaaagttctcttttcttagctgctttacctttttaacctgttctccagttaagcactatgttttaaatttttctggtctttttataggtgtgtttaagcagaggaaaattattagttgaaaaagctatcaaggaccatgtaagtaggaactataaagattcacattgtacattttgttattaaaaactcaactggaaattacagatattcttgaaattttcctttccacatttttaggcaaaaacctgaatctcagcatatattttattttacaaagtaaagaacttacttttcatgtagaaacatccccatcttgtggccttttaaaatattactggaaacttaaaacttgccttatagttttcattaaattaccaaggatgtgggtataaagtgggattgattttaggaattctatagaaaatcttgatgtcctagctattgtaactctatagggtctgttacaaataactgccttagtgacattaaacttcaaataattgaatttttattaaaatttagctcatcttaaataatttcctagaacaaccataaaacttttttttttacaggattttattccttcaaatagtatattatcaaatgccttgtcatggggagtaaaaattcttcatattgatggtaaggattttataattgttttttgacagtatttgttttaagtgtccatgtctgtcctttggttcctgactttacatagtgaaattttgatagcagggatgtcttaatctgtttcctattgcttataacagaatacctgaaactgggtaatgtacaaagaaaaggaatttatttcttacagttatggagactaagaagtcctgggtcaaagggctgcatctggtgagggccttcttgttggtggagactctgcagagtcttgaggcagcacagagtatcacatggtgaggggctgagtgtgctagctcaggtctctctttctctttttataaagatatcaggtccactcccatgataacccattaatccatgaattccctcttaaaggtcccatctctcagtaagtactgtcacactgggggttaaatttcaacatgagttttagaggagacaaacattcagaccatagcataagagatacctataatggtaaattctttatctaatttaactacaagaaaatatcactgtttaactccaagagtaaaattgctaatcttaaaaccttctttcttttaataaagacattagatactacattgaacaaaagaaaaaagagttgtatttactcaagaaatcaagtacttcagtaagagatggggtatgttttctttttcaatttttaaagtgaccaagcttggtttttttacttacgtatttgcaaagttttcctcccaagcagaaaatatcctaggggcaagcctgtgtatgatgtgcctgtttctgttattcaaataaatcgagtgtcatttaactttagggttgtactcaccaggtaaaagttgttcctggaatagtggcataggtcgcttcctcagcccccttttgttactgctgttttgtaacaggtacttttatttattctgtagaaaaatcactaaaatcagcctgttgtataaacgttcctaatgtaagtaatgtacttctttttggaatataaatatgtactatccttttcaactgctctaaatggtataacaaaatctcgttttagcatagctaactggcctgaccttgaaatacttgttaaacaaccacattggttgttaacgttctgttaaacctaatgttcccattatcttcagtccctttccttttccttgttgcttctttgaagcatctatacagtttcaggctttttccatcctttaaaacaaatacagtaaaacctcccttgatcccacatccctacctacctattatctaatccttgtaattcctcatccaaagttctcagatctctacttttatacttcccattcacttttcaacctacaaggtataaaacttctgaccagttttccaaatcattttgatactttttaaacccagtcatattggttctctcagctgttgtccatttcttccttaaacttttctattctcttctgaaatttcatctcttagctttctcctgatctcttcatatttctcagaccattcttttgtggcctacttttcctttgttcaatatttaaatgacagggatctaaaaataataaactgataagagtgtatatagagacatgaagccatagtaggatggcatattttagaaatcttgtatagcataatacagcctgatctttgagtgtgccagtgacaaaagataaagctggaaaaaccagcatgttaagattataaagtaccttgccctatataaaggagttagattttatcttggagagtttggaaaattatggaaagattataaatagagtaacctgattggatagtcattttggaaagatcttctggttgacagtaaagaatgaattatttggcaagactgaaaaatggcttttgaactcttgaacaattttttttttttttttttgaggcaggccctccccctctgtcatccaggctggagtacagtggtgccatctcagctcactgcaacctcctcctcccgggctcaagcgatcctcccacctcagcctcccaagtagctgggactacaggcatgagccaccgtacctggctagtttttgtattttttgtagagacggggtttcgccatgttgcccaggctggtctcgaactcctgagctcaagctatccacccgcctcagcctcccaaagtgctgagattacagccataagcaaccacacccagccctcattttttactgaatacattttataggatgaccacttggtatatacatgccgtatataaggctgcataaactttttatgcatttctcgtttttaataaattcacgtttatataaggataatttgcagaaagcaacaaagtagtatttaaataaaactatcaatcaaagtgtaaaaatgatttggaaaactggtcagaagttttataccttgtaggttgaaaagtgaatgggaaatataaaagtagagatctgagaactttggatgaggaattacaaggattagataataggtctgggttaaaaatttaaatgactatttccaaattttcacaaaatataagtggatattcctgtattggactttgctaaatggcatataaattgcctctaccacacttagcagattgtttggattgtatatagaagtaaatgtttaaaaaaatgtaaactcataaggacatttatggactctgaatacacaaattatgtctgtcttcatgtatatgtgtatatatatctgaaataagtttcatagaacaatagttaccctccttaatgtggtggatattaatatttctgtggtattttcatttcttaaaaatattgatcacaactctgaattgactttatagcctactgataggtcacagtttgcagtttaaaaagcattctgggggctaagcatggaggcttatgcctctaatcccagcactttgggaggccaaggtgggcagatcacacgaggtcaggataccagcatgaccaacatggtgaaacccccatctctactaaaaatacaaaaatgcccggtgtggtggtgcatgcctgtaatcccagctacttggaaggctgatagaagagaatcacttgaagctggcaggcagaggtagcagtgagccgggatcacccccactgcagtccagcctgggtgacagagtgagactccatctcaaaataaataaataaatggatggatggatagatagcattctgggatgttatgtcagtgatcctgagaaatgttcaaggcctggcttaaggcaataacaaaggggaggggaagatttgaaagatacttaattggtttcagtgcctagtcagtgtcttgagtctagtatttactagattattaacatcataaagaccaagtttagtcctcatcattccttcagtagtaacaaatattaaatgcctgctatgtgccatgcagtaggagccctcataaaacgaagaaaagataaaatagctatgaaacagatcttaatctttcttctaaaataaaaatgataataataccaaatatcttgatagtccagaatctatatctggttgaattgatactcatactggaaatttttattttggtatataagaaaggaatgtttctggaaaatttttagtttgccaagtactaaaacaaaattagtgaaattacatttaagagtcttgaatggacatgtataaatttcaaaatgtttattaggttcccataaatgttcttattagtatgtatcttatttaaaatatggtaattggataaaggtattttactcattgctttatttaaagtgctttgaggtttgggcttttcttttttttttttttttccagtttactcaaaacttattttgtcgaattttttacatacatgtgcaggaggaatattggtctttttctttgatgtctttgtctggttttagtggaatgtttaatcctattttcagaacacactgatatgtgttcctgtttctattttccagagaagtttttatagaattgtttttatttctttaaatgtttggtagaatttactagcaaggctatctagccctgacatttttctttgttggaagattcttaactatgaattcaatttattcattagatataggataattcaggttattttctcttcagtgcatgttggtagtctgtttttcaaggaatttgtccattgtgtcttggttgtcaaattgatgggcaaagagttgtttctaatactcccttattaactttgtaatgtctatgggaactgtaataatgtcccctcttccattcctgataatgctattttgtgtctattccttttttcttagtcaatctggctagttttaccagttattaatattttcaaggaaacagcctttagtggcattgattttttgtgtgtgtggttttctgttttcagttttattgatttctgctcttatttcttttcttctgcctattttgggtttatatttctatttgtagtttcttaggtaaaaagcttgaatcattgatttgagacctttcttttatcttaatgctataaattttctttaagctttcctttagctgcatcccacacattttacactggatattttatcaatagactttatttttttagagaagtttttggttcccagtaaaatcgaatgaaaggtacagagatgttttacatactccttgtcctaacatcccacaccagagtggtacatttgttataatcgatgaacttaacattgacacatcattatcatccaaagttcatagttcacattttggctcactcttagtgttgtacattctatgagttttgacaagtatgattatgacgtgtgtccatcattatagtatcatacagaatggttccactgccctaaaaatcttccgtgtttatccccccattcccttaaaccccagataactcctgatgcttttacattcaccatggttttgccttttccacagtgtcatatagttggaatcatacagtgtgtttccttttttgattggcttctttcacttggtaatgcttatttaaggttcctccatgtcttttcatggcttgacagctctttttaaaatctgagtaatatttcattttctatatgcagcacagtttatccatttacctactaaaggacatcttggttgcttccaagttctggcagttatgcataaagctaatgtaaatatccacgtgcagggtttttttgtggacatattgtcaactcatttgggtaaataaccaaagagtatgattgctgcttcacatagtaagactaggtttagttttgttataatatgccaaactgtcttccaaagtagttgtgccattttgtattcccaccagcaatgaatgagagttcctgttgctgataggttggattttcatctttattcaattaaaaatatttttaaatttctcttgtgacttactcattgtcctgtggggttacttttatcatttgtttccaaataggaatttttcagctatctttctgtttactgatttctattttaattctgttatggccatataacgtgctttttattattttagttttaaaaaatttatcagagttacccaaaatatagtctatcttggtaacattccatgtgcagttgaagaaaatgtatattctgctgtggttgggtacagtattgtttacaagtcagttagatcaacttgagtgatagcgttgctcatgttttctgtatccaggatatagaaatgttgctcaggccttgttctgtccactactgagagagagggatattgaaattaccaagtaaaattgtggatttgtctagttttccttttagttctagtacagttttgagtcattttgaagcctgttgttggatatgtacacatttaatattcttttttttttttttttttttgagacggagtctcgctctgtcgcccaggccggactgtggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccagaatggtctcgatctcctgacctcatgatccacccgcctcggcctcccaaagtgctgggattacaggcgtgagccaccgcgcccggccttcttatgtcttcctggtgaattgacccttctagcctctgtaatgctctctcttctgtccctgttaattcttattctgaagtctgctctctgatgtagaccattctggctttatttttattagtatttacatagtactttttgcagtcttttgcatttaacatatctatatatttaaaatggacttcttgcagatattgtctttttcatcaaatttggcaatctgtcttttaattggtagtttaagtgatttatacttaatgtaactattgatcttgtatttaggtctaccatcttactgttagttttctgctgatgccctctgtattttatttctgtttccccctttcctgccttctttcagattgatctgccagctttttaactctcttcatttttgttgttttattttagtggttgctataggatttacgatatacatgtgtgacctttcgcaatctatcttgaattaatatttaccttcttcaaataaaatgtagaagccttaaaatattcaagcccttttaccttccccaccaacctttatgccataatgtttagtacatcttcttataatgaaaatgtcaccagacaatgttaaactttttgcttgaaaaagtcatattttagggctgggcctggtggctcacacctgtcatcccagcactttgggaggccaaggtgggtggatcactttagctcagaagttcgagaccagcctgggcaacatggtgaaaccccatctctacaaaaaatatatatataaattagccaggcctggtggcatgcgcctgtagtcccacctgcttaggaggctgaggtggcatgatggccttagcccaagaggcggaggttgcagagaggcaagatcatgccactgcttgcgacagggcaagaccctgtctcggggaaaaaaaagaaaaaaaaagttgggttttaaagaaagcgacaggaggaaaatagtcctattaacccagatgttaacctttccattactcttccttcctgaaattacaggttttcttcggatatatccctttagcctgaaggacttactttagcatgttttagagcaaatctggtggcacaaggaattctctgagatatccttcatgtgatcatatctttactggaaaaagaatcatgaattgagagttctttgtctcagcaccttactcttgtcctaaaactgtcttctggtctccatggattctgacgagaaatctgcagttactcaaattggtattcatttatatctactgtatcatttttctctggctgcttttaagatttttttctttatctttggtttcagaagttcgattgtgcctacacttggttcactgagcttattgatttgtgtaaatttatgtttggaaagttttcagctattattttgttaattttttttcttcactagtctctcccctctttttccaccattccagttgacaataaagttagacatcttgatgttattccacagatccctgtggctcttttccttttttccttagtcttttttgtttcctcttttcttccaattggagatttctattcatttgtcttgaagttcactaatacttaattgtgtcatacatgttctgctattgagcttatccagtgaattttgttatctcactcagatagtatatttttcagtcctattatttttgtttggttcttatttgtagtttttctgctgagaatttgtctctttccattcatcttaagtgtgtttacctttacttttaaagtctttttctaataattacaatatcaggaacatgttggggttggcatctgattgtccttttctctcaaaaattgataatgtttttctggttgtttacatgtgaaatttaagttttgactgtatactggacattctaaatgttgtgtaggccctatatcctgatagtctgtaggatgctgattttgtttctgccattgttttagcggacagtcatcccagttttgttcagactgttctgtcttggtggttgtgggtggggtggatctaatctcagtttcaattttcaaagcccttgctatgctgcgttgggtctatccttagcatgtgcaacttggaggtaagccctgcacttgcatggatttatatagggaattagggatccctttctctaacttgctcttttcatggatcaatctccagcttgcagtggcctctttcccaggtcttctagtcagaaagtgagggtttctcaatgttagcttaagcttgtactacctttacaatctcagcctcctaattgggacccaccctcagggcagaactgtgggagaaaagaaaataatacagggattctcttggtatttttggccacttgaacctcattcctggttcttcctgccagaaagataggagttttagctgctggctctgccactgctgctaactccatgactgaaggttccagttttgacttccttccacaatctgcctgcttattttacttttcattcttcaggtagttgcttattcagtgttgtccagagtttctagttgtaatcagtggagttgattatccatctttaacatattgaatctttgcctaaattgactgactaataaatgttgactaatttctttattcaatttaatacaaagattttgctgaataagggcataaaaataatatgacttttaaaaaaacatttcattaactaccttttcattattggttttctttttatgaagtcaaaatcaattatagctagaatgcaaggtacttgctgagtgtattgtaaaacatttaaaaacaatagttttttttaacaaagaataatccttctttgatatagcacttttctgcatgatttttttatcttgaagatactgagcaattgcagttgctgttttaactgtactttcaaagccaatcttttcactatatatttttttttagggcaaaagagttggtagtggtgcacaaaaaacaagaagtaagtattttgtgatctttaagtgtatttggtttgcatttgaaaaatcataaaagatcttctaaaatcatataaaccaccctctaaatgatttattcaaggctttcttcgtctttatagaacatagatccttggtgaagtttggtgaagcctgtggaccgcattttcagaatgatgttttttttaaaacgtttcctttaaaaatcattagtctaccaagaaaatgaattatattaaaatgtagttaccaaaatagtttttaattgtgaaatagtgataacttgctttttattacacagaacagattctagcagtgaatctaattgccacttcattttgaattgataagcgtaaacaatgctttgagatatctgctcaagcagttcataactgatgaaaatatgtgcagtttctattagcatcaaagtcgcaggtactgcgaatagtgtgatttgttacatttataattgaaggaaatgctaaatttcagtttgaggttagtgaagacaatagtgtagtttttctcctgttctaatttatgaccttcctgaatcctgttaatttgagggttccatttagtttaagaatctcagaatataggagagagcttctgttatttttggaaatgaggtgataatggaagtacctcatctgaggcttaaaactttaaagtggatacatagttttttgtttggagggttttgttttgccacagtagttttattaaaaaaaaaaaagaatcctgaatttgcaagtatctaatatgttttctatgttctcaagcaggaagactcaaaaagccttttgtaaaggtggaagatatgagccagtaagtatttaagtccaatctgtatgatttaagtgcaatactaaagaggaaaatcacctaactaattaggctagctcgattagtactgttaggttcctttgtgtttgatttatattatactaatgtgcatgcggcacaagttaacgaaagtagcattaattcatttgtgctcaaggactgaatttagtttcagtatgttgtagatattcctgaaatagctggtttagaaaaatcatgacaccgtttttttagtatttaaattattctctggctaaatgcagtaccaaatgatttagaactactgaaagattacgccttcatttgcgaaaaagaaattattagatgctatttagaaacagaaaatctaagtataacatctaacatggttgatttccaaaattctgaagtattgtaggatagtcttgttgttgttgttgtttgttttgattttttgagatggagtcttgctctgtcacccaggctagagtgcagtggcacgatctcggctcactgcaacgtccaccccacccccggttcaagcaattctcctgcctcagcctcccaagtagctgggattatgggtctacgccaccatgcccagctgatgtttgtatttttagtagagatggggtttcaccatgttggccaggctagtctctaactcttgacctcaagtgatccgcctgcctcagcctcccaaagtgcggggattacaggcgtgagccactgtgcccagccatgtgggataatcttaatgaagaccacagatataaataggcctgccatgagagaattagattactttcttttttctttccacttattcatttagacatctgtggttaattctcttgggtactcacactgaggcgacaaaagtgtattgaaaactgctttttatgaaatgtgttgctgtgaagaaaaaagtgcaattcaaaaggaggcctagaaaagacactagtatacgaaaggacatcccatgttcatgaattggaagatataatattgttaagatgttaataccacccaaagtgatctacagattcactgcaatccctatcaaaatcccaatgatgttttttgcagaaatagtaaaaacgtatcctagaattcatacggaattgtaacagatgcaggaaacccaagacaatcattaaaaataacaacaaaggccaggcgcggtggctcactcctgtaatcctagcactttgggaggccgaggcaggcagatcacgagttcaggagatggagaccatcctggctaatacggtgaaaccctgtctctactaaaaatataaaaaattagccgggcctggtggcgggcacctgtagtcccagctactcaggaggctgaggcaggagaatggcgtgaacccgggaggcagagcttgcagtgagccgagatcacgccactacacttcagcctgggggacagagcaagactccgtctcaaaaaaaaaaaaaaaaaagaacaacaaagtaagaggtctcacactttctggttttaaaacttactgtaatgctacagaaatcagaacaatttggcattggaataaagacatataaacgaatggaatagaatagagagcctagaaataaaccatcacacatatggccaaatgattttcaacaagggtatgaagataatttaatggagaaaggacagtcttttttaacagtgttgagaaaactagatatacacatgcaaaagaatggcattagactcctacctcacatcatgttcaaaaattaactcaaaatggaccaaagacctaaaatggtaaaactcttggagagaacacaggggaaaagcttcatgacattggatttgcagtgctttcctggacgtgacaccaaaaacacagattacaaaagataaaataattaaattggaccatatcaaaaatataaatttctgtgcctaaagggatataacagtaaaaaggcaaccgaaaggatggaagaagatactgcaagtcatgtatctatttctttttttcagctttctcaggttgaacaagtcatatatctaataaatgttaatatccagaatatattaagaattacaagtcaacaacaaaacaacccaattttaaaaaggggcaaagcgctgaatagacatttttccagaggtgatacacaaatagccaataagcatatgaaaagatgctcaacattactaatcatgagggaattgcaaatctaaaccacagtgagataccactttacattatttaggatggctactattaagcagccaaaaagtgaaagtaatccaagtccatcagcaaattaatggataaacagtatgcaggatgtgtgtgtacacacactcaatggaatattactcagcctttaaaaggaatgaaattctgacacgtgcaacatggataaacctttaagacgttatgctaagtgaaataagacaaaaaatactgcatgattccactcctgaagcatctacgttagtcaaactgataacaagaagtagaatggtggttgtcaggggatatggagaaaggatatttgggaagttactgtttgatgggtatagagtttcagtttttgcaagatgaaaatacgtcatcttacaaaagatggacggtagcagtgatggtaccacagcattgtgaatacttaatgcaactgaattgtacacttaaaatggttaaggtaataaattttatgtgtattttaccacaatttaaaaaatgtttaaatgttaaaaattgttaggcctgaaattgattttttgaaggaaagcctaaataatttgttatttcagattccagcttaattatatgattttgaaatacaaaactttaaaccttttttctttaatcataaagaatctcatgtatttgtctttttattcttctagactttataggccattttatcttcagctgaccaatatgccttttataaattattctattcagaagccctgcagtccatttgatgtagacaagccatctagtatgcaaaagcaaactcaggttaaactaaggttggtttgaatctttacttttagaaggaatattcagaatttcatctcaatttttctttgtaaagatttgaaatagtttcatttatgccataatggttatttgtgtttgtaattactattctgattacttttataagtctgaatctgtttagatggaggtggggagggccttaaaatatttgtgaataatgaaaatgtgtagtttatcttgaatgatctgaaatattctccagaatattcattaaatctttagtttgcttctcaatatagtataaagaaatatgattaaaagtacttgctgatacaagtctctgcaaattatgcagattgtgtgtgatagtttaggacaataaatttttaaagttattccttaggttcagcagttaattctttaccatgtatgtctgtcatcagaatccaaacagatggcgataagtatggtggaacctcaattcaactccagttgaaagagaagaagaaaaaaggatattgtgaatgttgcttgcagaaatatgaagatctagaaactgtaaatgtgattttatattttgggggcttgtttcgaaaactgtaatacttgtgttttaaattttagcttgttattctgatgcagatattttacattttaagaactcaagggaggaaatgagtattgaaaatgaatttttattcagcaaatactgagcgtctactacatactgatcactactctgggcaaacagcattgaacaaaacagacttaattttttaccgttgtgaagattatattctgtagggtaggggtgggataggggtggagataggtaaccacaggataaaagaagaataaaaatatagagagagaatattagatcagtgctatgaaaaaatagaacataggaatggggatgttgctatttagcctagacaaggaacacataactgataaggtgacatttgagtagagacctgagagaaatgaagtaatgagacctggatattgagataagtaagtgcaaaggtcccaatttaaaatgattgatgggaccaaggaatagatattgatagtccagactaagtggtagtagaagtgctgaaacatggtcagattgtggatttgttttaaaggtgggaccaagaggatttgccaatggattggatgttgcaagtgagggaaaatggtagtcaagggttactatagtattttgaaccttagcaattaaaaagtgggcttattatttataatgggaagagaagagttgaaagaagtaaagaccattgaggtagcagaaagaaatgggagagttgcaaagggtatataggatgaaaatgggggaactattatagtttgtaaactgatgagcaagagctatggattcaggctgccaggtttgaatcctggctccctggctgtgtgagcttggacagtgtttggcacatagtaagtgcttattgttagctgttatttgaataattttttacgtaatagataggtttgttttggtgtttggttcggttttggtagaagatggtgggaaagttaaggggaaagaataatactggaacatatctgtcttcagactctgaattgaagtttgttttataaaccaaaatatattagtgttttgtgtcagtttttttgtttttatgtaataaacaagaaaactatgattagtctaaaattgcttttaatcagaagctaaagtatctcagaaatatttccccttcctgaaaataattttgaaaattaaaattacagattggtcctgaagttttactttgctggtgtagcaacaaaataatctggaatggatgcttaatttggttctcagaaaatgtcgaggctaaaaaatgaaaaaattgttcagtggttgccacaaagaagaaaattagtgaaagcagatgttgagattagaggttgggattgaaatttaaggtcatgtttttacagttttcatttatatgtttcttagttgctaagagtaaagacattttttttttgaatgttaggtttcataatgattcaattccacttgtatcaagggattaattaacacatatttttgagtactggggagaaagcaacagataaggcggacatccctacccttatgcaccttatggtctggcagtgtagatagatagaaaatatgtatttgcaagtgtgatgagtttcacaaaagtaaagtatgaagtgcaatgggaataaataatgaggttatttaacctagaatgagggtctcaaaaggcccaactgaacacaggtgacgctttaaattaagacttataaggatgagtaagaagaacttaatggaaattagaggggaactaaataaaagttggaaatttttccttcccagaacattaacagagtgaatctgagcttacaagatttgatgcttccttttaaattttgataattcttatttttattactgggcatatataatttgtatatggtaaagtttgcaagtaatgaaggaatacatgtatattacaggatgctagtttttagaaatgtaataaaatcatcaaaatgtaaaattgcatgaaactagggaaatagaaattaggttctttaatggtcatctagaggaagcttctaagtacaattccctccctgatcagctgacagacaaataataaagttaggctggagattccacctattcacaaggaactttgtttcctgtgaattttatctcactttgttgtgaacttgtttacttttggttttgaccactctttttgttttgttttttgtttttatttgagatggagtctcgctctgtcacccaggctggagtgcagtggtgcaatctcagctcactgtaacctccatctcccgagttccagagattctactgcctcagcctctctggtagttgggactacaggcatgcgccaccacgcctggctaattgtacttttagtagagacgggatttcaccgtgttggccaggaggtctcgaactcctgacctcaggtgatccgccctccttggctccccaaagtgctaggactacaggcgtaagccactgcgcccagtggttttgactgctcttaagaatgagaataacttctgtatactctgttatgagcactgggtaattgagatcatttgttttggtcattcccaaatgtgttcttcaattacgaatcttggcttttttagtacttcacagcatttaatgtggttcatgtgtttaatctactttctggattcttttatgttaacttatatttcattcatttattattctataagctctgccttatttagtgataattgcatgaagacaaagtaatagagggaaatgtgttttccaaaatgttactgttgtctctctctctgtatccctttttttttttttttttttttttgagacgaagtcttgctctgttgcccaggcttgagtacagtggtgccatctctgctcactgcaccctccacctcctgggttcaagtgattcttctgcctcagcctcccaagtatctgggactacaggcatgtgccaccaggcccagccgattttttgtatttttagtagagatagggtttcaccatgttggccaagctggtctcaaactcctgacctcgggtgatccgcccacctcggcctcccagagtgctgggattacaggcatgagccactgcgcctgatctgtgtcttcgttttctgacacagctcattcttttcagttccattgtaactacaaattagtacttgtcttttctcactgaagactaaaaaccaaagtagttttactggcttctcaaaagtgacttttattttattttattttaaacgtcttttgaagtctagtaaagggtattatctttggagtagttattggaaacctaattttaggggcatgagaatgttagaaaaccttaattaaaaaggcatctcttgattttaaatacaattttttgatacatgtttttaattttgttttagcaccttctaagtgagcaacacagaaactttgcacagagtaaccagtatcaagttgttgatgatattgtatctaagttagtttttgactttgtggaatatgaaaaggacacacctaaaaagaaaaggtaattagttttatcaacctaagttttaaattctactaggcggccaggggtggtggctcatgcctgtaatcccagcactttgggaggctgaggcagttggatcacttgaggtcaggagttcgagaccagcctagccaacatggcaaaaccccatctctactaaaaaaataaaaaattagccgggtgtggtggttgcacacctgtaatcccagctactcgggaggctgaggcagaagaatcacttgaaacccaggaggcagaggttgcagtgagccaagattgcaccactgcactccagcctgggtgacagtgagactccgtctcaaaaataaataaataaattatactagaatattaaactattaaactaaaaataaacacagttttcctgttcttagaaggaatatgtattttcgggatgtaaatatggttaaaaaccagtagcttcttccctactatcaaagatccttaccttagactacttttagttccattctttttaaattttctttttatgtaaaacttttccttttttaaattttttgttttattttgagacagtctcgccctatcacccaggccggagtgcagttgcataatcttggctcactgcaacctctgcctcccaggtacaaaagattctcatgcctcagcctcctgagtagttgggattacaggcgtgtgccactacaccccactaattagtctcattcttgacactgtagtttagaaggagttggctgacttttcctgtaaagagccagatagttgatattttaggttttgtgagccgtaagatctctgttgcaactaattagcttagcttttttgtacaatggatatgactgtattttgacgcaattttatttggaaaaatagactgacggctagattttgcccacaggctatatagtgtatcagctcctgttgtagaaccataaagtttaccatttactcagactaaaacattttattgaacttttaggtaatattaaggagttttaagaaaacttcctccacttgccccttaggtctttatatttcactaaatatctttgcctaaaccttatgatgggtatgtttactaaaggtactgacaggacttttaagtgtgaatacagtactgctcaatgtacaccaactgcacattgacaaaaattgtcctgattagattattcctataaacttaaagggatggtttcatatggatataccctagaggtggtgataactcattaagttagtctttattcttagactaatcttacttaagacataaagaagattagaaatgtgataacaagatacagcttctgaaaattaaccagaaagtttttttacttcaggtaaaacagttcttaaattccatatttctgtgacattcagaatggtttcatgactgacttaatatggatttgaagagaaggcatatttccaactattaaaactatgtgggctactgtgcccaggcagggtgtctcacacctgtggtcccagcacttcgaaaggccgaggcgggcagatcacttgaggccaggagttccagaccagcctagccaacgtggtgaaagcccatctccactgaaaaaaaaaaaaaattaggtggtggcacatgcctgtagtcccaactacttaggaggctgaggcgcaagaatcacttgaacccgagaagcagaggttgcagtgagctgagatcaggccactgcactccagcctggttgacagagagactctgtctcaaaaaaaaacaaaaaacaaaaaaactatgtgggctactctaagaacttataattccctaaaaactcagtctgcagcaaaattctgagctagtactggttgttccttaattgtcacttctgtgggcaagtgtcctaaacatcttggacttaaaagccatgttagagtagtttttttttttttttttacatttttttattgcccatttgttcaaagagaattgtttgtaagtaaatgtatgaacaagataaaaaagaacattctggttgaaggggcaggaaaaattgtattatttctcacagttaatctgtgacatgcggaacacaaaatgtaattggtgagctattaactttttctctaattgtatattatttaggtttgtctaatacaaactggaatttcagggatatcaagatgctccatgaagaaaataattttaggtcaaatatgtttgaagcttaaaagttacaactttgtcacctttgaaagtataaagatactaagtttctagctcactttgatattaaatattcttaaatgtaaatttaaaatatatgtttttgccataggtttctcagtaaatacttattctccacattgctaagtaaaatgaagagtaaaatgtgcattaatgtaaatcaaagcacagaagttaagaaattgttcagaataatgaaagcaaaattaggggcaggctcaaatccctttactatcaatttctttcatttacatgattaaagtaattttaaatgtcaaaattcaggatattggttatctgggagggaggcagggaatgtagaggagaagagaggtacactagggttttcagctatatctgaaaagttgtattactttaaaaacagctcaagtaaatttggcaaaatgttaagatgtttgtatttttgtaaaatttcctaagttaaataggtttcttaaagattatataatgtttttactaatttaatttctaactactcaggaatttgttttgatagcaattattttaatatttttcttctatttttcctacaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaatattattaggacaaaatagaaaagaaaatctggaaccaaatgctgaatttgataaaagaactgaatttattacacaagaagaaaacagaatttgtagttcaccggtacagtctttaccagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggggaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtgcatacacgcaaaccctgtttccattgtaaattattgttccattttctatcacaaatacatgtatgtatgtgtaaacatacgtaaggtttcgtagacaacctttgaaaaatctaaatggaacttggaaaattatttgcaggtttatttccctttagttatcagtgttccccaaattttccaaataactgaaaggtatgtaaagtcactgtatgatcctttgactttaagagtaacagtgtctggctgggcgcggtggctcacgcctgtaatcccagcactttgagaggccaaggcgggcggatcacgaggtcaggagatcgagaccatcctggccaacatgatgaaaccctgtctctactaaactacaaaaaattcgctgggcatggtggtgcgctcctgtaatcccagctacttgggaggctgaggcaggagaatcgcttgaaccccggaggcagaaattgcagcgagccgagattgtgccattgcactccagcctggtgacagagcgagactccgtctcaaaaaaaaaaaaaaaaaagtgtcttcaatttacagtggtactctgggcatcattttacattaagttatacttactaaggagaaaaagtctgaacccttcagtaaaagttgttaaactatttgacactggatattggacttttggaacaccacatggtcttcataatgagtattcagcttttttcaagtgcttaaatttcagtttacttggaataatttcagtttacttgggccaccacatacagtttggattgtgctgtgcagctatgcagatgggcacccagccagtgagatgaaggcaggttatttgcagca

SEQ ID NO: 13191 - DNA, 57002 bp, Human
acaaattttcctccaaaaagttactttgactcatagtcaatttttaatcttggaacaacttcttgctatcacaaatacttcaagtgcctaaaacatcttccttaccagccaatatctcccgctccactctaagaaatgcaaactcgttcaagtttaacctgaatgcaacataatttggaatctttcattaaaatatatatcacacattttgaagccaaacatattttaaaatacctgtttttggtgatttggggtacatatgcttatcagtataacatattttaaaagatttttttctacatactcaaatctgtgttccattcattttttcactcccacacctttttgtctatccgataattcaggaatctttacagaaacatcttgtttccattgaaataaacaacaagagtaggaaaaagagtgaagcgaaatggttctaaattctatgcaccaacaggcattaaacatgcataaacttttaaagagatgccaagactcactaaaaaggagaaaaaaaatacaacgaaggtttctgagtagtttttagttactcaatttaaaaactttatcttgtaagcaaactttaacatcatccagagcatcgcacttatatatgaaagaaaaagttctttatcacaccttcagaaattacaactacaaattcctaatcccttatttaaaatctttttggctagatatgtttcaaaattcagaacttttcttagaatagtacgtctgccatatattatgaaacacttccagcaagctgtactgtaatcaaacacaatatttctgtagaaaacttatgaatatttacacaaagggaacattcagttacacatagcctcacttcccttcaggtcaaactttactgctaaaggagttagaaacgacagacaaaggaatggggcctgtcatgacatgttaatttgaaatctaaatctttatctttgataactagttcagagtcagtgtaaacatttggtctttccttccacaaaaaaatgaaacagtgtatttaaaattaaaaatgaaacagtatattttatttcagaaggtaaaagcaaaatgaattaatctgtgaaactaagtcaatcacattatgatcttctagaacttgggtagctccactctggttaaagattccatttcttggcacaacagtaaaagacatcagataggcccccaagcttgcagggtaagcatccctggggtattcaaataacttgggtagcaatgaagagctgcagaagagcaaggagacccgagatgatgtagtgtgctgcggcatacctgagttgggcaaactcagcctccgaagattaaaggaaagagcccaagtaggaatctgtgtgatcactgttcttttgccaagacacggggtggacaataagattcctttacaaagcactggtgtaagtgttcgcctggtgctgcaaaaagcggctcactgggaatggggaggagcgtgtggtaagccagacctgcggcgagaagttgggtgaaaatgggtcttaaccatcgcttcctgcatctatcccagagggttgggtaccttcgtgggcggagcgcggcctgcccagagtgccttctagatcctgggtcaggcgccaagctccccagcatcatgcaggaagctgcagccccgcagagttaggacagctcatttggcacccggcgagcccttcccaggcccgcagcccagaatagagccggggcccaagacgcccactggagacagggtcgggtcccactaccgcgcaggcccggctcgcccccgacgtcaggcacggggcgggacccttgcagctgtccgtccagtcccgttccccggaaagtgaggggcgggaccctcgcggctttctatccaatcctgttccccggcgaatgcggggcgggaccctagcggccttcagtccaattcccgcacctttgaggcccaagggggagcgagccggtgctgctgcaggctgaggctgcggcagaggcggcgaggcgcgggcggtgaggacggacaggtccgttgaagcagcattccctccctcccctaatccttcaactcgggggcgggggaaagttaagtcgtgcagaaccgcaaaggtgcctggatttggtgggggagtagtgtcatcaagcatctcgcctgctggggtctcaggggtaccctcaaggttgggccgcggggctgctccgttgtagtgcttagatttctctcacttgatggcctcttgagtgcagagttgctcttgggttggtgggaagagcctccgagctctcattgccctctgctcctgcttctaccccttgccactctgcgacgaacctgttacccagccactgaaaacgtatcctctaccctttgaacccgtctaatggaaggtgtacttgtctgaaacctacttaattgtatgatcatttactcctgctctctagcaggtggactatttgcgtgtgtttgcagtgattcacgaaaagtttgtcttgggaactcccaactcctagtttgtctgcattccaccttctttcactagcttgttcatttctttttccctcttaaatatttgttaagcttgtttctttcttcccacagtcaccgacttagtccagttccctgtgatctcaaaacaattgttgcagcaggctcctggcagtctcaagcagttcatcttcttggtgtactggtatgtgacaattccttcacgtattgttcgtggttcttttccactttctgtgaattcatatctaattgcccccagaaagtcaattctaattaaatctagcataatcattttcttagtgctattggaaccatcttatttaacttaatctttgtggttgagaattcaagaaaactcttcaagaaagaatccaataatttatatttttaatgtgtaccggttggtgggttaagcactatagtgggtatgtaactaatactcttgcttccagttttctagagtctattaagtggcacagaggtaaacagaatagcttatcttctctgtatgtgtgtactagtcttctattgctgccttaaccaattacacaaatgcaacaattaaaacaacacaaatgtattatctcatagcttctgtaaatgtgaagtttgggtgggcttagctgagtacttggcttagaatttcacaaaaccgaaaccaaggtttctgtagatttggattcttttctggaggctctaggggagaatccacctccaggctatttcagattgttggtagaattcacactgacatttctatatccttactgtttgtcagcctgagcctctttcagttctttaaggccatctgcatcttcaaagacaccacaaatccttctcaagcattaaagcagtcttacttgtctgccactggccagagaaagctctttgctcttatggactcaagtgattagattagttccaattcgataatatccctattttaaggtcagttctgtagagaatatcacaatcacaggagtaatgatctcaccatattcgcaggttctggggattagcaggggtggaatcttgggggccattcatagtaattgtgcctaccacaatatggtggtttcaggcaggattattttgtttttataatgtgctttcacaggcattgaaaacaaattctgactttattgaattgtatgattaaccactctaagataaggaaattcacttaaagttggttgccctaggggcacatggctagaaagtggcagagtctgtacttggatccagatctacatttccattaggtacaaacccatttttatggatggtcaaaatggtgtgcagccaaagtcaatagatagaaagaagctaaagaactttgagttaattattatttctcattttcaaattatctctttatattagtggtacaggctaagctcttctccctacaatagaaagcccaaaatacaatggtatgaataaaatagaagtttttttttttccatacatctagaggtaggagtccaggactagtagggagattctgcaatcctgcatatatgacttccataaatgaggccatggtgctgtttagttcgtcactacctagcaggtagtaaaaaggagggaaagtgcagggagaacacatgcattcctttttgggagcatgacctggaagtgacacacacaaggtcatcacaaagccacactgagctccaagagagggtaggaaagataaaactgggggctgtatgcacagctacaactcaggattctgttaaagcagaggaaaacaggtattagctgaaaatagtctcttctgtgtccatgtttttgatagtgttcgattctgtaacctatgagtggaatactttgtttagcgttgctatcagttttaaaaaatagtttttgagagaataggaagttcaaattcaatattaacgttctttgatttctcagttgctattttaacatataattacatttaatatattacattatttaatataattaatatatgataatttacaaaggctttgagaaacctcattttttatttagcatttgtataccttattcacattttgagttagatttctttgatagcaattaatacacgtgtcaatatgttcaagattgctttggaacacttgagaccattctgtgtagacctcatacgacctgtgcaattaaagcagcttgtcatatgatttatgtattctataataatctttaattctacagttggacacttccacacctctttgtactttgtgctccaaagttttctatatcaatgcaatatcaacacataatccttttctatacatcaaatactatctacccactaagatttactgcaggttcccttaccttctatcatgttgttttgtataggggaaagattgtagtcttaacagatctgggtttgggtcctgtgtttgacattaggtaagttactaaatttctgagttttgatatattcatatgtaaaattgcaaagaatgccacctttcagagataacataaaagttagagagctaacacatgttttctgtaatgcaaactggagtacctggcaaatgctaggtgttcaataaatggtaactaattataccagtcccactgatcactctttacttctagcactttgtgtctacacattctttttaagttggttttctctatctgacagatttataaatttcataaaagctggtaccaagtcctagatatgctgtggtccctaaatactggtttagtgaattgtgaattgtacctaggatacgtaacactatctatgagattgaagttgtgagggctctctctcttttctttaggtttcctattgtgattttatcatggaaaatcaattggctaaatcaactgaagaacgaacatttcagtaccaggattctcttccatcactgcctgttccttcacttgaagaatcattaaaaaaataccttgaatcaggtatgttaataatcttttagtatatattaatattattagtaacttagaaaactgtgatactgttgctggagaaggggtctcgatccagactctaagagagagttagagttcttggatctcttgcaggaaggaattcaaggtgagttgcagagtgcagtgagaagagacagtttattgaaagcttctccattatagagtaggacatcctcagaaagcaagcagactgtctttaagtttttcttacataggggtcttatcgatgtaaagactaagctgtgcctatgtgagggtgagcagacagcatgacaaaatttattattctgttgatttaaagaaaacaatccttgacattttagtgcatgaatacatcaaagaattatgttaatcatctcaaaaacatatattgttatgggtattgagacatctggactttctactgttgtaggagtgtgtcattgtaagtatctttaggttgtttcctcaactgtaaatatcttatgactgggtcatgactggcaaggaacgtgccttgctagtctcaagatggagctgaatttaaaatggtgttactctggctctcctgagctcctgcttccccaacatttccccctctacttatgagagaacccttaaccttaaggggagataaagggtgaaggttgttcttttgtaactccttcctggaggcagtagatgttgatggttgggacagggtcttctcataatagtgtgcagtgagcctcttcagggagtaagggagctccttgcttgcatgatatcccaattgtttctagaaagttaatatactaggttagtaaatagaaaggtgaaacagctgctaaactattttatcttgcaaccctatacaataaacacaacagaaataaaagcacaataactaataacaatgaatattataataccaagcatactgaaaagaaatgctttccaagtgctggaaagctcatgaaactatgctgttatggggtcataagaccgggaatccatagccaaaatacaagtttctagagaactcatgtcctgggatatattatggcagtaatcaggaacataatattcagttttgttcaagacacaagttcctcccttggctgcagttaaagaatgtataaagccatatggttttgcaagcccactggtcttatttgggaagtttctcctgtcagaagtgtgatagcctgatgagtgtcattgaaagccgcaccagtatgttttgctagagcttttatttgtaattcaatgtctatagctgctgcttgaagagagaatatggccataggataaaaccaccaagaagcctgttttgtcatcaactatggtgggccttgactatttttcagttggtgaggaaggaatttagatgtataacaatatgtcgtagaaggtaatgttgacccctagtacattgtccagtccagttgtaaggtaggtatagccaattgtgagacccatgtgcccataaccatccccaaggagaaggatgagcatgcaatcttagagatttattttgccattctgtccactttgattagttaagaccagggtctgattgcattgttgggtggcaaccaccccatgttgtaggtttcagcctggaagtggctggtgtcatgtctctcaaggcataagagtactttacctgtcacctgaatttgggtagccattaatcaactaagcccatcaaaaatggtatagcctaaagtggtgatgttatttagttatctacagaataattgaaaaaggtgttttttttgtttgtttcagtagaggaagggaaggatagtggctggtgtctttttgatatattagaaaaggaaatattggctaggtgtggtagctcacacctgtaatcccagcactttgggagactgaggcaggttgatcacgggatcaggagatcgagaccatcctggctaacacggtgaaaccccgtctctactaaaaatgcaaaaaaattagccaggcgtggtggcgggcccttgtagtcccagctactcaggagcctgagacaggagaatggcgtgaacccgggaggcagagcttgcagtgagccacgattgtgccattgcattccagcctggacaacagagcgagactccatctcaaaaaaaaaaaaaaaaaaaaaaaagaaaaggaaaggaaagcatttatctcttataaaccattcattggaattggaatggcttaaattagcctatttgatatgccaaggtaagcctgaggttgatgaaagaggtaattcactgcgtacccaacagtttttctggtttagaagggaggccgtagtttgtgcccattctgtaaacaaattagctctaatattataatagatcaagtttaatattaaaactagtaatttcattttgagagtagtacttatccactggatggattctttttttgaagagaagccacaggattctttattggctcacaagagtgtgctggaacagtggtcaccacgttgaatgcctgtgggactttatgagaggcaggtttaattttggatgaatgtacgcaagtgtgtattcccttactccactagaggtacttagaagcacttgatagggtcctctccactttggagaaagttgtctataggaggtccttctttccaagtctttaatatgactaagtcacctggttgaacagcagagttatgaatatttatggaggtggttctgacacatgaatattgaacaaacgtgcatgtaacatatgactgtttaccctgcaatagagacttaacccttgccttacgtgatcttagattctatttataatttggtattttattgccataaagagtctgttttgtcaatcttatgatttctattttaatgctaagctagtcagttgtgactgaattccaagaagaggaaagatatggcaagtcatgtccaatctccctgcttcccctcatggcctgaattagttttcaggtgttttggatgccctttggccaagaagagggtccattttgttgggaaagggcttagaacttttaaaaacttatttattttagtttatagttccccttttttttgttaaggtatgccatcaatggccaagctcttattttgtccagtattgatgtcagggtggtgtgctacctgccctggatccatcatgtcccttggtgggaccactatggccaagggacttaaacaaaagacttatggccaattaaactttctaggccagatgggaatggaggtgggcaggcactccttaaccttaaaaccccttttaagcaacataagagccaaaagccaaatgggacggttataaaatttgcttatttataaattctatacattaagctattttaatcttgacttgtagcaattagccatataaaatacaacattttgttcagctatagaggcagtttgcctgaccttgatttggagggtctgaattgattttattccccacaacaagcccttacaatctcatgtggtagtctctgggcctggaaggactaaatagtttcaaattatagaggaaaacaaaacataaggaattaatgttttaaacaaaaatgtcataagccctacctagttatgagaatgacatgaaaagaagcccatacgtagccaaatacttaaattatttaatatcaaggcatagaaaattatattcagatataggcaaaattattaaatgaatcttaatgttttgaatacaggcctgtccctatgtctctgtctgtaggtctcatgaaaatagtttactttgattgtccaggtctaaagacaaggctttgattagcttcagcttgctatcagatactggcaggagtcagtgccttctttagatgagctatatgtactcaggagtcaaagccctgtaactgtaaggcacaaggattagttaatagcacttgataaggacccttttaaggaactagagggagtcctttaacggattttttttcttttatttttattttttttttgaaacatggtctcgttccgttgcccaggctggagtgcattggtgcaatctcagctcactgcaacctctgctccctgggtttaagcaattctcccaacttagcatcctgagtagctgggattacagtcatgcaccaccatgcccagctaactttttgtagttttagtagagatggggttttgtcaagttggccaggctagtctcaaactcctgacctcaagtgatccgcctgcctccagttcccaacatgctgggattacaggtgtgagccactacgcctggccctttaactgattcttttctagtatatataattatcagggtggaggtggtatgtgttaggccatttttgcattgatataaagaaatacctgagactgggtaatttattttcaaaaaagaagtttaattggctcacagttctgcaggctatacaggaagcatagtgctggtatctgcttctggaaagtcctcaggaaccttacaatcatggcagaaggtgaagcaggagcaggcacttcacatggtgacaacaagagcaagaaagagagagtgacagtgaggaagaggtgccacacacttttaaacaaccagatctggtgtgaatcagagtgagggctcacttgtcaccaaggggacagcccaagccattcttgagggctctgctcccatgatccagccacctcccaccaggccccacctccaacactgggcgttacatttcaacatgagatttggaggggacatccaaactatattatggtgataatggagttcatggtgtgactaaaagctgtaaaaagattctacagtcttgtagtgattaatttttataactttaataaatcccagcaataagactaagtcagagacttaatttaggattttgattttgaggctgtttattaaacatgttaaaaggctgaaaacatttgatcaaaacagaagcagaggtcattgtaaaataatagttactcatttagccaaagtgataatgaaaatgctttagaagcaatacagaaggttacatgatgtaaaaaccttaagccttttaaatcttagttttggcaaccaaaaaaacctaataaagacagcataggaattatacaatcttgtttcttaagacagttaccaaaaaggcaaagaaaaattctgcagtgtgactacttctgcttatgggaagcccatttagataacctggacatcaaacctgatgaaaaaagtgcttggatttgactggacctaggaagagtatattcaaggttatgattatagcataggattacctcactcttaggaacagcattagttttttgattacattgacaatttagatgtattttaaaagccaaaagtacagaatcaagttatactagaggtaaacattgcttttctagaccttcaagataaaatattttagcattagctcataacaacagtaaaattagaactggagaaaaaaaaagttgatgagaaagctgaaggaaagaattatctcagacctcaaaaaagcaaaaagcagtgagacacagtaaaagctgaacttctgggatatgattctgagactttttaaaagaaacagtttataaaagtaaaagtaaaatttcttgtaattttattaagagcagattaataccataaaaaaatcttgttttaacatcggggaccaaaatttagaaagacttatttataaatgattttcttttcactgtaaccaatttaatcacatacaaaattcctttcatgaattccccttcacaaatcttatcatgacttacacaaaccgtctatgacatgcttggactttctgacttgttctaaacttctctctttcctaaataatcagtcattttactttaggacaaaaatttaccatacaagatactttttcatacaaaagtattcccttctgtataacctttcttaccaaaaatatgtattttttttttttttgagatagggcctcgctctcttgcccaggctagagtgcagtggcaaattcacggctcattgcagccttgacagcccaggctcaagtgatcctcccacctcagcctcccaagtagctgggattatagacatgtaccaccacaccaggctaatttttgtattttttgtagaaatggagctttgccatgttgcccaggctggtcttgaactcctgccctgaagcaatccacctgccttggcctcccaacgtgctggtgttacagacatgagccactgggcccggccaaaagtacatttttatattcataactttcttcacatctctctctccctacttgttcctttttaccttctttcataggtaaattttaaataagctctaaattatataaaattattattatttttcaacttggagaatgttcacttccctcaattgagagatgctgaattaaataacccaaagaatgaaaatcatcaagaccagaaaaaaatgacaggtgtaaacttcagggcatgcaagcacagggcgacatgtgtcactagcgagacacagacagcaaataacagccgattaagaaacagtaggtactgacaaatacaactctgagactcaaataggttatccaactctgggtggggcctctaacctcaacctggggaatatgagtattcctgtgtctcctggggcctagaaggctgagtatattgcaaagtatattgcagaaaggaaaagggacaacaaagggaatggaagagacaacaaagagcactcacctatacatgaatccaaaaacttaggaagcaagaaacctagaactatttgtcagatgttagcattttatagataaaatcattccacaattttattttattttatttttctgagatgagatctcactgttacccaggctggagtgcagtggtgtagtcacaggtcactgcagccttgacctccccagctcaggtgatcctccaacctcagcctcctgagtagctgagactgcaggcaggtgccaccatgccctgctaatttttgtatcttttgtagagatggggtttcaccatgttgcccaggctgccaacattttagaaacatgtttcccatattataaacatttcttaattggaaatgacccagatatccagtgagtcatgccaggaaagccatagaccaaaattttgggtaaagtagtcttcatgaaagtttgagggttttttatttttgtttttgtttgtttgttttgccttttcacattttgtttttcagtttcaaatgagtttctaacatgtacatttcttttacagttctggttgaactgtacaagaaaaacaaaatctctaagtaacctaaacatcaagttttatttcaatactagtagactaataataacagattcaaatcaggcagaaaagaagagaaaaatagagagctttagaagactctgtttaatttcatagttgcagggcaaaagtaaccaccagaatgataacaggctgaagcttcagataagagaatgagactccaggtttccacagggggcaagcagataaagattgctgcctgttttaacatggggtgtaaaagcatctgagtcctgcaatgtttaagatatagcaagaacaggctgggcacagtggctcacgtctgtaatcccagtactttgggaggccaaagtgggcagatcacctgaggtcaggattcaagaccagcttggccaagatggtgaaaccttgtctctactaaaaatacaaaaattagctgggcgtggtggtgggcacctgtaattctagctacttgggaggctgaggcaggagaatcgcctgaacctgggaggcggaggttgctgtgagccaagattgcaccattgcactccagcctgggtgatagagcgagactctgtctcaaaatatatatatcaagaacaaatcttgtaagtcctcaggttccccatgctatcctgagacatgacaaagcaaacgaaaaggtgacagtcagaaggcaagtgtggaaagtgaatgcagtaaacctctgggctggccataggggccactgtaaagctgcagtaaagcaaaggcaacaagttgggaagtgatgagaagtatagctttcccatatctggcaaaggggacaaagtggattagtccaaagcatatactggcgtacatcttgcaaggctactttaatttttattataccccagggactctcaccccattgggctgggactctaacccaaatattataccctagagactctaaccccattgggctagaaatattatccttgataggatgccaagacagaccccatttatcagaggtggccaattagtgctgtgcaggctgaatctcctcagcatgggatctcatcctaatgtccctttgtagtcaccagaacatgctaccagataaggggtcttgatccagatgctaagagagggttcttggatctcacgcgggaaggaattcaaggtgagttgcagagtgcagtgagaagagacagcttattgaaagctactccattgcggagtagagcgtcctcagagggcaagcaaaggaaggcaccatccttattttaagtttttcttatatagagcctttatctatgtaaagactaaactaagctacgtctacatgtgggtgagcagacaacatgacacaatttattattctattgatttaaataaaactatccttgacattttagtgtgtaaatacatccaaacataactgtaattatcttgaaaacatatattgttatgggtattgggatacctggactttctgctgtttaggagtgtgtccttgtaggtatctgtaggctgttcactcaactgtaaatatcttcttaatgtgggtcatgaccagcaaggaattgtgccttgttagtctccagatggagctgaaattaaaacggcattactctggctctcctaagctcctgcttccttaacaacactgttagaagttgaaggtttaattgcttctttatctagacttgtaataaagtataggtgactcttgaacaatgcagggctggtggtgctgacccatgtgtattagaaaatccaagtacaggccgtgcgcagtgcctcacgcctgtaatcctagcactttgggaggcggaggcaggtagatcacgaggtcaggagatcgagaccatcctggctaacacagtgaaaccccgtctctactaaaaatacaaaaaaaaaaaagagccgggagtggtggcgggcgcctgtattcccagctactcgggaggctgaggcaggagaatggtgtgaacccaggaggcggagcttgcagtgagctgagattacgccactgcactccagcctgggcgacagagcgagactccatctcaaaaaaaaaaaaaaaaaaaagaaaagaaattcaagtacaactttataacgtaaacagttgattaacagataattttatgttatatgtattattttctgaattatttaagttagagtaaagcaaatgttattaaaaaatgataaggaagagaaaaatatatttattatccattaagtggaagtagatcatcataaaaatcttcatcctgatggttttcatgttgagtaggtggaggaagaggagggactggtcttgctgtctcagaggtggtagaggaggtggaagtagggacaggagaggcaagcacactcattatcaacttttattaggtataaatggacctgtgcagttcaaactcgtgttgttcgagtcaaccatgtccttaaaatatccaactttttttctctctttatgttaatttttccagagtttgaaaagccagatagtgtaaataggcttgtgatgaaaaatgcagtcctttgcccatctccctggctccctcccgacttgctaatcccattctctcaagcaaggatttccaaatcttttgtttcttttccgccactttcatgttgtcaactcttaattttattgttctgctctgctatttaatacagtactgtgttttacatatctgagtcttaagatttgcataagttagtaataatagaggtgagttggtggtacttggtctaaataccttaatacgtatttttcctttctagtgaaaccatttgcaaatcaagaagaatataagaaaactgaagaaatagttcaaaaatttcaaagtgggattggagaaaaattgcaccagaaattgcttgaaagagcaaaaggaaaaagaaattgggtatttgttgttataattgaataatgatgatgtttaaagaatgataaataaaaagtgcatagtttttatttttaaattattgctgtaaaaatttttacagttattattgttattttcataatccaaaagaaggaatgaatcacttaactttgggagttttcagtgggtggattcgggaacttgttaaaatgcagatttgctgggataagtgattctgattcacatggctggaatgaggcccagagattcttattttaacaatcacttcatgtggtttggctgcaggtaatctgtagaccatgctgaaggaaaacattttgtccaggtgactagcttgaaaaatcagaaacactaaaatagacatgtcacataggtggcatagaaatattttcgtagtacaatggagaaagggaatcattaaaaatcagagtggagaatggttatgtatattgtatatttcagttagataaattgaggaagctagtataataattattgaaggtctcaataattttccacaaaattctttaacttcttcagctcaaccatttctgtacttctctactatgaatcagaggatgaggttgtataattcaaaagcattgccttagtctagaaataattattgtacctatcatttagttttagaaataaaaagcaagctgattttttttgatgaaccatttatatctgtgatggaataataaaatttcacacttccggattcctttgttctcaattttgagccttgagttgttttaattaaagaggggtaaaggtaaagaagttgttgttttatctgtatcttttttgtttatgtctctttctgaattactaattatagtttataacatcactttcttcaaacaagactccaggtaatttgataagatgtgcttacttatgcatggaattcaattgcatattgtgaaagagggacacatagaaaacagtgtctgtgaaaaatctaaattactttgaagcctactgaaaacttttatttatttgttttatttatttattttttggagacagagtcttgctctgttgcccaggcttaagtgcagtggtgcagtctcggctcactgcaacctctgcctcctgggttcaagctattctcatgcctcagtctcccatgcacctggaattgcaggtgcgcaccaccacacccaactgatttttgtattttttgtagagatagggttttgccatgttggccaggctggtctcaaattcctggcctcaagtgatctgcctgcctccgcctcccaaagtgctgggattacaggtgtgagccactatgcccagccagtttttatatttctgatttagtattgcagtttttgtttggaaaaggaaaattgttaatgccttaataactgttattattaggtaaggatttattgattatctattatgccccaagtactctgaagaaacacctatgtactttattgcatacttgtgactacaatacaatgatatttctgaaggtatcttttggtgctttcttgatactcgtttttgatagtgtagttaaaacaaataatacctaagatcctatagctccccgctgaaaagaaattatcacaataacatttctcaatatctatgatgatttaaaacaagaaaacatgtttttatttatttatttttgagacagggtctttctctgtcaccaaggctggagtgcagtggtgcaatcatagctcactgcagccttgaactcctgggctcaggtggtcctcctgcctcagcctcttgagtagctaagactacatgcaggcccagctaattaattttttttttttttgtagagacagggtctttctatgttgcccaggctggcctctaggtcctggactcaagtgatcctcccaccttggcctcccaaagtgctgggattataggtgtgagtcacctcacccagccaaaaaacatgtttttaaatgttgaagaataattaaagaacaaatatagcttgctttttaaaattcccagtagttacacattcatgtattatgaagaacattaagctgatgttctcaatttcttttagctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaagtaaggacacatgtgaatttagtgacaggcttacctgaagtctcaggtagcaaaatgttgagaagcttaatttacttatttggggatgaacacttcagttgtggctggtttttaaattttataatgactttttgatcaaaatcctttttttaatagagaaaaagtgcctgttcataaagttggaaatactcctctagatatgaatcaattccgaatgctattttctacctgcaaggttccaggaattactagagactccattatgaattattttaggactggtaagtaaaaatgcagatatcgtttttagtaaaggcactggaatttgggtagcctactatgacgtgatggaacatacacttttgaagaatattactgttgggactttgacaaagaaaggttttctgtgagccttatatttgaatcattctgattagatgtaatttatgggaacggattttctaaatgtatcttacatggttcaacacaaacctgatgcttatatttcatcatttgaaagtttaaagtttacttgaagagtagaatcagagtattaagaaaatcctgaaacatgaaacatatgatctggatgcttctctttctaccctcattttttattacctgaattgtctttttgagtgtttacttatatgtgcttatcatgccacagtctccctgtgagtctgcttgtccctccaccttatatgaggtaaaagcctggagtcactcttcctttttttttttttttttttgtttgagacagggtctcactctgttgcccaggttgcgacctcagctcactgcaacctccacctcctgggcacaagtggtcttcctgcctcagcctcctgagtggctgggactataggcaggcactgccatacctggctaattgtgtattttttgtagagatggagtttcaccatgatgcccaggctagtctcaaactcctgggctcaagcagtctgtccgcctcagcctccagaagtgctgagattacaggcatgggccaccatgcccggcttggagtcactcttcttagagacacatgagttcagattgactcatcaatttttttttttaaactggcagtttaatggcagtttctgcttggtgtcctagcttatcttgaaatggaaaattctgctgtggtaactgtttttttcacagtttacacttactgaagagtataattgtgaatggatttttttcttacataaaatgttatttaaaagtaaaatatttatagccaatcatgctcatagtatgaggggtatgagcttactttcatgtagaactcaactcttctttgtaaacttctttacatgcttgagatatttaatgtcctcaagcccacatatatttaccttgatgttaccagtgaaacaattaaaagattagggaaactgagttattcatggtctaaagtttaatgtgcaaatatgaatggaaaaaatgaacaagataaaattaatgtaagaagagcaatagcaaaaagagaaaatatgcatatcagttaagaactaatatcaatagacctgcttttgaattgtctttatcgcttagtaggtatatccttagataaggtaactcttttgggttatagtttgtaaaatggggattcattaataatgcatctcttgatatggtgattgaagctgacatagttattatattttggggcttacatgtgaagacatgtagagatagggataaagtgtgaggtagacatgaaaaaatcagaattcatggcaaataatatacagagagttcaaataagattagtaactacatggcaattttatattagatagtcagggaaggcctctccaaggatctgaatgataagatgaacctgcagagttttttggctttcttttgtttagttcacttttgttgttgttgttactttttgtgtgtgttgagggcagaatgctctgggcaggaataaacttggcaggttcaaagggcagtatggatggagcagagtacacaggagggagctggatggccagattggaaaggtgactagaaggtagatcatatagtactttataaaacaaggtaaggtttttggcttgcgtttaaaatgtgaacagaaactattagtgagttttgataaaaagaatgatgtgaccagatttatgctttaaaaaagatcattctacctactgtttgaagaatagacttttagaggtgagacaagtttataagcagggaggtcaattagaaagttgttcttgtattccaagtaagtcatgataatggcttgtactaggattatggcattggagtggtgagaagttatactctggatgtattttggattttgggttagcaggaatattcatatattggttgtaagatataagagaaaaataggaatcagattacttcaacatatttggcttgagcagctaacagggtaggtgggtacgtaggtagattcatgaggtgggaaatattgggaggagatgatttagggaggagaagcaagtggtctttaaaccgtcttgaatttaagatgccttttagacatctaagtggaaatgtacataggcagttggattcaagatttgtagttttgggaatagctcaggactgcaaattacagacttaggagtcatcactaccaggcatagaaagcaactgtaaatccataacagtagccaaggttacttttgggacatatgtaaagatgatcagtgctgatccttatcacaggttcaatactgtattttccaatcagaggaggaggagccagcaaaggagaccaagggaagtaggaagaaaacaaggacagtggtctcccagaggccaagagaaggaagtgtttaatgcttctgagaagtcaaatgaggtaaaaatgtgaccattggatatgtaaacatgatgtggacagaggttgcccttgacaagagcagttttaatgaaagttgaagagggaaccccagctggaagagatgaaagcagattgatgaagtggtggtaacatttggaaataatgcttgcaagaaaagttttgatgtgcactgggagatcaaaaataattttttaaagattgtgatattacatcataggcattgttacaggagaggaggaaaaataatcttgcaggggagaagataaggagccaaagtcattgagaaggtaaaagccaagaggatcaagagcagaaaggtggaggggttggtctttgacaggatcaaagaagagaggcaattaggagggaatgcagaaagtgtgaatctagaagcaaacagattggccagttttgttgtaggaagatgaggaggtactttttattgcttatgtttttagtgaaataagaactgaggtcatccactggggtggatgatttgaggagaaaggaggtttgaaatagtctttttggaaagtggaaaaaacaaacatgctgtggaaataatggagttactgaacactgctgagtgcccatttgagatgtgtgttcatgcatttaaaattagacgagatgacatgctgtgtttttttcttcagcatcagtgaggggcaggaggggcaggtgcaaaggaagaggggctgaaggattaaagtttttgtaagggagaaataatttggggccattgaatctatcatgtgtaaagtgaaaattgggccaggcctggtggctcatgcctgtaatcccagcactttgggaggcctaggtgggcagatcacctgaggtcaggaatttgagaccagcctggccaacatggtgaaaccccatctctactaaaaatacaaaaatttagctgggcacagtggctcgcgcctgtaatcccagctacgcgggaagctgaggcaggagaatcacttgagctcatgagtgggaggttgcagtgagccgagatcatgccactgcactccggcctgggcggcagagtgagactccatctcaaaaaaaaaaaaagagagggagagaaaattgaaaaaatgatgtgtgttgatgggatgggcagaatttaagccactgaggttagtctcaataaggaggctataattaaaactagttttttgttttttgtttgtcttttttttttttttttggtctgtcacctagggtggaatgctgtggtgtgatcacagctcactgcaacctcgacctcctgggctctaacagtcctcccacttcagcctcctgagtagctgggaccaggcacatgccaccacacctggctaatttttgtattttttgtagagaccgagttttgccatgttgcccaggctggtctcgaactcctgagctcaagcaatctgcccgcctcagcccccaaagtgttgggattacacgtgtgagccacagcacctggcctgttgtttatttatttgtttttacctaccccctaggagaccattaagactaattcagtcatacctttcatccctgtttaccacatttacacaaaaagcccagactgttcatgttatcccttgtcagctggattcacggatttgtgcatggtctaatttgatccaaatttcccattgctctgatctaccctcacgacttccccaaacccttctgctgtactttctggagctcacgatcagcaaaatccattatatcctcaaccttttctctaaaagatgttactaaagcttgattattcattaagcttactacttcccctgtaccctcgcaagggggaattttttttttcttttatatagcactacagggcctgtgggaggtgttggtatcctttttgtttccctctgccctttctgttttcccttcgtccttaacaattttagcctttttggggaaaaaaaaatgccttcaggttatatcaccactacattgttgcagtgactttcctcctgcccattccccttcatctattgattgctttagctccagtgcctgtctttctttccattactacctcagtcatattcttgatgattttagctttcaattgtagacgatccataggctctcatttccttcagtttatagctctaggaaactacatctttcagtactccaactcagctgttcctttggccacattgtgatttacagtttaatgatgctactgctctcttcatggctccattcctacttccccgtcttcacttctttctggctcttcaccatcattactcccaggcatacacattcaaatctttgctacctctccccagtactgatgtggtaaaacctaaacatcgtttaaaatttaatttgtcttttctctacatatcaaagatacctactctagcaatttacttggccagagaaaaccataaaacttacttaatgatctcagttaaatctcaagttggcccccagcactacggtgctatcttccttggttagcttattctttcacttccagagaagactgttttatgcctttcgctctccttcttgttagctaacaaactcttgtttttcacaacagatatgagcaatcttcccatcatgacatttaccagcctttcagtgatgggcagaataatggtcccccatagatgtctactttctaatccctgaaattgttaatatgttaggttacatggtaaagaggaattaaggttgctagtcagttgaccttgaaatggggacgttatcctggattattcacatgtgcccaaagtatataatcacaagggtccttattcatggaagagggaggcaaaggagagaaccaaagagatggaagtatgagaaggttatgatcttcccttgatggctttgaagatggaagaaggggttcatgagcccaaggaatgtggatagcctctaaaagctggaaaaaggaaggaaaccaattttcttctagagcctctagaaggaacacagccctgatggcaccttcattttagcccagtaagacacatttcagatttctggtccttagacctgtaagataataaatttgtgttgttttaagctaccaagtcagtagtaatttgtttttgcaaccagtgaaaatatactgattcaaatatttgcccattctctacccccttgcaatatgttactgcaaattcatatacttttcttttctttttaaaatacagatgaactcctctgactcctaaggacaactcttctatatctgtgctgagtcccgcttcctcttgcttagtcaagaaacttgcttttgcattatcctctctctctgctgcttatcagtttttttctttacttgattgttccagtctgtaatatcttccatcttaaaaggaaaacaattcacctcatgtctccttcaagtatcaggccccagtcgaagccatcatcccatctctcttagattgttctcacctggacaactttagtcacctcctaacttggcataccttctcttcacccttgtaatctgttctccatgtaacagctggagggatctttttagtgagaccacattatcactcccttgcttaaaaccatccattggtttccttcccatcatactggaaaccactttctgaggccagtataatcgggtctcaaccttatctaccactctatccttttctctgtgccgcagctgcactgaccttgttttcctttaagcagatcaactcatgtttattctaatgcctttgtgcttgctgtttcctctgcctgaaacacttctgcgggtatttacatggcgtactttctcactccattcagttttctgctcaaatatccgccaggtttattgtgaggtagcacccttctgccaccctcaccctttccaaccatttattgattaatttggcatcaggtttattttcttttttcttttccagccctaaactttgaaaggggtgtggtcaggagatgaaagcaataaaagagtggtggtcgtagaggtaaaaggatctggaggtttttgaaggggaagaaagaagaaatggtttggaggtagccatgaggaacaaggaaaacacatatctcatcccctaggtcttgaggaaataaggtataagagaaaaaagagtatttttatcaggagactgttcttcctcatagttgatgaaaagatttcataagataatgtatgtaaagcacttaatactgacccgtaaataatacccaccactatatttccttcaagcggcagtgtatgtcttctctttcttcctctttttccattttcttttcttagaaggtaggggcagggatcacataagaagatccttggcaaaaggacaagtacctaaagatggggttatatcagaatagtctgaggtttacagcaaacaaacagttcttggggagttaaggtgtgccaaagaaatcagagataatccattgtcagtggcttaccaggtgttaccagactggacaaaattcttttcctttgccactggcatactgtatccttttctactgaaaattattttattgagttatcatagctagatattactgcaattaaattatctgatgagtaattaacattaaaataatccaaaagagaaatctgttaattcaaatggctgtcctccaagattccactggtctccttctccccttcccatttctgttcctaagtaaaattagaaaggtctgtagtagtttgggatttatgtggttttcagggtatttgaaactcattgatttctagatgtctcacatggaacaagtgtcaggagtatgtatttatatcatagtaactgcaattccattaatacattatttttgttatgtgatatatttgatgactatatgataaataaaatactggaagaatgcctacttttcttctattggatatatgcatctttactcctgtttaaccttagatttgagtcttgtgttttctgtttctgtttccagagagtgaagggcgttccccaaaccacattgtagtgctgtgtcgaggccgagcttttgtctttgatgtaatacatgaaggatgtttggtcaccccgccagagcttctcaggttttcagactactttcttgagtttcattaggtcttatggtattgcttgaattaaaatatacatgtttagaattgcctttcaaggtgatagtaagctgaaaaataagaattttatgcatgcttttttaaaaaaaaatctatttgtattttttatttaaattatttttaaattttactagacatatataaatatgttcacttggagaaaaggaaaacattacatatattaccaattccattccctgccccagaattaatcactcttactagtttagtgtgttccattgttccatacctgttgcaatgaatttacatgtatacctagcttaaaaaatatatataatatataatatgtattatatatgtatatacatatatatggtatacattttctatgtatatgttttaaagtatattacagaaaatttcaaaatgtataggggattatataatgataactcccgtgtacccatctcctaacttcaacagttaccaactcctagcatcaacagttataaactcatagtcaatgctgtttcaactatacctcttttaccttttccctcactttcccatggattattttgaagataatctgacataatatcctttcactatagatatttcagtatacatctctaaaatagaaggactcttaaaatacacatttagtaccattatcatacctaatgacttctaaaaaataattttttttttgagacagagtcttgctttgtgtccaggctggagtgcagaggcacaatctcggctcactgcaccctccacattccaggttcaagtgattcttctgcctcagcctcccaagtagctaggattataggtgcgcaccaccatggccagctaattattgtatttttagtagggatgaggttttgccgtgttggccaagctggtcttgaactcctggccttaaataatccgcctgccttggcctcccaaagtgctgggattacaggcatgagccaccacacccagccaaataaacagtgttttaatatcattaacagagaatcagttgttctaattgttttctaattgttgggtatatatatctatttataacttaaattagttttattaaatattgcaaacatgtacaaaactgcacacagaaatgtacaactaaatattcatgtaacctgcacccaggtcaaaaattagaacatttctaatactccaaagattcccgtcatccctcttccagactttcactccttcccaggggcagtcatttaggttgtttacagtttgcattattatttgaaaaaggctgctgtgaaaatccttgtgtaagtcttttggtgtacacatgcatgtatttctgtctggagcacacccaggagagaatttgctgagtcataggatatgtgtatgttcagcttcaatagataatgccagttttccaaagtagttatgtctactagtgtgtgaatgttgtaggagttccttacattctgggtaagagttcttacttggttgtgtgtgttgcaatacacagagtagaagatgtttataattgatcttttgttctattaaacacatcttcctgatgaacagaagttcttaattgaatgaactccagtttattaatcttttaatctttaccatacagattatacattttgtgttctgttttaaaaaatttttccctaactcagtgccaagaagataatttcctatgttctagaattttgtgttgacttttacgtttgtatttatagtcttcctagagttaattgatttttttgtttgacatgaggcatggggtagttgcacatttaaaaaatagtgttatttttatagttagcttcttttaatcaacaataaatgtaatctttccatattggtacaaatacatctaccttattcttttaaactattacatagaattccatcaaatggatatattatagttgatgtgaccatttctttatgatatgacattaaagttgtttccatttgttgctataacaaataattaacattttcaaacatgcccctttgtgtatttggataaaatatctatggtttgatattagaagtgaaatgttcacatcatctgatgtatacatttaaaatttttgactgagtcaaattgtcatccacagtggcattgttttttctgccagtattatgtgaggacacccacttctcctaatcattgttgacatggtactattaaacttaaaacatatctggtgagtgggggacacagtggctcatgcctgtaattgcaacattttgggaggctgaggctggaggatcacttaaggccaagagttgaagaccagcctgggcaacatagggggaccctgtctctataaaaagttaaaaaattagctggacatgatagtgctacttgggagtgctcccagctacttggaaggctggggtgggaggatcacttgagcccaggaggtcgaggctgcagtgagctgtgattacgccactgcactccagcctgggtgacagagcaagacgctgtctcaaaaaaaaaaaaacaaaaaaaaaaaaacaaaaaaaagctatatctagtcaactgacaggtgaaaaatggttttcattgttgttcgaattggcatatccctcattacaagtgaggttgagcatttttatatggtttatatgccatttatttgtgttttctgtgagttacttttgcctatttttctgttggctattttactttatccttattgatttatagcaattatttatatagtctctacattaatcttttatacattatgtgtgttgcaaacattttcttccagttaacttgaaacaaattttggaaattgtccaatcttaattttgatttaggcaaatttatctttttaatcatttgcttttgtatcttggataatatttgtgtgtcttcccattacatgttttagttagtgtgttttaaatttgacatataattattagatcaggcttattaattggattattcaaagccactcttccagaaattaaacacatgtgcttcatgggctgcattcagcctgtgacctattttgcttggatagcagaatttgaatcactatttaaaaatcaggaaaatttacataaacatctggatttctgtttttgccttaaaaaaacccaaaagttctgacaactaccaatctactttctgcctctataaatgtgcctattttatacattttattaatataggaatggcatcttacaacatgtagccttttgtgtgtagcttctttcacttagcataatgttttcaaggttcatccgtgttttagcatgtatgaatactttattcctttttattgctgaataacattctattttacagatatgccacattttattaactattcatcagttgatggacatttgagttgtttctactttttgtctattatgaataatagacaaatagtaaattattcataatgctgccgtgactattgtatacaggttttcatgtaaacatatgttttcatttctcttgggtatattttaggggtagaattgccaggtcatatggtaattctatgtttaactattgagaaactaccagagagttttccaaaatggcgcagtatattagggttccagtttctccacatcttcaccaacacttattgtctgccttttttattgtagcgatgctagtaagggtaaagtgggatctcgttgtagtttatatttgataatgatgttaaagattttttcacatgcattttggccatttgtatatatcttccttggagagatgtctaatcagatacttggccaatttttaaattagtttgtttttttattattgaattgtaatcgttctttagatataagtctttttacagatatataatttgcaaattatatctcctaggcttggcttttcactttcttgatggcctcttttgatgcacaatatttttcattttgacaaaatccaattttatctctttttttgttgttacatgtgcttttggaattgtatctaagaaaccattgcctaatctgaggacatgaagatttacacatatattatcttttaagatctttttaaaaaaaattgtgggaagggggagataatgtttaaatatacatttagttggaaatgttggcaggaatcgaagtagagatatccaacaagcttttggaactttggtaacagagattgagagaaaaaatggtgttgaagttagagagttggttgcctcttacataaaggtgatcattgaaactattaaagaagtagacgagattactaagggagaaacttataagaggagcttggaaaggccagtgacagaaatttgggaaaagacacattcagcagtgtaaggagaacaaatggtcaatgaaaaagacttcagtgacgtatggagacgacaatgggaccatgtgaaaaaatcaagtaagaagataattttaacattcatacctgagtgtcaaacattctataatgaggaaaattagacttaaataaagctactaggtttccttaatgggacattattggtgactttcaagataatcactggagaacaaaaatcgaggacagtaaattaaagagtgaatggaaagcgatgaagcagaagccagactgtgtgggttatagaatatttaaaaaaatatatgattctgtaatgcagatatttttaatacaaatctttgtgctttgaaatataaaaaattagatgtgtagctgaaaaacaggtgcatagttagccaagttaaaggaaaagagggattatcttgttaccaaatctgtatctcttaatggtggcgatttgggcagttatgtgaccttttattatcaaacttaaaatgtcatttcaggtttaacacactttcctttgtaatttctccctaataatgaccaccttgtaaaacgaacatgaaaatgatcatttcagggaggaagtaaaagtttcatagtcaaaactcgtgctttgaggtagttggtaagggaaaggtagcaacaagtaccatatggagagaaacaggttgattttatttagaaattcagagtttatgctagtaaccacaactgcaaaagctttacttataattggagcaaaatcagtagttactaaagaaagtaagcaggaagagaggcaaggcaagttgctctgctatagatgcagattggtgaagaaacccttattctgttcctcaggacaccattaatttgcaaataacaaggggggaatttttcagcaagaaatgtatttctttatcagtgttacagatataatgaacaaacagaggagagtatgcaaatcagtagataaatgatgaattccaattttgaatgatgaagtcagaactgatggctactagtagcattttttgaccatttattaagctacattagctcacttcctgagaaatccttgaaagcttttaaattgaagtaatttcttaacatgtgccatgaaattgagctaaattaaagctctgtggatttttgactgatggaaatttctttatgggagaacccagttatttatctgctgtatgtttaaagatacatgaaattcaccaatctaggagcataaaatactgtggagggggagtagtttatccttagctaatagagtctttaaaaatataatgattagaagtaacaaagtggcacatatgaaaatagttaaaactgattatatggtatttctatttttttttggtaaaacacaaatattaattgagtatacagtaagtcctctggttaaatatatacgcacatagattttagttagataagatgtacattatatttgtgaaattgattaccaggatatttttcaagttctccattgtaaggatatttacagtaaaaaggatatttacttgcaacctagaagtgcatgcacatttccaaagtatatatcagcgaaactaaatttagccaataactaaatttatttactgaaattaaattattgtcaaatatgcttttggtgttaatagaacacaatcacttaaaaaaatatgtgatgtaggaaatctattggcatcataagtggtttctttgggtaatatatccaaacatttaaatattgatcaatgttatgaccttttaaaggccaaagtagttactttctgcctgtactcttttttaatcttcttttcatcttccataagacaactgacatatatccacaagaagtgccatagtgaacctgatggacctgggattgcagcattaactagtgaggagcgaactcgatgggctaaggttctgatttacacttttcttaacgaagcttttctctaacaaactcttttgatgtattgtatttcagttgtaatatttgatcatcatctccttgccctttaggcacgagaatatctgattggtcttgatccagagaacttggctttgttagaaaaaattcagagtagtttactggtatattccatggaggatagcagtccacatgtaacaccagaggattattctgaggtacttaactaccttctcttttttttttttattgcagatttttctggaagactcatatttattgaacatggaagttttttttctttttctacctttaggctcttgaaactttttcttagttatacaatatacttgtgccaaattgaagcttataaagtagatagtaaattggtaaatccttgccacattgtttaagtttgtttagctatatattatactttgtttaaagaagtatgactttgcatatcacatatcagtgttgctcaaccttttcattgcttgcctactcagaaaatttacacagagcactaggttaatgagcttttcttgccaaaggtgaaatgataacctaatcataacctgcactagtgtatcttgacaccatagttgggactgtgtctcctaagaattatgtcacccttgtaagtcatttattttatcatttggttaattgctgaacacattgatgtcagtgacgttaagggtaaatatggccttattttatgctcccctgccacccccagggtgacatttgtgtcccaggaaataataaaagatagtaattgtattagaaatctcatagtcttttgaaaatacttaattattttatagtgaattaatcggtattaaataataggaaaaaatatcaaggattggaaaaccttgtagcaaggagagagatttttttttttttttgagaatcaccagacttctttttaaggaagaatgtattttaatgcagtgttgttcaaagttttttgaccacaatttttagttacaaatacatttagattgcagcccactatatatacatgtgtatatgcatgcaaacacatatataaaataggagtttcacagagcactaattacttttattgtctgtgaggtacactgatatttccagtctattttattctccttttttgtaaggaatattgattatgatgcactgagttaatttcatgatccattaataggccaaagtatacagtttgaaaaacaggtttagtaggaaacgaattcttaaaatatttcctcctaactagactttaatgactaaacttttatcaagatcttttatcctattcaagttacaaaacccttatcctctcaattctatgttctgtaaacattcatgaatattgtaccagcattttcttttctggtaggattttcttaacttgagattttgagaagcccctaaagtcagggccagaattactctctcttgactttgcatatcacatatcagtgttgctgatcataactatattatgattttattaaatttggttgacctgaagaggaatggtgagatgatatatgtgtttaagatgtaaattcttacaaaccaatattaaacccttttaatttggaaaaattaaatttattttagattattgcagccatccttattggagatccaacagtacgctggggtgacaaatcctataacttgatttccttttctaatggagtatttggctgtaattgtgatgtaagtaaactactgaaatttttctcttttgatcttttaggttaaattaatgacaataaaccataaatacttgtgctggggaacagtgtaagtgaatagtaatttagttttatggcactgtggtgaaaagtttagttatgaattctcattgaaagtataggacaagttattttcttctgtagtaaggccaacagtttgttgtgtactatatctgcaaaatgggatttgcatataatatttatgtaatataagctcttaaaacccagtattatctgcttgctgagaatacctatttcaaaaggtattatatggcattatgtatgtgttctatgcagagcaatgcatatggatatatttatagagttcaagattcacctagtaactaggtaactattttcctaaaatgacacatgatctttggaacactatttaggctgtggatattaaaatggcagttactaccattttgaccattttcataaaaaatgaacaacttttcttgcttctcctctgttcccctcccatggacatcttcactagctgtctactaactgtctgataggcattcaggaggtctatgaaccaagaaaattttttataaaggggtttggggctgggtatgatggctgatacctgtaatcccagcactttgggaggccaaggcaggtgaatcacttgagcccaggagatggagactggtctgggcaatggcatgaaaccccgtctctacaaaaaatacaaaaattagcctcacatggtgttgtgcgcctgtgatcccagctacttgggaggctgaggtctaggaggatcgcttgaacctgggaggttgagggtgcagtgaacggtgtttgggccagtgcacttcagcctgggaaacagactgagactctgactccaaaaaaaaaaaaaaaaaagggttcagtagttgtattaatccatattcaggtttaggtgatagaaacctaaatcaaactagcgttagcgtaagaagatatttgttggcaaggagttagctaaatttgggtaaagctgacttcaatgttcaaatgctttcattagaaatctctccccattttttggtactgctttcttttgtttggcctcatatttaggtagactgcccaatgtgattgttgtaccaacagtctcatatcttcatagctttcttcatagactcccaaaggaaatagccagcttctttgtttccaatggttacagcaaaagtcctggaataatcctcatcagttgtgattggcctgtgtgattcatgtccccatcctggggaatcaggtgcttggatgagcttggcctgggtcacatgcccaaccttggaatctagtgggtagaatcagtctcattcaaaccactacaaagtggtgcttggttgcctaaagaacagtaaagtagctgttatttcagaacaaggtggattggttaataggcactgaaagtaaatgtctattggagtatctcatcagagctacagtgaaaagttgccacaagtcatttattttgaagatgttctctttactcttcctttgagtctactgttgacagaatagttcttgttaattgcctcagttttcttctcttcagctcctcatttgattctccttgaccttcctcagtctggtttatgtccttaccattccttgcaaactaccctttgtaaggtggttaactgccccctggcttcttcccttcatttccctttgacctgtctgctgcagttggttaccctctgcatacatattttgacactgcctctttcctcttaacagtattttcctctctactgattctgaaactgaccttaatattcatcacacttttccccctctgaccactttattgacctattgttatatatgtaacttgcagctatacttttctagcttttacctattattctcatttgagagttgtgtttcattatatgttaaattgttcaaattggatgttatattgttatataagagtaagtcaatctcatcaagaataactcatcttgctttccgtccctcatccccaagaccatcaaaaaacaccttttgctaaactgatttttactaatagcaccagtatcctgctgttcacacaaattcaagatgaaaataattttgataatcttgtctgtctctgaataaagaatattgggctcataatgagcatatctctcagcataactgaactgcttttttatagtgtgcggacatgttttatgtgtgtgcattaacatgcatatattcataaaattgatctgattatctccacctgataatttgcattaaattccatggaggtttcccttctaacctaagatgattatagagggtgcagtttaacctttgtaaatcatcattagtgaaatacatatgctgtaggccaaacatgggagctcatgcctataatcccagcactttgggagacgaaggtgggaggatttgattccagcagttcagcaccagcttgggcaacatagtgagaccctcatctctacaaaaaataaaaaattagttgggcatggtaatgcatacctatactcccaactacttgggaggctgaggtgggaggatcacttgagcctaggaggtccaggttgcagtgagccatggttgtaccactgcactcccacccaggcaacagaacaagaccctgtcccaaaaataataataagaagaaaaataagcatatgtactgtaaaataaagcttattttaccctaaagccatgttgctggtccataattttaattgtttgaatatgttcttttgtgattatattaattccatttccctcctattttataaacctgaagtcaactatattgtcttctctatattgtaggctttattgtaaggctttgcagagggtgcataggaagcatgtaaaaactttagttaataataacaatagttactaattattgctgtgagctagatccttggtaagtactgtgtaagtggtataaaaatcatttttcacagcatctgtatgtatgtatgcattatctctacagggaaatgaggcagtttaattagaaagcaaagtaacttttttactattgcccagctaggaagtagtttgaactcagaaccaaagcctacattcttaaacactatgtaaatacatattgcctctgtgtaagtgcaagaaatgaaaggtaaaaattatgtgaacaaataaagcatcaggatagcattggaattttatatattttctaccttctttgagattattagctttccattaggagatgggtgcttagaattatagctcaaagagacatccttcactcttgctatttcctactggctccagtaaaatagttggaaactgatgctgtttgtcttaaatgaaacaatatatttgataatatctgaaaattctttgtaaaattgtaaagtaccacacagttgtgagatactgttagaaaatggatttgtcagcgacctgtgagtcttgtcatgtgtgctgttgttggcagataaactgctcaggcatcttatactgacctccctcaagagcctttcctgatgtagttgttgcctggttggtaacaataaatcctgtttataggctccgctgggccatgatacaggctacagagctatagtgttagggtgacatttaagacacctaattactcctctgaaactgggcccatatcttgatactacttcccttctttccctcccaagctcgcagtgtcacgttcagatcatgaatgatatctgtgtctaatgtaaagtggtgacagtcacaaggaaccgtctgatgtaacttttatctaaggaacatggggaaaatgcgggcaaaaactttgttcttcaaaatagatgatgggaaaattcactaactgcaatttctttctctaaatacacctggcaaacctgaaacagccccgtaacacccagcctatctttcccacatttcttaaactgagaattatcacattgggacattcatatgtataaaaaacacaaaatggttatgctttctaatattcactaagtggcctaagtccttacctaaagaagttcatgcccatcccaaatgctttcagataggttgccatccccatctgcttttccaccctgttcttacaattccagaacatcttcatgttgcatatatacacttgctttgacttctagtaaaaatagcaattaatttatctagattgtttatatgttattttatacaccctcatgaccccaagccccaccagaagccctactaggtgcttccaaatttaaacaactttttttccaaaaaataaaatatagcagttactgaactgtagggaatcttctatcttatcatatcctcaagaggtgaggcatttgaagactctatgctttattatctgttaagaatggacacaaagtgaaaataaaatattgggtcaagttttaagttgacataaagtattcagaaatcttgtgtgttctcattttagcatgctccttttgatgcaatgattatggtgaacatcagttattatgtggatgagaaaatttttcagaatgaaggaagatggaaggtatgtttgaataaatatttcatcttttttctcctaataattctatagataaaatatttttaagtcttccctattttcagggttcagagaaggtacgagatataccacttccagaagagctcattttcattgtggatgagaaagttttaaatgacatcaaccaagctaaagcccagtatctcagggaggtatatttttcacttttctcttaaataataatgattttttcttttaacaaccatatgtaaaaatttggctgtcatccaagcatgtctgcacaaaacattttaaaattatgcctttaacacctttaattctttatgtctggtgattactttaatgcaggtgataatttgcttctctttggtgtattctccttaggtgatttttcaccgttctcatttaattcttcttgttaggcatctgatctacagattgcggcttatgcctttacatcttttggcaaaaagctaaccaagaacaagatgcttcacccggatacgtttattcagcttgcacttcagctggcctattacagacttcatggacagtaaggaccattcagtttctattttcacagtcttgaagtccaagggtatatctttttttatagctatttcatcctaactcctcagtatttttgctcacttttttcccagctggtactgtgtcctatttgtacttccatcaatagagtattagatttctgatctgtggtggtttcacagtttttccttgttactttatcacagtatccacttgataacttttgacgtgtctattctcatctgaaagaggattggtcatctttggcattcagatcgcttggttttcttgcaacgtcagttttctgatgggttcatgaaaagttgtgattttataaattatccagcctttactcatttttagaataggagcgacattaattttgtgacttaatacatcctaagaagaagtagaagtccctcaatgttgctttttcattgataaataagttataattgaacatatttatcaggtacatgtgatttttttgatacatgcataaaatgtgtaatggtcaaatcacggtaattgggatgtccactgcctcaaccatttattatgtcttcgtgtggggaatgttccaagtcttctcttcttggtattttgaaatatacaacaaattattgttaactatagtcaacctactgtgctatcgaacactagaagttattccatctaactgtaccattatacccattagctaacttctcttcaatctcctctcccccctactcatcccaatctctgttaaccaccattttactgtctacttccacgagatcaattttttttaactcccatatataggtgagaacctgcagtatttgtctttctatttctggcttatttcacttaacaaaaagttatccagccttacccatgttgctgcaaatgaagggatttcattctttgtttttttattttggctgagtaatattccattgtgtatgtatatcactttttttttttttttgagtcagagtcttgctctgtcgcccaggttggagtgcagtggcatggtcttggttccctgcaacctctacctcctgggttcaagcaattctccctgcctcagcctcctgagtagctgggattacaggtgcctgccaccatgcctggctaatttttatagttttagtagagatggggtttcgtcgtgttggccaggctggtctctaactcctgagctcaggtgatctgcgtgccttggcctcccaaagtgctgggattagaggtgtgagccaccacgcccggcccacattttctttatccatacatctgctggacacttaggttgattctatatcttgactattgtgaatagtgctgcaataaacattggagtgtggctatctctttgatatattgatttcctttctcttggatatatacctagcagtgggatcatcagattgtagggtagttcttttttttttagttttgtgaggcactttcagactgttcgccatagtggctgtactaatttacatttccaccaacaatgtatgagggttcccttttctccacatctttgctagcatctgttattgcctatctttttgataaaagtgatttttaactagggtgaggtgatgtctcattgtagttttaatttgcatttcccgatgattagtgatgttgagcatttttcatatacttgttggctgtttgtatgtcttcttttgagaaatgtctattaagatcatttgtcactgggcgcatggctcacacctgtagtcccagcaatttgggaggccgaggtgggcagatcacctgaggtcaggagtttgagaccagcctggccaacatagcgaaaccctgtctctactaaaaatacaaaaattagcctgatgtaggggcacatatctgtacctctacctactcaggaggctgaggcacgagaatcccttgaacctgggaggcagaggttgcagtgagctgagatcgtgccactgcactccagcctgggcgacagagcaagacactgtctaacaacaacaaaaaagattatttgtccattttagatcagataaatttgtgtgttgctattgagttttttaagttccttatatattctgattattaatttcttgggagatggatagtttgcagatattttctcccattctgtgggctgctgattgtttcctctgcagtgcagaagctttttaacttcatatgatcccattcgtccatttctgctttggcttccatacttgtagggtattactcaagaaatatttgcccagttcagtgtcttacagagcatcctcaatgttttcttttagtagttttatagtttcaggtcttatatttaagcctttaatccattttgatttgaattttgtacacggtaagagatagtggtccagtttcattcttctgcatatggatatccagttttcatggagccatttattgaagagcctgtcctttcctttgctgaaaaggagatgcctgtaaatacacggatttatttctgggttctctattctgttccattggtctgtatgtctgtttttatgccagtaacatgctgttttggttactatagtttggcggtatattttgaagttcggtaatgtgatacctcaagcttttttttttttcccctggtattgcattggctattctgggtcttttgtggttccatatgaatttttggatttttttttcctatttttgtgaagaatattgttggtattttgataggaattgcattgaatatgtagattgctttgggtaggatggacattttaacaatattaattcttctaattaatgaacataggttgtctttccattttttggtgttctctcactttcatcagtgtcttatagtcttccttgtattgatttttttacttttttggttcagttgattcctaggtattttatattctttgtagctattgtaaatgggattgctttcttgatttgtttttcagattgtttgctttttgcatatagaaatgctactgattttaatatgttgattttatatcttgcaactttactgaatttgtttatcactctaatggctgtttgttggtgtcttaagtattagatcatgtcatctgcagacaggacaatttgactttttcctttgcaatttgagtgctctttatttcattctcttttctaattgctttggctaggacttccaatactatgttgcataaaagtggtgaaagtaggcatctttgtcatgttctagatcttagaggaaagtcttgcaatttttccatgttcagtatgatgttagctctggatttgtcatatgtggcttttattgttttgatgtatatttcttctttactgagtttgttgaaaattttttttatcatgaaggtatgtttaattttatcaaatgcttttcagcatctattgaaatgattatagggtttttgtcctttattctgttgatgtgatatatcatgcttattaatttgcatatgttgaaccatctgaatcccacttaatcatggtgagtgatctttttaatgtgctgttgagttcagtttgctagtattttgttgaggatttctgcatctgtgttcatctgggatactgctctgtagtttacttctttagttgtgtccttttctggttttggtattaggataatgctgtcttcatagaatgagattgaaaatattctgccctcttcaattttttggaatagtttgagtataattggtattagttctttttttaaaggtttattagaattcagcagtgaagccatcaggtcctaagcttttgcttaatgggagactttttattgcttcaatcatattacttgttattggtctgtttgggttttctatgtctttatgtttcaatctcaggttgtatgtgtccaggaatttatccattccttctaggttttccaatttgttggcatatagttactcataatagtgtctaatgatcctttatatttctgtggtattggttaccatatctcctttcatctctgaatttatttatttgagtcttttcctttttccttattctacctacagatttgtcaatattgtttatcttgtcaaaaaattgacttttggagctcttgtaaaagttcagattgcttactgttgtggacttggagtgtctgcaacgaaaggataccctggctgtgtgggaaggctggctagggctttatagcctcatggactcatggagcgtgcttcctacaccgtaacactgctgaacaacctctttgatttggtgtcttttttggctgagatgaagagtgatcactgagttttgttcattggggattgctaaccccatctctacccattgtctctggctgcctttaggatttttttaccctataggcaaagatgcttcccttaggttgaagcaggaatgatttttctgtgaaggaacccagcatggagataagggtgtctgtctgccttgatctcacttctttcagtgtagtattgtgagtccatgggagtttttccacatgcggcctggcagcttgagggcggggtgttgtggatagagtggtctgtttctcttaccttctgcttgaagttttttgcttctctctggcccctgggatcatcacagcctccattttggtttctgggatactcctgaggataattggtactagatagttgttttggttttctgtggggaagagtgaagccagattgcttctactctgccattatggtaacatgactcctctcagttttgcttttttatctagtctgagaatatctgtctttaaatatgttatttagataattaaattcagtataattatcagtaaatttgtgtttaagtctaccatcttgctctttattttctagttatcccatctgtacttttttctttttcttttgaatttttagagctttaaaaaaattgcttcattttatttccaacatgagctatactttttttttttgtacagttgacccttcaacatcatggaggttaggggtccccaagcccccagtgcattagaaaatccaagtgtgtgaccagaagtcttaccaataacataaacaattaacacacattttgtatatgtattatatattgtattcttacaataaagtaaactagagaaaggaaatttttgttaagaaaaatcataaggaggctgggcatggtggctcacacctgtaaacccagcactttgggaggctgaggcaggcagatcacttgaggtcaggagttcgagactagcctggccaacatggtaaaaccccatctctatggaaaatacaaaaattagctgggtattgtggtgcatgcctgtaattccagctactcaggaggctgagataggagaattgcttgcacccaggaggtagaggttgcagtgacccaagatcatgccactgcactccagcctgggcgacagagcaagactttggcaccattgagtaggactggagctgggttaaagggctgcttctgtgtccacagtcaaatgcacagttttggtgggtctattactggggagcaggtgggtgtgataccttccaggtccctagacagatgggacttcctccaagactgcacagagaaacaggcctggagccaagactccaaggtacctcacttcaaagagctgctcttctctccagatcttgaccctcatatcctggctgctctaacagttgccccaagtaatttatagattcgatgctatctccatcaagctactactgactttcttcagaaaattaaaaaaaaactactttaaatttcatatggaaccaaaaaagagcctgtatagccaaaacaatcctaagcaaaaagaaaaaaactggaggtatcatgctacctgacttcaaactgtactacaaggctacagtaaccaaaacagcatgttactggtaccaacacagatatatagaccaatggaacagaacagaggccttagaaataacaccacacatctacaaccatctgatctgtaacaaacctgagaaaaacaagcaatggggaaaggattccctatttaataaatgatgttgggaaaactggctagccatttgcagaaaactgaaactggaccccttccttataccttatacaaaaattaactcaagatggattaaagacttaaacataagacctaaacccataaaaactctagaagaaaacctaggcaatatcattcaggacataggcatgggcaaagacttcatgactaaaacaacaaaatcaatggcaacaaaagccaaaattgacaaatgggatctaattaaactaaagagcttctgcacagcaaatgaaactatcatcagagtgaacaggcaacctacagaatgggagaaaatttttgcaatctaaccacctgacaaagggctaatatccagaatctacaaggaacttaaacaaatttacaagaaaaaaacaaccccatcaaaaagtgggcaaaagatgtgaacagacacttctcaaaagaagacatttatgtggccaacaaacaaatgaaaaaaagctcatcatcactagtcattagagaaatgcaaatcaaaatcacaatgagataccatcttatgccagttagaatggcgatcattaaaaagtcaggaaacaacagatgctggagaggatgtggagaaataggaatgcttttacactgttggtgggagtgtaaattagttcaaccattgcagaagacagtgtggcgattcctcaaggatctagaaccagaaataccatttgatccagcgatcccattgctagatatatacccaaaggattataaatctttctactataaagatacatgcacacatatgtatattgcagccctgttcacaatagcaaagacttggaaccaacctaagtgcccatcaatgatagactagataaagaaaatgtggcacatatacaccatggaatactatgcagccataaaagaggatgagttcatgtcctttgcagggacatggatgaagctggaaaccatcattctcaacaaactaacacaggaacagaaaaccaaacaccacatgttctcactcataagtgggagttgaacaatgagaatacatggacacaggaagggaacatcacacaccgggggctgtcatggggtggggggctaggggagggatagcattaggagaaatgcctaatgtagatgatgggttgatgggtgcagcaaaccatcatggcacatgtatacctatgtaataaacctgcacattctgcacatgtatcccagaactttaaagtataataaaaaaaattctgcaaagccttcaaatagatgttttttaaatccagtttttgttgttgttcctagcattaagactggcttgccagaaactagctcatcatagctggcattggaaatttcacgcggtattttttttttatatagaagatatgttcaaatcaggttccaaataaattttacacattgcatttgattgatataccttataagtcttttttaaatatgggaatctttttcctacctttctcttattgtatttgatttgatgaagaaactgggtcatttatcctgtagagttttctgaattttcctgattgtattcccatggtgatatttaacatgttgctcagtctcctgtatgtcttgtaaactggtagttagagctagaggattgataatatgcatcagttcctattttggttatgttttacaataataaatccaatagttaatgctctttgctttctactccatcttttaagattaagagtgtgtttacttgtcagccagcatctattataaaaagtttactccctgaattttttacctaacgtttcagtagtcattgaagatcattgctaaggttcattatttcatttgaggttacagtggtaatattttattactcatttttactgcttttatttttaatttgttttcctgaaagaatgttattttagtgctatttaaaaatattattcacactttctccttcacactttgaagggataccatttcactccagagagacagaaacactgaacagaagaggcttgaaaactgtttgagccctcctagtacccacattcagagacttttcactctcactttatttgatctctttgactctaaattctaaccaataagaaagtaagagagttttatacctaaaattgctatatcattctccaacccaggaaaacagatatcaccctggggaacttcttaaattatacttctactttattctagtccttcatgttctatatggaggcactaaaggtcaaggactctgtattacctatttctgtgtaataaattaccccaaaacgtagtggcttaaaacacatacttttttatatcacacattttgtgggtcagtaattttatatcacatattttgtgggtcagtaattttatatcacaattttgtgggtcattttttgtgatgcagcttagttgagtaactctgacttaataaaggtttttcatgaggttgtagtcagtatcagccaaggctgttttcatctgctctcctgagggtaggtccacttctcagctcacccacgggaactagtagcattcagttcctccctagctgttgtccagagggtcaccctcagttttctgccgctagggcctctccatcgggcagccctcagcatggcagctggctttcttcagatgagaaataagagaacaagagagagctctctttgtaacctaattgcagatgtgatatcccatcacttgtgctgtactctccccattagatgcaagtcactgtctagcctgcgctcaaaagtgaggggttacagcagagcataaatagcaggaggcaggaatcacgggggccatcttagaggctgtaatgtatatgacctgacagcagccacgcctttgaaacagcccacattatcagagtattttttgctctttggtattggaaataggctcttttttgttgaaagtctccaacctatctgtgttaaagggcttagtctctgaacaaagctagctttattaggcaactatatctgtaatgatattagagcattttctttcttatgatacactcttttaattttttcttgtagccctggttgttgctatgaaacagctatgacaagacatttttatcatggccgtacagagactatgcgatcatgcacagttgaagcagtgaggtggtgccagtccatgcaggatccttctgtcaatgtgagtattggaaaggaaaaaaactcacaagatttgtttaattgttctaaaggaaccgtggtctttgagtaactaacttctttgcttcagttttcctggatcattaaaatactttgagacatcttttctgaggtttttaaagcatttgttcattcaccagtgaaatgtgtaattggaaacagggaaggcaggaaaaggatcccatttgtgttattttctaggcaaagggtcttcagtactttaggtatttcaggacttctaatctacctttagaacaacaccaacaaagtgcagaaatcccaaggtgcctttaaaaggaaggttttcttgatgtggttgaatgtttttgaaatgacagattcttgtttcatatagtggaaccaggacagttgtatgctttgtttcatactcttttttttgaagcatttagacaacagcaaatttccttctcactgttattttagtattatatttgtttctttagttttgctagatgtggttatatatgagtgcctgtatcttaattttatagaactgctttattgtcatttttagttatgctttcatttttgaaatatcggttgcttttatctttatacttgttagtgtcacttcagtgctgcccacaagttcatagtttcctattccaggaaagaaataagaagcaggatatacagggaagactaggcgatagaataactgatggaaagatataggagtatgtgttatagatcttcctagaaatctttcctctcccaaattaccccaatcctaattacaatgagcttaggatttttttctagttgggttttgcacagtgtgttattgaagtgtctctcgatttttaatacagcttcgtgagcggcagcaaaagatgttacaagcttttgcaaagcataataaaatgatgaaagattgttcagctggaaaaggtacttaagttaaaatttttctgacttaaaaatctctcatggtgaaaaatttttttctaacctcagatttggggtttcattgcaggatttgatcgtcaccttttaggtctcttactcatagcaaaagaggaaggtcttcctgttccagaactctttacggacccacttttttccaaaaggtaatatagtgtagtgttttacagcttcatcaattggcttcctctttttgtatattaaatggtttttagaaacaatataagcatctgtaggcctagtaaaatgttcttttattgtgccacacagcggaggaggtggaaattttgttctctcaacaagtctggttggctatttacgagtccagggagtggtagttcccatggtacacaatggttatggatttttctaccatatcagagatgacaggtgaggcttctcttttttattctttctgtgctatagagtaggaaaggtattacttttgtttttaaatgcctttcctacactgtgattcttatattgccatctgtcacttgctacataagtaactatttttttccacttaggcatttaatgcatattcatgtttctctgtcctgcttttgagacacttgtcagattagtcccttaggtgtcttcatgcagaacactgtttcaagtcgattcggcaatcatatcatcatcctcaaaatcagtacacccatgaacatatttggtttgtacaaggtattttataataagctcagataaaatgtttaaatatatggtggttcatgtagtcatagacaatattaatgagatagagaaaagagattgggtaaattatactttttaaaacagttttaccaattcagatgcagttcacttgggctgtgtggagtttgacttatgtttatggaaagaatgagaaagaaaagatcaaaacctggtataaaaaagagtagtggagaacaagataaaatgaaagtgatagcaaggcttgtaaggtccttatctacagtctggcagtctctttacaggggcctttcaaagcatagttggcttcataaaaattacgtgactacatttagcactatgtgaataagaagagggcaggcttggaggcacttcagatagaatgtgaaaaattggaatagtaatatgcatgacatatttcagtttctaatacaactgacccttgaacaacatgggtttgaactgcatgggcacacttacatgcagattttaaataaatgagaaaattttttggagattgagacaatttgaaaaaactcaaaactgtgtagtgtagaaatattcaaaaactaaagtattcatgaatgcataaaatatatacagatactagtctatttcatcatttactaccataaaatatacacaaatctactatacaaagttgaaatttatcaaaatatatgaacataagcccttacagactttatatggtgccatttgcagtcaagagaaatgtaaacaaatgtaaagatgcagttttcaatcataattgcattaaattaactgtggtacacactgtactactataataattttgtagctacctcatgttgctactgtggtgagctaaagagttgcaagtatctccttaagatgtcacataatgctaatcatctctgcagaagcagtttgtctctttagcagatcacaaaaagtgatctttcgtggtttattctcatgtatttttcattgtgggtagtacagtattgtaaacattgaataataccatgggacccacatgtagtgcttctagtgatactgcaagtgctcccaagaagcagagaaaagtcatgacattacaagaaagagttgatttgcttgataagtatcatagattgagatctgtagctgcatttgcccatcatttcaacataaataaatctagtataagtactatttaaaaaaaaaaaaggaaatttgtgaagctattgctgcagctacactggcaggcattaaaactttgccgtttgcaaaatgccttttgatctccaattaaaaatgcagctttttggtgggtgctatattttttatagcaaaaaaaatgcctttcttgctataaaaaggcatacctatagactctactatgattctagaaaaagcgaagttattatatgacaactttacaggaaggtgaaggatctgaagctggagaatttaatgccagcaaaggatagtttgataattttagaaagaggtttggctttaaaaatgtcaagataacaggagaagtagaggcagcagacaagttcccagacaccatcaagaaaatcactgaggacaaaggatatctgcctgaacagatttttaatgcagacaaatgtgccctattctgaaaaaaaaaatgccacaaaggacatttgttagtaaggaagagaagtgtattagtcagggttctctacagggacagaactaataggatatttaagaagtatgtaagaagcattaactcacacgatcacaaggtcccacaataggccagctgcaagctgaggggcaagaaagccagtttgagtcccacagctgaagaagttagagtccaacgttcaaggccaggaagcatctagcacaggagaaagatgtaggctgggaggctaagccagtctagtcttttcaggtttttctgcctgctttatattctggctgtgctggcagctgattagatggtgccctcccagattaacggtgggtctgactttcccagcccactgactcaaatgttaatctcctttggcaacactgtctcagacacacccaggatcaatactttgcatccttcaatcaaaccaagttgacactcagtattaaccatcacaagaagcaagcatcaggctttaaggcagaaagggataggccaacactactgttttgtgcaaatgcagtagggtttatgatcaggactgcctttgtctgtaaagctgttaactttgagccttgaagggaaaagataaacatcagctgctagtttacaagaaggcctggaccaatgataacctttttttctggactggtttctttgatgttttgtcactgaagtcaggaagtacctagccttttaaagttgttttgattttggacagtgaccctggccacccagaaccccatgatttaaacacccaaggtgtcaaaatggtctacttgcccccagacatgtctctaattcaggctctagatcgggggttataaggacctttaaggctcattacatgcaggactcaatagaaaggattgtcaccaaggattgtcttttaccccaatggaagagaacatcatgaaagtctggaaggattacaccattgaagatgccattgttgttaagaagaagtcatgaaagcagtcaagcccaaaacaataaatttctactagagaaaactatgtccagatgtacatgatttcacaggatttacgacagagccagtctaggaaatcatgaaagagattgtcgatatggcaaaaaaaagtggagggtgaaggatttcaaggtatggatgttgggccagtttcagtggctcatgcctgtgtttccagcagtttggaaggccaaggtgggaagattgcttgaggccaggagtttgagaccatcctgagcaatatagtaagacctcatctctattaaaaaatttgaaaaatcacgcactaatagtcaccacaccagaggaattaacagaaggtgacttgaaggagatgagtgcttctgaaccagagccaaatgacgaggaggaagacatagtagaagcagtgccagaactgatgttagataatctcacagaagcgttctgattattcaagactgtttttgatggcttttatgacatgcactggacccttctatgataggagcattgaaactaaagcaagtggggcaagggttggtacagtatagaaacatttttagagaaatgaaaaagcaaaaagatagaaattacaatgtatttacataaagttacactgagtgtgccagcctcccctgcctcttctttcatctcttctaccccaagactagaccactgcattttaaatgtattacatgctgattgtaaaaaaaaaaaaagttgttaaatataaaaactacataagaacaaagttatctacatttccattacatggcataagactataattatatgatgctcccaacctataatgtatgtagactgtatatttacactgtaaatatttgtgtccttttttgtgaatttcattcttgcttattatttcaagcagtttacaatgctattaagtatgctttgagatattttgatggttgtataatttccagtcttaggattcctatgatttatctaactgcttctctactattttgtttttccatcattacaaataatgtataaggttataaacgtatcctttctcatttcatcacaccattgccaactctagttattataaaaattctgtaggctaggcatggtggctcacgcctgtaatcccagcactttgggagggattacactagatcatttgaggccaggagttcaagaccagtctggccaacatggtgaaaccccatttctactaaaaatacaaaaattagctggtgtggtggcacacacctgtagtctgagttacttgggaacctgaggcacgagaattgcttcacactgggagatggaggttgcagtgagctgagatcatgccactgcactccagtctgggcaacagagtgagactctttctcaaaaaaaaaaaaaagtatttactcatttgacaggcaaaaaataacataaattacttgtttacctatgaagtaaaacatgttttcattgtttttggcattgtgtttctttcatgaattgtctgtacatgtaggaaaggctgttctttagaaagataactgaaatttttttaaaaaattgacacttgaataagaatggttaatctgtggagagaaacatgtttagatgctgctaaatatctgggaattccatgccaagtgtagctggagaatgattcgtgatcatgaatcacgaggtgaaaacaaggcaggacttcctaaaggtttctgtattacttttctgcaaatataatccactcagacattggtttcatcattatatactgggctagagcatgttcttatttttatttctctttgtttaacttaaagcacatgttgaagacataatttactctttttttaagtgatgtgaaaattgcatggttttccagaagcattacattgcacattttaattttgagcctaattcatatttcgctatagaaacttctgtctgtaaagtggaagactagctctaagtcaggcttctctcctatttatttcagcttcccagggccacttttctcacttgccagatctgggatttcttattaggagtatctcgagaaagatggtggaaggcatgacttgatcccaagagtttctctttttgactcctagaaatagcctttctcacctatcatccttctctgcctttttttttttttcaaactttcttcaagtactctttaaaaacagtttaaatttcattaaaaactgtagcatgaattcatattccaactcattccagtagcactttaggaaggacttttctaggaaggaggttttttgttctgttttaaacgcagtaagacctagcttcagagcactctagggctctagctaatttgttcccctttgtccctaggtgctagtcatctaatgaatgaggtgtttcttagcattatctacagatatggctttaccttcaattgtgtcaggttacatttacctaatgtcagcaagacttcacatttcatgtatgaatatccagatgaaataaagtcctggttgtattcaccatcactatttggagccttttgtgtaatcattaatcattatttatgcttcacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataactcttttgaacaaacagacaaattagctagtagtatggagatgtataccctctattacacacataaaaccgtaacaaaattcattgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctgtttgcttttctggtgctttttgacctcagttatatattgctgtgtaattaaccatccaaaacttagtgtcttgaatcagtttattgtttctcattactttgtcagttgattgataacagctagacagttcttctgctcatcttgcctgtgtttatttgtacagctataatcatcaggcagccaggactgaggctggaaagtttaagatcacctcaccaactatctgtaaatttggtggctgggactgtctctcctgacatggtctctgatcatctagtattcagaattgagcttccttacttggtagtgagagtgttctgagaggtgaaggtcccttgaggcctaggccctgaagtcacatgccatcacctggctgcattttgttgattaaaccaagtcacaagagaagtccagattcaaggagtggggaaaaagtaatatcttgataagagaaagtcactttgtaaaagagtgggcacagagggcatgattatgggtactatagcaatctgccagacattttaatatatgtaaagattacatcatactcagggtactgattctatacatcccttttaaaaaacatgtacgctctgaatttgataagactggtttattgctaacaattaagccctttacactgtgccagcctctgtcctgaaaagcatcagtactatttctctgtgaaaacattcagagttggcttcagtagcatttgatacatttcttcacagttggtatagaaaaggaagatgagatctgaactaagaaccttttcccctcattctaatgcagggttttaaactagatagcgaggacatttagaatcatttggttggtttataaatacaggttgaacattccaaatttgaacaccagaaatgctccaaaatccaaaacattttgagtgctgacataaggaaatgctcattggaacatttaggatttctg

SEQ ID NO: 13192 - DNA, 57811 bp, Human
tactttgaaaatattagtcacacagacatgctgaagatccttcacctcatgagtgataactactccagtgagaggtgattaactgttacatttaaagtgggaaatgcctatatatagagagaaaatggttatttatttccagaccctgccaacttccatattgctctcttgctgtgtcatagtcacagacctgttcaaagacaggaaatataatttctaatcttcctgttcaagaaataattttattgatctccacttcatcttttattttccccatgattcagcaggtcaaaactgttccagttccagtagcatcctatcagtcagcaaaatgtccatgaggttaaaatgtcttacaagttaataggaggtgaagaaattcatttcagcaccaaggagagtgccctgctattttcaattggttttatgtatttgaaactgtgtattgttcctgaggatagaaaaaaaagttgaaatgtgattggacagaaagctgctaaaaacctattttaataagaagaaaaaaatacattcatttttctgaaattaaaaacttgccagggtttcatacctgttcatgattgcaacaatgtgctcttcttttggctttcaaacgtcggaattagcaattctttgcctatttttctaatattaaaaccagtttctgcatggaattagactggctcaataaagttacagaagagttaaattagcagtaattaaaaacttcatgcagcaactcctaaactttttctcaccattttcagagctgtgcacatggtaaatgctcaatacatatttaagtcaagtgaaagagaacaaatgaatgactggcatccattaagtgagaaggaggaactaataaatgccttgtttgtaatgaaagtcattttttgcaactagtctcaaagatcctcacatacgacattgctcaatccgaaacttgaacacagccttcctgggcctacataaacgtagtctctctggatctcagaaaaataatgacccagaccacacctttcatctcttctaagttttccatgtaaagcattctccttagagccctggaaaggttactaaaattttgacccacttaatcctacaccttcagggcaacatggcattcacctgtggtttccttaatgcccaaaccagccagccaacctgttttctgccgtgttaacaaatggacaggacacaggcgccagaggttaaactttcttcctcttcccccatgtccccaggtggaccattattaccatccctattcccaagcaaccaggtagccccttcctctgtgccaagggaagaaaacaccatgcttccctctcctgagagaccttcaagagtttagagacgcctaagtccagctgtgctaaaagataaaggacaataatgcaagtctgctctgagctgccaccatagccagacatagggtagccctgaaagactagaaccaaggacagagccaaaggtgaaagaaaatatgaaaaagtgaaaacacagtatttaaacagaattttccaacagcctgcatatagtgaggacttctcaagcttctgaatccttttccattgaattgtgcaatggcacatgtatgagcaaagtcaagcctcctggctcccaggtaggcacagcccagttcttagctcctaggaagcttcagggcttaaagctccactctacttggactgtactatcaggcccccaaaatggggggagccgacagggaaggactgatttccatttcaaactgcattctggtactttgtactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatgggtaaggcactgcgcctcgttctccgtcggctctacctggagcccacctctcacctcctctcttgagctctagaagcattcagagatattttataaagaaaaagatgttaatggtaacacaggaccaggaaggacagggcagttctgggggaggtgggagggcagagaagaggtctatggaaatctaaagcgaagaatttcttttaaaaggtagaagcgggtaagttgccctcctatgggtagagaatttattctgtttccatatttaaaattaggactcaatcgtgaggggaggaagctaccttaactgtttgccttaaatgggcttaagggacattttggaaagtgctttataacgaccttttttttttttatttcttctctagtttaagaagaaaataggaaaggggtaaagggaaggtgggagaaaggaaaaagaaaattgcaaagtcaaagcggtcccatcccgctgtttgaaagatgggtggagacggggggaggggatggagagaactgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgccccccgcccggtgctgcatcttcattcgaaagggggtcgggtggggagcgcagcgtgacaccccaggagcccaaccctgcggggacagcggcgccacgccccgcgctccccgctcccgactccccgccgcggcttccaagagagacctgaccactgaccccgccctccccacgctggcctcattgttctgcttttaagagagatgggaaaagtgggttaacatttttcttttcggaagcaaattacatagagtgtttagacatagacacagataaagggttctttgaagacctttgatcgtttgcgggaaaagcttctagaacctagacatgtgtatgtataataatagagatgacatgaaatcgtatataaagcaaaagaggtcaaagtcttaagttaagccacgcgaaatttccgttttgtgggtcagacagtgccaaatatcggcaatttcataagctcagagagacaagacagtggagacacaggatgaccggaaaagattctggattcagggccttcatccgcaattggtcttgtgccttgagtgcccacggttctggcgctcagtggccccggggtgaaaaggcagggtggggcctggggtcctgtggcagctggaagcacgtgtcccccgggacttggttgcaggatgcggagacagggaaagctgccgaaaggactccatctgcgcggctccgccctgccctaccctccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccccttcccagggattcagggagggctgtctcttctcgcccacccacggtccgcggagctcggggctttttttcccccagcccaagccccccgcccaccctctgttctctatgattttccagaatggagaccccgcgaggggcttctctaagggagaccctcgctcctccagcggggcgcggctcggccccacccctcccagctgaggcccagagccgcctaccgctggccgggtgggggcgcacgtggcgactgggtgtgtggagcgcagccagccctgcagagccccgcgccgcgccctgcgctcccctccccggagttgggcgctcgcccccgcggtgcagccggggagaccggtttctgcgcagtgtcctgagctacccccgctttccacaattcgcagttcactcgcacgtccagaaaggttctgagaatgggtggtgggggcgatctcgcctcgctttctgcacccctcagaaaggtttccgctgcaggctagtggctgcaaactcatcgtcatcatcagtattattatcatttcaaatcgttgttattatttaatgattcagtagccttgtttgttctcatttgttcaaaagggacgtggattgctcttggttaaggattaacccttgttgcgttcgctttgcttcctcctaattgccctcatccctttcccccacaaaaaggtaaatttgtctccagttgttcattttaagttataaagcaaatatatttttgcttcctgccaggattatgtatgttcatgtggctaagatacatgtgcaagtgcttgctaagagcagggtttgtgtgccaacgattgctggaaaattctctgcaaagaattgtttgtggctgcaatgggtgagaatacacatatataattgagatgatcttcaacataaggttatatctataaatatataaatatagtttatgcacaaaattttaagttttttcccctgaaactgttcttccaactgctgattcttgatacagcctcaatcctacacagatacatggatcgtgaaatggtagccgccatccaaataaaaatcccaccccaaatatgacaaacgcaagcatcctttctggccataatttaactgcatttgcaaatcatgaaaaaaacactacttctgcagtattaaaataatagattttgaaattaattccaatttcaaagataattaattatcagggcgagtgcttttttcctgattcattaaacaattatgtattcagcatgattgtaagaggtgcatataatattccccattatcttttctaatgaagtgggcaccttctgaatggatatataagtaactagaaatgaaaagctgaggatttggtcagaatttcaggataaaactgaaagaaatggcagtagtttatcaattaatctcatgtatttagtttataccaggtgagtaagctgagcctgcaataaacactctctgtcccagtgtaacacgtcgcaggtagctagaatgataggataaattaatagaccttgtggtgtttgtctatgcacgttaaaattctctgagagaaagtatattttaaaatgataattaagattggacatttgtgctattaaaatctacaactttagtcaaaattcacaatggtttttttttacaataatgtgacttacagatttgtagtaaattattctattctaaaagagaaatgagtgtttttattgttacagctattacctcattaatatttttagcaaacttttatttgttgcattgaaagcagttttaattactttgggtttttatttttcaaattactaatggatagatggtggaataagcatttaatcatttggcacaatatgacttccatcaaatagctcattctcagtgattaaaaaatgctacaagaggctacaatttactcagattcaggaaatgtcctttcagagtgccataaggctgattcatataataaaatagttttcttccctataatttaagatcaaatagttacttagttctgtgaatacctagcagtagctatcaaacagaattttaaagttaaatctgtacaactaacaatgaagtggaggatgaatcgatacatattgaatggaagactttgtcattgataaattcaggccatctttaggaaaattccggatttatcaatcaccattattttttacttcaactgagtgtgactgatcacatgctcaggctaccttggtagctcattgctcacaggaggctgaaaaaagctggcctccgagcaggaggaagctcagagcacaaacctaggcctgggcgtggccactgggagctgctgatagcgaaccccagctcacaccagtttcttttttggtcgtgggaagaaaaacacatattatcctgttgtcacaagatctgtgaccttatatgaaaaaatgctagaattttttcattaaaaaagaaaatactgaactagccagtgacccagatgttttcagaacctagactggttctgtccattggaaaacctcggtgtctgcattaacttttcaccacactagagggcaatcatgttctctaaaaaagcagatgattgatgtaaacctagttccaaatattaactgtttaataaaatcttttcttttaccaggaacattcaagtgtttattcaataagctgatgccatgctttaccctagtggatgaacagagcttgtacaattttcaaggagacaggatgaaatgagtggtcataatctgaaagtagatacacgccctggttaattattccctgatggttttacttctcagttttattacattgttattataataccatttatgttacttctgagattttgtagtggataaatagtagaaaaatgtcagtagtaatagcaaagttatttagcagccgaatattttaatgcttaaaaataaaggaataaattaaagaaaatcattgtttacttcttcatcgattgaaatgtgccccctgttcagagcacatctgaatatcagagtctccacctgcagagaacatgcagcttagcgagtaaaacaggcaggtatgtgatactgaggaggtgtaccaaaaactgactgctgttatttttcccatcttctaagtctgtctttcttttccatttaaagatacctttttaaatctaatccaatgtgatttcaatctagttttatcagatttcaacaattattgagcatctccttgtagtggttttctgtttattagaaaatcgatgttaattttaacgaagtaagaagaaatatataagtataaactaattttgggtatcatcaaaagtggattttttaaatatgcattgatagaattattttttgattacattttatgtaattctaatccagctataaaatatttaatagtgtcatattactgtgttcctcaaactttgatgtgcatatgaattacctttgattttcattaaaatgcaaattctgattcaatacatctggcttgaggcagacattctgtcttccgaacaagctcccagatgatgctgattctgaccactaaacacatcagttttagggatattaacttgtaatatacaggtatccctcctggtaagctctggtattatgtcttaacatttttaaatctatggtaatctttacaaaatattttacttccgaactcatatacctagggattttattactctgggaattatgtgttctgccccatcactctctcttaattggatttttaaaattatattcatattgcaggactcggcagaagaccttcgagagaaaggtagaaaataagaatttggctctctgtgtgagcatgtgtgcgtgtgtgcgagagagagagacagacagcctgcctaagaagaaatgaatgtgaatgcggcttgtggcacagttgacaaggatgataaatcaataatgcaagcttactatcatttatgaatagcaatactgaagaaattaaaacaaaagattgctgtctcaatatatcttatatttattatttaccaaattattctaagagtatttcttcctgaataccatgtgagaaaattcttaagaatttattgagtatgactgtatatttgaaaagagtgttttcttctgcttatctaagccaataaaggatcttcattattcaattctaactttctaaggaagtcaacctacagatcagaaagaggatcttcaaggaatagcatcaaagacatagtcaggtctcccatgcagtgactggctgaccatgcagccattaccacctttctggaaatattatgctgcaaaaatgatacaatacacgaaatatctcaaattaaaaaatataacatttcccaaatagggcactaaaaacatgatcccaaataaaactagcttcagggtttgcagaatatactgttactcaacacaaagttggactaagtctcaaagttagccattcagttgttgttaacagttcatttcagggtctctcagaagctgggaaactttccatttttgcaatttcttgtacattgaaggaaaggaagacacacttaagacagcattacaaaagtaattcatgttttaaatgtttaattctggcagtcgggcagggctctctgtataacctcatttggagatgacaaaaatctaaacttgagggcctcgagccaataagtcttcctatttctttactcaaacattttcccgcaatggtgctttctttcaactgtttttctggtgtattcataaattccagattctctatgggaagtaacttttattgattgatttaacccttgtatagcacatataacatgcaaggcattgttgctaagaactttccacatattaactgtgttaatcacttaataatcctaagtaggttctattacagatatggaaactgaggcacagaaagttgaagtatcttactcaaggtcacacagttagtcagatccagaatttgggcccaggccatctggcttcggaatccatctttcaccgattgctgctagtctcatatctgttccatgttagaggtgagctcccattgcagaggtcacacctgtgatatcaccattttatttaaacagaccagagatggtcttctcctttctgatcacagactcaccttgaagagaaaatacttccaaattgatgcctagttttaatagcttacctggggcttattcaaataattgccatgatttaggctttgggagaaagagagctatgaggccgtgtgggttgtaacgtatgagacacatggcgttctgcaggctcagcacagcatcgatttctggtgggaacacactctgatgaccagttccagaaataacattgacttaatctcctcagtcccatcatggttagcacatttcaaaatgcctccttaactacttccataggccagagatatttagttttaacattttgttgaataaaataaatttacacattcacatttaatataactattagatgttatttcaagattctcttcatattaccatcaaagcaggcaggcaggcaggagagaactgtaggaaggttttgaatcccttgtgaaacatttttaattatcttttaataaaggaatcaggccctgtcatttgtcaaggagacatttgcagtagtaaagcttgtgtttataatatccatttttattagtcatgattaaagataacattcgtgtacatttgttctcacaaaacacttttatatgagtgtaaaggttaattaatgcatttcagccatcattttgctggtcatgtggaaatatagcttctttaggaattgtacttagagtaggagccacatattatactataaaaccataacaaaaatattttaagtttgttctcacttgttgttgacctccagagtaaaatatttaatactctggaaagttatgggtttcaaaatttattttatggcaagaaatagataattacagttctcatagagcacatttaaaataatttatttttatagggcaaaaatattgcctaggactgaatgatttttttttttttacaaagattgtaaagcaacgcctgcaagagtgcccatttagcagttattcttctggaataattgtattttggatgttggagttcgcacattaaccattagtacaagtacccaatataacaatagatcatcaggataataaatctgtccatcttttagttgtatgtctttatatcaggataaagagaattgagtgaaatttatctaaacctagtcccacaaatacttttacaagagagcatgttaaagtgtaaattaaatttttattagcattctactctgtctttggaagttttttttccttatgaaatgcagccataaagtttaacttccattaacaaagctgctcacagtaaacctattataataatagtttcccagtttgggcttcctagtgaggagcaacctaactcacacgaaacaaccccaacttataatatattgactgttacaaaactgagaccagaaaatcccatcaagatggtactgttatcatttccagactctcgggaagaacattaatcatctcaggcacttttaggatagacttattgcagcctccctgggaactctgcttcagaacataattatttttattaatgcagagttactttttatttccaacaaaaatatctattgttattatttaagtcttacagctttatctgagaaattccaattagcacccttctcataataaatattcaaacacatgaaaaattaccaaagttgttctagtcttttaatgacatattacatgatcctgcactcttgtcactttaaaaattatctttttattatatttctgatgatttttttcttatatagttttttaaaaggagcaggcaagcatagaagactaaaaaatgttcaaaagaaaaattaaatcgcatgatctatctatatgggaccttgtcatttttagaaaacattcacctgcttcatccttttgaatcttcatataatccctctgagatgggcatactatacaagttgtcttatttaaagattggtaaatttaagctcatataatttattcagtggcaagcctcagaggcagactcggaacacaggtctaatatatattatatatatattataacatataatatatatattacatataataaagttgtgtatattatttacctatcaaaatatttatatgtaatatataaatatgttatatatcatgtatgtgcctatttcatacatatatacacattcatgcaaaataaggtttagcactccctccactgtcctgtaataaaacatgcacagtgagaatagtcatacacgaggcatatttgtcttcagtttaaagtcattgatagtcagtgtcactaactaaagtaaaatagattggagcaccaactttgttctgaagcctgtgccaggtattatgagaacaaaaataaaaatgttcctcacccttggtggatttagtcttttgcagaaaaaaagatcctgtacatgtcagaaagttcaatagtaataatggtaatttataactataaatggaagtcaccatctcacaatttcaccatcttaacaattttgttaaactgccctacaatattacaagatagtacataatgatacactagtaacatcaactaggaagtaccaagatccaccaaaaggctgaaaaatttaaatatttaatgagtccatcaaccaatctggccagagaattctttaattaaaatgcttcccaaattttactgagaatcagcagcgtttgaggagctagcctccacccccagaggttctcactctattaggtctgaagcaggtcccatggatttgcatttctaacaagctcccaggtggtgctgatgaggctgattcagaaccacacttggagtagacctaaaacagcagtgacctgtagggtccccaagcagcaggccaggacagcatgtgagttacgtcctctgtggagctctgcaacaaggcgtcaagaggtcagagtctaagtccccatcagctctgcccttctccaccagtgctgctggtgctgcatggaaggaagagcccagaagggattctgagtttcagtctttactcttgctgacgcaccttggtcaggtcaattttcctgtttgttcctctaattcagcatctgtaaaatagccatgtgaactgccttgtccatatcagagggtctttttcagactcaaggaaaaaaacgtgaaagtgattagtgtctgtcaagtagtatataaatgcaagaagttgagtttttaaattgtcattagatataaatacccatgtgcatgcatttagaatgagtaaagagggaacaaggagcgcaatcaaaaactgcgtcatttgctttttgaaaaatactttctatgtaatgaaaagtgaaataaaatgttaattgagtccctctgacaacagcatcagacgttttgcagttcttgtgattagaacccacctggccagcccttcttcctcctaaagaagagccttcttcttcttaaatgaaggttggctcagaagaagcaattaactcattcaacgttttgttacagtcaatccacatccaacttttccccaactcaatctgctttaagggaaggatggtaagtggtggcccaagatggcaaccatcaagcttagagaatctctagaagcaggggtgtccccagcaagtagacactgaaaatatgagagggctgataagccagagataaaactcagtacttactttgcttctagtccatgtctacccctttcttggcaccaccttgacactaccctctgagtccaccttcctgagatggtacaaactctgcttagacaaagcagcccatgtccaaatgtgttagggctcagtttaaagctgccttcaaaagttaaaacagaagtgtaaagttctgtgcaattaaaaataatcagcttgtcttggaactcaaacgaatgtaaaatcctatgaaaattaaaaagcagtaccacaagttaccccaaaagtccttaggtcagtaactgttcctgttacaggtaagagagagcgtggattagaggtgggcgtgggtatccagtggacatggttttgaaccatgctccactactactcactatctgagaattcttaaatttattaatcatttctatattataattttctcagttatgaaatgggaaaacaatacctaaatcacatggttgttaagtaagcaattgattgttaagcatttggtcatcaaaaatattaatccccttccctgattccctagataaatgatgaaaatactaaataaaaataataaaaatttaaagtgaacatctcaattcttatactttgttaatttctacatgtattacaaatctactagaaattacttggaattgaggaaatgattactgcttaataattctttgtggtagagggagagttggtatcatatttatgagacagcagccaatatagtatatctcaaaggaaaaaatccattctacataatgccagaatttaatagttaagcattttatctaggtcacagcacaataagcaagatggataattaaaataaaagtatatttctcttgcatatatttctcatttcatgtttccctatcatattttatatcttaccttacttcaaatacatatataccttcaataaaactgagccttcttgcttacccaggaagtttcatcattcagtagaaataaaagatgactttagaaatattaaaatacaaaaatctacactgaggtcttttgaatgcaggaaaaagaattatatcacacacacacgtacacgcacgcatgcatacacacacacagaacctctcgttctttcttaacatcttatcaatccatcagtttcactcccactccgtatcacctgactgtgcacaatatctcattgccacctcccagtcttctccctgcctggcaccctcctgctctcctgcttccactttaaacacccttccttcagctaggtcttttctttcagggatcctcccgttgctttcttatctggatcaatttagccttcctcttctccacccattagtggataagcacgacaaagacactagagtcaaataatacaaacagaatataccttagatgagtatggtgatgaaaaggatatggatacttagagtttagcactattctctcagccactcaggaaagcaacgcctttacaatcaatagtgtttcaggtaccaatcaataatctgttattgctatttttaaaatctataaggtatcagtaaaatgtaattactagagcaacaaagatatcttgtgaaatcaaattagtattcatccagcaactgagtacaaaggtttaagggaggataactaccaataccaaaacattttaagcattttgttttgcctcctaaatatcaaatcatgtaaatgtgtggtacataaattaggaattatatttatgacatagctgcagacatattaagagaaatatgtgcttatatttacaagtatagtacagttctttttcatattagatactgttgatgataatctgcatataaaaatgctcaatattttttcacatttataagccataaaatacagctaataaaatgtgtttctactttctcataaacatggaatagtgacaaacaaggagctttatatgaaagcaccattacaatttaaactctcacaaggtcataatatattgcactaagcaggagagttcagcttatttaaaaaaaaaaataaactctaatgaggttctggaatgcagagccaaagcataaagatggaaataaaagaattgcatgtcttctgaactgacttggttgatgatttttttaaaaaaggttttgtgtcttctgacttggttgatgattttttaaaaaaacgttttgtggtagaacaaataaggtaaatgaaattcagtatttaggatgaaaagtttttctaatttcaggaacaacattgaagaaatattgaactaagcagctttgaaagaatcagattccatttgttgaaatttttctgagaatgaatttttttaagacagtgtacacagttgcagtgtgtattggttatggattgtggcaagctatattacaacttacccaagaaataaggaggctgggcgtggtggctcacacctgtaatcccagcactttgggtggccgaggcgggcggatcacgaggtcaggagatcgagaccatcctggctaacacggtgaaaccccgtctctactaaaagtacaaaaaattagccgggtgtggtggcgggtgcctgtagtcccagctactcgggaggctgaggcaggagaatggcgtgaatccgggagggggagtttgcagtgagccgagattgtaccactgcactccagcctgggcgacagagcgagactccgtctcaaaaaaaaaaaaaaaaaaaaaaaaagaaagaaagaaagaaggaaaaaagtcacttgaaaagaatactggactttgtgtccagcttgcatagctgaaaagaataaaaacctgtccacttaaactcattgcaaaaagaagatgtcactcctacaaatagcaaagagtcatgaaattattctatccagaaaagtatacatttcatccctttggataaattttagaagtgaactatgaatacatacggtgaggatagccagctaagaagtcaagaaggatttctcaaatttgctgctcagaaagatcatactctccacaaaacaaataatagcaggctttccaagtcaaccttgaatccagctttcctttatctttccttcttgtgaactttcactagtttactatctaacaatgaatttgacgatagccacataccatcttatagcaatatttgttatcatatcccttgttatttatcattcacctgctctgcttgagccagctacaagtcacatgtcccacgcactttttcctgtttgattttttacagcactttgagacatgtctcattattcctacttgacaggaaagaagccatggaaagttgagtgacttgctcctgatcacaaatgctggccaaggaagagtcgagtttcaaatctaatgatctttccactgcactctagattcctcattttgaactatttttttattttttgcactatagacttttttccacattttgaactgttttttattttttgcactatagacttttctcttatacccaactatattgatgacttcttttaggctagaaacttgtttcacttactttccctttcttcagattgctgcaatattggccaacatgtattgggtacttactgagtcaagtactgtgattgtgccaagtatcttataggaggattatcatcctcatttttacaggtgagaaaggaaaggaggtaaagtcacacacagccaacaaaaatggtagcaccaggatttgaaacaaatcagtctgacccaagttgactttgttaaccactgtatgcacagtcttcttagacatagtaagagctctaattgtgtttggtgatttgattattatgacaaagtaagtaagggaagcagggagaattataagaaataaggctccacaacacttggctatagcaaagccccttaaaacttcaaaaggtcacccaaagaataaagatcaggctgggagcagtggctcacgcctgtaatcccagcactttgggaggccgaggtgggtggatcacctgagttcaggagttcgagaccagcctggacaacatggtgaaaccctgtctctactaaaaatacaaaaattagctggatgtggtggttgccgcctgtaatcccagctacttgggaggctgaggcagggagaatcgcttgaacccaggaggtggaggttgcagtgagccgagatcatgccactgcactccagcctgggcaacaagagcaaaaaactctgactcaaaaaaataaataaatcaatcaataaaataaagatcaatttggagaaattaatgcttattaataagcaatgtcttgcacagcacttcagtttctcaatacattacctaactcaatccttacaacaacaccctatccccattttgtggataaataaactcatgttcagaaggttgaataaattatctaaggttgaatagttcctgacctagagctcaaatcttcagtttctatcatattcttgcccttaccctggggtagctaacattcactcactagtattggagctaaaataagggagagaacatataaatgaatacaaaggagacattcacctgccttctctttctccttacatagagaaggttgattatctgctattgtgaagtttgccttttgaaggatagaaatgagaagactttcttaaattttgcctctacgccaagaaattagagtggtaccaccagtagttccattttcaaactatcactgtagctaaagctatgtggtaagggccaaggaaaagaagtattcttgcacttcaaaatgcactgaaataccagtcagtagcataatataaaggaatttagtggagagaagagttgacctcaatctggctccaacatctcggctcttaacccctaccctacacttgttcttcatggggaagctaattgggccactggaagattcagcagctaccatttgcagctgagggacagcccctccctgcttagcaaccaatggatatgcatttatggaacacctgctaactgcgacacacactcctatgtatgagggaaaatacaaaaaatgttaaaggagatgccttcccttgccctcaggaaacttaagtatagttgcaaagaaatgattagcagcaaacgaaaccatggagaagtaagggctaaggtctgtgaaacaagcctagaaaataaccttgtccttgaaaaacacaaaaagaaagaaagaaagaaaagaaactccaaggcccttgtgaaggaaaccattaagtttgcttcacttctgtttttaggaagacacaaacccagtcttaatgaacctcaaggccacaactactggagacatttaggaattgtcaccacattctaatgtatatatcctctgtttggcccttcctattaatattttgtaaaatttttgaagatatgagcaatgtttaaaaccatgaatccccctttttttataagtaatatttaggctgaataaacaagagaaaataggacataaaggggagccaacgtgtgccttcatttataatgtattcccaagttgtgagtttggtttatcagcaatttatcatgccaaattccaagtcatatttatctatgcagatcaaacacttgattctatttttgccttaatttttttattgggtatgtttatgaccaagtcatatggtattttctgtgacagataaaatgcacaggttattccaatctggctcagccagtcatagcaacatgtagtccttctcatgtcttaagaatgagtatcaagaattcaaagggagttccagatggcatccaaaaagcttacagtttatgcatcacttattctaacagtagaaaaagaatatttgaagccaaaaatagaccttgcatgtagcatgtggaagagtagaaattgccctgatagttaaacaatttgaaattcaagacattaatttctttatgaagcatttgtcacatcataggtaatattttatgcctatcatatatatacttattatgaaatacaaagaaattattcattctatctaagactttgtatcctttaccaatatctctccattctcccacctccaccctagcccctggaaaccacccttctactctctgcttctatgagttcttttttagtgagatcatgcagtatttgtctttctgttcctgtcttatttcacttgacataatgtccttcaggcttatccatgttgtcacaaatgacagaatttccttcttaaggctgaatagtattccattgtgtgtatgtagcacattttctttattaattcatttgttgatggatactcatattgattccatatcttgggtcttgtgaataatgatgcagtgaacataggagtgcagatatctttttgacatactgattccactttgatgggatatatacccagtagtgggactgctggatcatctagtagttttatttttttttattttttattttttttattttgagacagagccttgctatgtcgcccaggctggagtacagtggtgccatctaggctcactgcaatctctgcctcctgggttcaagcaattttcctgcctcagcctcctgagtagctgggattacaggcacgcaccaccatgcccagctaatttttgtatgtttagtagagacggggtttcaccatgtctcgaactcctgtcttcaagtgatccgtccacctcagactcccaaagtgctgcgattacaggtgtgagccaccacgcctggcctagtagttctgtttttaattttttgaggagcctccatactgctttccataatggctctaggaatttacattccaccagcagtgcacaaggattgcttttctccacattctggctaaccagtctcctgtctttttgagaacagacatttcaacacgtgtgagataatatctcattgtggttttgatttgcatttccctgatgattagtgatcttgtgccttttttcatataactgctggacattaatatgccttcctttgagaactgtgtatacaggagaaaataatcacttctcagaggagctttcatttcaaaatatccgggaaaaaaatagaaaaaatggaaaatttatcctagagtaagttgtcttttatattttgaccctgtttgtgacataaactggatgatacaaaactggaatgcaaaggctttaggaggattacttacttacttgtatattgctttaggttgtttgcagaaaattatactaattgaagttcaggctatgatgtgataaaatctatgtcaggagatgagtctacatgcaaagtttgaggaagtgacatttgagtttcaaaacaaaaaagcaattttcaatgtcatatctaggttaacccaaaagatttctttcaccctatttagctgcctctaagatggatgctgaggataattacactgtagaacaataggacgatgcttcacactcacctcacaggctctgttattcccacatactgccagagatactccaaaataaaatcactgcaacatcaggcagttataaacctcaacggtattattttctatttatatacagtatattttatattttacaagtataaaatagaatatatttattctattctctttgacacaaagtgaccataagacatattacttaagtatgactagcaaagtcatggggcttgtcattcaggaggaaactcttaactaactgttcagtttttgttcactgcaccatttacataagccaaactaatgcttcacactgtgcaaaacaatgcacagtgttgtgaatgaatggctaaaataaaactctaatgagtggggtttgaaaaatgcaactttagaaaactgttgagaaaatgttgcacactgcgcattttacaaaatttcgttgaaggacactggatattctttttaggattatggagggaagcaaaattttggctcctacatgcagtttttgtggcctttgcctgaaatagtcatctcccattaattatttagatatcattcatttcctaagacaacatttagggagactgccttaagtacaatttgtacactacccagataagaattctttttggtgaaacatcgataaatattacttggcagtaacaccaagttaaaatatttgtttcacagtcgacgttaataactattatagataaagtgaattttataagacatactcagatctaaaacagcaatatggagctcttcaaatccattgaaacttcataccagcctacggaagtagaggtttttatgcaaactcttcaagaaatatgctctgaacttttaattccttagattgatagaggaattaaatcatgatataactaataggtttgtggtacaaattgctgctgcttaatctgactctgtgtcttcccagtgttctatatgaattagatattccattatctaaagacaatcaaccccatcccacggtgatagctctaggactccctttgagttcattaaatctgtattctcagtctccaaacttctggttaattcaaacagaaaagtcaactggcccatgaactaaaataaagtcatctgaattttttttttattttgcagtgtgataaaagtctcgcactttttatttctgaaagtttctgctttcactgagagcataataggctatccacccttatgcaatcttacatacaaagtcatagtcaggctaaattcaaaaacacatgtgagatagaagtcaacgtttattttctggagaaaagccacacattacaacaaagtgaacaatgaagctggcatccttatcactggtgaccaaaacatttgtgactctggacattggccccacaaatgcgataaacattctgcataggaagtgagttttgctaattaaaaatggatccaaaatactttctactcttcagccaagaattaaaaagtaatagggaggaattgaaatcacttgggtgctacattgagccattctggagaagcaattcagagaatgtcatggcagcctcaaattgctgctcaggagcatcccagcttagaagattgcaggaaaggaagagcaaagtcattcttacatgagaactgtccttaaccagatgaatagactctccattttttaccctggctttgtctcatttaagtcccaaccaatctagctatcattttaggttttactacctgctagtatttaggagcttagggggataaaaaaatccctcaatactcagaattagacttggtgataaaaatcttgacacataaacagaataaagcgctttcattactcctctaaaccacagtgtcatttggtctctatcaaggactgtaagaatttctttcatcaggggaaagaaaaaaaggacaagagcctgcaagatgtagcggaactctcattaaacacagcaggagctttaactggaatccagagtaaggtgaggtaccaggttacaacaatttactgcttttattacaattttgatcacaaggactgattcatgtcatctagtttcttttccttgtcactatcactggtgctaagaatacatcaaattgaaatttaagagcctcatatgtttctgtataacccagtgatgggttgtactgctttgaccttcttaaatgtccctttatttcatttgatatccattcccatagaaaaactataatgctttggttggtcaaaatattaatctttcaaaacctccctggcttagaaaaccaaatttttgtagagagagatgggtagaatctaattttattctaaagcaattagcattacatcatcacagcagaaatatctagaatattacctcatgtcagtgatcttctgatatgttaaaaagggtattttaaaatctgagttatttctttttctttttaaagttacatcattaattacatactcatcaaccaaaatattttatgctccaaatttgaaccgatatagtatgtaagaagtgttcaaaatgaaattattttggtctattttgtctttgaagaagatcacagggatggacctcccaaaaggatttttaaatgggattacatatctgacttttaaaaaaaattatctgaccttgagttatagtgccccaaagtaagcaaagttccaaacacacagtatcatcagaattgagttaaaattatcaccaggggcttaatttctgaaattaaaaaggaaatgttatttccttatgaaaagaaaaggaaccaaaaatgaacttcaaggtagctgatttctgtctatgttaagacttaggtaatgggagaaagggaaaaggaaggacagaattaggagaggagcagtgtttaacaattgcgggtgcaagactcaagttttttagaatccattagcagagaaccctatttctcccattaactgctgtccttttaaatcctggcaccagctctgaggactgcagggtccatagctagtgccccactctacccagtttaaagacaccactgcctggaaatgacaggggtttttttcttaaggaaagaggtgctttctgccacgtatatataaattggtaagcttcaaataaagtgcttttgtcctttctgtctatcagaaactgtgcaaatcgaattgctgtaaaaccaagggcaagagacatcaatcctgcattctatagcatctgattttatcctttatccccaggcacatttcaaaaggaaaaaaatgaggttgcatttaaattgagtatttgggacttgccaggaaaacctcccgctagactaatatgattgcagggaaaacaagagaaaggaaaagtggagagggagtgtgctaacagatcctgggcctcgtcagcagagccgtcctgagcacaaggccatggtcagacatctggtcccgcgaatgacgttttctttatggtcattaagaacaccagtgtgtcgggacacaaacaagtattcctttcagggattatgacacattttctcccaaagtagtatattaatgacatttccagagcattctttactatcttttatatgtgatcaggaagactaatacatatcactacttcttttacacacagcattagccaaaactaaagtgtcaaatacaattttgcctaggatgaataaacagaagaaatttttatgatactgcactatcaattccaaattaaataacaacaaaatgataagtgttaaaattcatattaatgattgttcccacacaagccggaaaaaatctttctaagaagtctttcatgagttaatcccatctttcaaagtgttcagtggctccgaattcagttactgtttcctatcagttcttctttcattaagtctcttcccttttttttctctttgcactatttcccttagccgggtacataatctgctgtgctttattcatttgtgtcttaagtttgtttcccgatgacatacctttccagcaacgccatctggggagtttgggcaactgtaccacgttaggaggaaacccttcttcacaggagagtgtgcctttgctgcagggaaggaattaggatttgcttggactgtggttgcagctggcttttaaggatctccttagaatgcaagcaactcatcaatgagaatctctgcaatggttgtcactgggtagagtcatgctatgtggggtcatagcctttgaaacaaataacagtaaagataaaaatgctattaaaggaatcaccacccacagaggttaactgggttttgtccccagaccacctcgaacaagaaagaacatttttatcagtcattttcttagttttagctgataaaacaaagtaccatagactaggtggcttataaacaacagaaatttatttttcacagctttggaaactggaagtctgagatcaggccgccagaatgatcagattctagttagggcctactttgcttttgcagactgccaacttctagctgcattttcatgtggcaaaaggagattgagctagctctctggtctcttcttataaggacactaatcccattcatgaaggcttcaccttcatcatctaattactctccaaagaccccacctccaaatactatcacattgggaattagatttcaaatacaaattttgcggggacacaaatattcagtccataatagtaatgattactcattatacatagggctctaaatgtgctagcttctgatagtttttacactcacttctctttattagcttgtcaagcataattagggcagtggccttactgaaaattattgaatttagtttcctaaggacagatattgaggagttttttcttcactaaaaattcacgttccgatacagctttcatctgttactactttgtgagatggaaaatcttttattttatttttatgtttggattgacccttcttaataaagtcggcatgtaatatgcttcatgtgtttctaatatgtgcttaattttgcaaaatgttttgcataccagaatgcatttctcttccaaaaaaggtaccagcctacaaaaccttgctgttactgttttcaattagttcatggaattaaatgtattaaatgttttatgctctggcagaaattatgattctcacttaactccatataaatctggatctgcctgggcctttataagtgacacaatttcattaactgaataaacaaatgatacaaagaaatttggtttagccttctaaaattccaaaggcgttcaacaaaatatctcagaatggatgttccaggacttttatggcacaggacaacatgtattgcttattttaagaaaataagctaaatagtgaggggattcttttagcagatcctcaggatgtgttaggttgaatcataggcaaatgatatttgatcattgcacctgttaacacattgaacctcatcctaaaattgtagagctagaagaaagccttctggcagtttttaaatagattgatttactgcaatttatccagaagcttcaccgttgtcactggctacatgtgactttggcctctgtggggctatatcctcatttgtaaaattggtggtgaggtaggtggacagttgactaaataatctcttagaataattctagtatctgtggatctaaagcatccaggggttgaatatgtttctttctggccaagaaaagatgcacctgtcaataatgcccaaactcatcttctgagaatcctctttcccaagatacccactctcccttgggttatattatagtaatgatcagaagcccctgccaagaagaaactgttaacctgggaggtctatattttatttcacagccatctgtttatactttctcacaagttagtgcacagtatacccatcattttctaccattttccttaatttattaattttactaattgcataattaacaaaagtaagaagattttacctccttatccccatctggtagtttgcagatacttggcctgatgacaactgacagtgatgagatactcaccaagtttaccagggcaggaggcttcctagagaaaaaatgagaaaatgaaatggggaaggggagtgaaggattgaggaggtgacaatctggactcttgcaactgcatggcaaggttggcacacaagctgggttgcaacggagggaaggagatccttatcagatgtaatcagagctcagatcgagggctttggtgtgtgtagaaagagggagagacaaagaacttaaaacagagctgccatttgaccttgcaatcccattacttggtgtatacccaaaggagaataaatcattctattaaaaagacacatgtgcttgtatgttcatggcagcactattcacaatagctaagacatggaatcaaactaggtgtccatctatggcagattggataaagaaaatggggtaaatataaagcatgcaatacaacatggccataagaaaaaatgaaatcatgtcctttgctgcaacatggatgcagttgggacccataatcctaagtgaattaacacaggaacagaaaaccaaatacagcatgttctcacttataagtgggagctaaacactgagcacacatggacataaatatgagaacaataaacactgtggactactagaggggggaaggagagaggtttgtaaaactacctatcaggtgctatgctcaatacctgggtgatgggatttacaccccaaacatcagcatcatttaatattcccatgtaaaaagactgcacatataccccttgtatctaaaataaaacttgaaattaaaaaaaaaagaaagaaagaaagaggctggaaatagaggctcacacctgtaatcccagcactttgggtggccaaggtgggtggattgcttgagcccgggaattcaagaccagcctgagaaacctggtgaaactctgtctgtacaaaaaatacaaaaattatccaggcatggtggagcgcacctgtagtcccagctaatggggaggctgaggggggaacatcacttgagcccaggaggtggaggttgcagtgagctgggatcacaccactgcactacagcctgggtaacagagcaactctgtctcaaagagagagaggaaagaaaaaagaaaagatggacagataagaaaatgcacttggagattaagagaaagcagcaacataggaccctggataatgtgtttgcttaataactatcctgatgagttatctgactattcccaaatgagtacgtggcaattcaggctgaaccatcagagtagccctccggaatcttacttatgtacaatagacctgcatgcacatttactagaatgagcctctctctctggtaatcatgtctgcttccactaattccatctgtttcctctctctccctcctatcctgctagatcttaattccttcgaccttcctttgtttttctaactccctttctttctcttgttatttaacctgctatactatgcaattgatctcctctgcactaaggaacatgcacttcagaattctgttgacatcttgcattcctttatatttagtgaaagaatgcaaaggagtctacctggcaatattcactctgcaggaggcaataattattattcaaattaaaggaagcagtaaagagaaattcagaaaaaatgaaatatactaatcttcagcttttcatttcagcctacaaggaaaaaatgaaggagctgtccatgctgtcactgatctgctcttgcttttacccggaacctcgcaacatcaacatctatacttacgatggtgagtaacctaggatagacatacccctgctagctagatcatttggaaaggttgacatatatttgtttcttacagctcctgatataattacatcaatattttgtagctctcactattgacttgccgtgtctagctattatgtccaattgattacctattgctgaaaacagtttgaatttggtgctaataacaacacatcaatgtctgttaagaaatgtggatggattcttattaacagccacatccagcatatcaacatccacaatatgtctaaggtctttctttgcaaataatttaataggctaagccataattggagtagatcataatttgtaagaaaatgctttatacttagaaaactcaagagaaagaatcaacaaccataattgtttttgctttattgtagtctttataaagtttctatactttgtatatacatgtcaaccagctaatgataataataattggctcaataaataaaactgacttacgactgaggccctagataaagagggtctgaaaagaaaagcctaaagaattagcatggcaattaacatgattgaggtgcaactctttaggtttgatttatcctgattcattttgcttactttggctctgccacaatccacatgatcttggtcaaatagatacttggattctctaagtctcatttaactctagcatcttcctcttggagttgttgtgaggtttaaacggtttaatgtaagtcaaatatgcaaaaccaagcctagctcattatatcactctacaatgatagctatcattatcaacatcatccttacctaattcagtcaatttaactaaaatattttatacagttctatgtatcctagatatccctaaggcatattttactaactctcaggctcacaaatatttttcttttccatatatgtaaagaaagacattaatgacaaaacaaactgaccttgtggcagttaaccccttctgcacctttaaagcctattcaaggactcaaaggcatttaccttccaaagttattctatcgtagcacaaaaatcataaatgctaattaactgttccataaggaaatgtcctccatgtgaaaggaattctgtctccaaacaaaacattcattagaatgcagggccaatgcctactttgtacaaattcattcggtcagcaaataaattagacagacctttattatttgctagatgtagctgtgaagaaggatccagctatgtttcttatgagactaatgtcgaactatgggttgtcactgaggatccagagttccatagggcgtagtcctcaccttcaaagaattcagggcttagtagaagagtcttacacaaatgactagaatgtagaacacagagtggttaggacaaaggagccagggatggtttttgctgggttagggaatgaaaaaaggggaagaaaatatgtgaagttatgtgtgagctgattcttgaaataagctgtttttatttgcctgcgttctcttataatccttttccataggcttccataatttttattgagctgtatttaaagttgaatagataattcaacatttctcgtaaactgtgcttcctaaaagagtccgtagagaatttcaaatttctgcagtctttaacttgacctggtatttctatgttagataataacgtgacttgtttattgcaggcaaacattataacaataaattattattattgtttacatttgtaagcactaagtatatggcttgtgctttgcattcagcatcctttatcatttaatcttcacaaccaccttagaaggaaggtactctttttatttccatcttttaaatgaggaaataaaagcataaagaagttaattaacttacctagtgtcacacagctattaagaggggcttactatttggatgcaaatataggcagttctaattccagagcctctaatctaaggcatttaaaaccccatcaccttatcaaataagctgtttttatttgcccgtgttctcttataatccttatccataggtttccataatttttataaaattgtatttaaaatttaagtataatcttggatgccatcaggaaaatgaaaaacatttttacatttgtgaaggaaaaagcccacatcatttccaatatagttattgagttagtattatctagactatctattagcagctaaggatctgaggtcaaggcctgccagcctggcattttacttgaccacaacctccatgtgcactaaccaggctgctaaaagaacattaacgggaacataacctgctggcttggttgccacaattttaaaaagacgttaataaattagagagcacttagaggttaggaaataatatggtggtaaagatctagaaacagtgtcattctggggcacttgaagatgtttagcctgggggaacaacttgaaatggaacataactgttttcaaatacttgaaaaatggtggtgcaccacagagaatggcctaatcatgggtagcttcagacttcaaacaaggatcagtgggctaaaaccagagagatggagtttgggactcaaagaatgctcatctgaaattgagggctgaccagcgaggttcttttaaaaatcattgcattttactaaattgtgagttctgtaattataaatgtcctagcaggtgctagctgtcatcttttctattataaattatactattttatgttataatttgtattatacaggcttaaaacataagggtctgataatctgcttatctttaatacataagccactgatagaaaataagtggctaaccattcttcagttctttttttaattgacaaaaattgtatatgtttgcggtgtatggcatattttgaaatatgtatacattagagaatggctaagtgaagcaaattcacatatgcattacctcacacacctgtcatttatttgtgatgagaacaaaaaatctactctttcagtgattttcaagaatacagtacattgttattaacaatagtcagcatggtgtacaataagtcttctgcggccgggcgtggtggctcacgcctataatcccagcactttgggaggccaaggctggcagatcacgaggtcaggagttcgagaccagcctgaccaacatgctgaaaccttgcctctactaaaaatagaaaaattagctgagtgtggtggtaagcgcctgtagtcccagctactcaggaggctgaggcaggagaattgcttgaacctgggaggcggaggttgcagtgagtcgagatagtgccactgcactccagcctggcaaaagagggaaactccgtctcaataataagtctcttgcatttgttcttcctgtttaactgaaattatgtattctttgatcaacatctccccagtctccacccctaacccctggtaaccacaattctactctgcttccgtgagttcaactttatgaatagtccacatgtaagtgagatcatgtggtatttgtctttctgtgcctagcttatttcacttagcatagtgtcctccaggttcacccatgttgtcaaaaatgacaggatttcccccaacttttttaaggctgaacagtattccatgtgtatgtgtataaattagattagtagatgttgccactccctcctccaccacagtggctctatccctggctcctggctccagccgagtacactagaggaggatattctaaacagcaacaacacaggagcaaagacattacaatggggtgttgtcttattgcccccattagactgtaagcatcttgaagacaaggacccccatcacagagtgatgttgtcatccctggagtgggcactgtgcatgattgatgactggaagcaatgaacatacagaagggcaaaacagaaatcagcaggatgctttgcatttcagcattgactttgccaaatatgcccaactgttcagggagttacactggttctaacgtagctcctgtgattcctaagcacaggaatggtgataatatatataatggtgcatgcatatatacgcatatctagataatgatatctcattatatgtgagaactgaagaactccgttatgtttctcgtctaaccaaaaagggcctacagctacgataatttccaaacaaataaatctgtgctacttgattttcatgcaaagctcatatttgttcaaaaggaaaataaagcttaatttaaaatcaatttaggctatttttatctaagtatgcttaccgttattcaactccctgcagatattgtcaaatttctcaatatggtaaatatttattctgttaaaatatatccatagttacactaaagacagagaggtcttatatgttctaaacaacatagagcaaatgctcataaacagcattttattcctatctcccggaataacaacgctacttccaattgctggaatctaaattattaaaataaacccatgctgcaagctttgtatgcttaacattctcaaatgttcacttttcagatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaaggtaactttttccataggttttccttctctctctccctcccctgctcctccctctcacacactcgggcacacatgcacgcacacacacacacacacacacacacacacacacacacacacacacacatacagagagcaatgacagctgaacctgtgccatgccaacatgtataggttttcagtagacacagagccaggctagttggggtaaaaactgtaagatagatgctaattttaggctagccaaaccagagctctcagaaatccaaagagcttcagtgctctagtgccccttcccgtatattgaatccccttattataaaagcctcccttccctagaccatcaggcagaagcactgtagagaaaacacagccctggcgaactccagtggtggggaggggaagaagtgctgcttcctccctctcaggatctgtgtcaccccctttgtcaggcgtggttttccttggaattacaaattaccagatcttccctccaagatctttcctgcccagggtaagggccaagagcttgcccctttcctcttcagagtcccactgcctgccctggaagttggtccttccaagatcaggaccttctctgagttctttgaatatgttctttatctttttctaagacttgatggggatttttctctttttgccattggtccctgcttatattaaagagctttccttttgccaaatctttacttttccataatcacatggctaagaagagccaagggtattatttgagaacacttagaaatcctagggactgtgtacacaaacagaagttgtttgaatgtgtctgttccaaccatgtggttatggtagttaatcccatcaaggtactcacgatcatccaaaaatggaattcttttatgtaattcatccccacattgtatttcccaatattttttatgatataattttagaatcaggtaatcactaagaacatgttccctgcacagttttatgatgttttctctaaaaagtcagccaaaactttggacacttctatgttggataattaaaaacagaatgaagataatcctcctcctaaagattgaattctccaagagagaatgcaggacaaacacagatgtgctgtgtatagtatatgtgcatatatacatgcatatatgtacacaaatatgtgtattatcaaataatgaggctcaaacattagaaatccttagattaaattttctaaacaagaaaacactaatctttgtagttgaaaaaaaatcctcctatgatatgtaatatgctgatctcaattttcacctaagagtgatgttctccaaatgtccgatgagcatgtcatatatatatatatgaatttttatatatataattacaatggtaattggtatatagagatatctatattatagatatatatagctatctctatatattacatataccaattatagatataaatataacaatggtaactggtgtatatgtgatgtgtatatatgtatatgtataccataattatatattaatattgtatatatgccataattatatattaatattggtatatatacaccatgattatatattaatattggtgtgtgtatgtgtgtgtgtatatatatatatatatataaaatactagttatcattgttctagatttaaaaaacaggaacctgagctactaactcgactatatatatatatatatatacaggaagttgctttaaaacatttttatcagcttttttattgttatttttagctttattctcatagtaaagctaaaataaattattcaacattatcaaaactttgctgccagcagatgtaagcaatacctaaaacagtggagagcatgttgcacccaaagcagtttaagctctgacccaagcactggcatcttataggcactgggtagagataagagtcataggtcgacatatattgagatgctatgacttgattagaatatggagtcagtgactgaggtgaaattaaaactcaaaccacaattcaacatcctgatttaggatgttgctggtgtttctaggtactacacttaatttgaaagaaattattgaggataaaaaaagaactgggatcaacaaaattaactaggtgttcttataagagtccctgaggttactaattaatgaaactgataaagctcctgcaccctgacagcaagaaattatcaatgattatacatttaaacaattgaattgaactagaaactggccacatggttaaaagacatttacaaatgtaatcatccagtgttatgatgcccagaaaaaaaaaattccttagaatgctttaaaagccgtattccatcacctttccagttatttgttaaacattttgtaatgcaaaaataaccatatagattatgccctagtggtcgggttttatttttagttttttatggtttttttttgttaatggtagagttttaattaaaagaaaatacaactaattagcagaaagtgccaactttaaaaaatcactaattgattttattctattgggttatactgacttaattagcactaatttaaagaactattaattatctttaaagagtctttagcaagtgcatatatctcagtaattatgttagtaaggacatgcctataaccaaaacccaactcaactagttaaaacaaaaagcaaatatgtgactaaaaagtctaggagtggctacagcatcaggaacagctggatccagggatcacagtattatcagaaaactttctttcagtgcctgtcatctcttcctgcatttaactggtttcattatcaagaaagtttaatttcaatagtcagttccaaattatttttctcacaacttagcaactccagcagaaacagagcttctttttcccaatagtttaacaaaagtcccgaaattgagtctcaatggcctggcctggatcacaggcccaacccagaaccaatcattatggccaagaggatgtagtagtttgatatgctagcctgaatcacatgcccaccactgacctgcaaaggattttaggtaagatccctggggtaagaattgtggaggggtagttccccagaagaaaatcgaggtgttctcacaagaggaaggggtaatggatcttaaataaacaaaactatagatgtccacattttctatctataaatgtttagtgttactataacaattagaataattatttagttcatacactattcaatttgtatctcccttctgttgccctgttgccgttattttcttacagatagaatgaaaaatattaatctaggcagctctgtgaaacagtactgtccaaggaatataacgtgagccaggccgggtgtggtggctcatggctataatcccagcactttgggacgccgaggcaggtggatcacctgagatcaggagttcaagaccagcctggccaacatggcaaaaccccatctctactaaaaatacaaaaattcgcagggcatagtggcgagtgcctgtaatcccagctactggggaggctgaggcagaagaattgcttgaacccaggaggtggaggttgcagtgaaccaagatggtaccattgcactccagcctggatgacagagcaagactccatctcaaaaaaaaaaaagaaagaaatgtaatgggagccatatgtgtatttttaaatgttctagaagccacattttttaaaataaaagaaatatgaaatgaattttagtaaaatattcttcacccaatatattcaaaacattatttcaatatgcatgtaatcaatatagaagtattaatgagctgtttcacattattttattcatactaagtgtttgaaatccagtgtgtattttacgtttacaactcatttcaattcatgttagacatattcctagtgcctagtagccaaaggcagccagtagcacagatacggatattaaaacagaaaacacctagtgaataatggggaaattttaggcctaagtttttaaaatccataccagataattattcagattcaaatttactttgttttttcatatatattctttaaaaattacattaatatgggaactcagaaagttcaaaagaaatttccattctatggttttagtctttacattgtcagaactaatgcaagtgtgaagtttaggatgtactgtaagtaataggatcttctaaatctcatgccttcttcagctacctactctgtttctatttcagttcctcactgtggggaggggacttctctgaacctaggtttcatctctcactctcgttcatggtaaacaggttttcctttgtggcacctagcacaattagtaagtaattagtatttactggcatattagtatatatatgcatatgtatttatttaaccctatgtcttctactagattataaactccatgaagatagaacttgtcttttgtttaatagtgcttggcaatagttattactgtaaacattttttttctttcttattcaactcctgttagtcattgcctgagtactacaaatgtttttaagtaaattaataaataataactttcagggccaaatgtgaaagcggcaatatatagcttgttttgattttttattccaccctcccatcctaaaacaattatagtcactaagtttccaaatgacatctgaaattgcactaaggaaatcctagtctgggcaaaatcactcagtcaacagatatttatcaagcacttactatttggcaggccctgttctagacacaggggatactcatcaaacttacattccagtgggggagaaagagctaataaatacatacacagcatattagatgatgcaaaattagcaggacaaagagaactgggggtgtgggggtgaaagaagctaatattatatgttattattactatatataataatataattattggatagtcaaaaaaaaacctcttgaataagacatttgaaaagaagcacaaaggtagcaagggagtagggcgggcagctcttctctgggacctgaacattcaaaatgatgagagcagcaggtgcggaggccctgaaataggaatgtatgaggtgtgtttgagaaataacatggaggccagcgtggctgaagctgagagcagggggagagtggtagcaactgaagtcagaggtcacaattaaggactttgacttcacatgaaatgggagatcatgaaggataataaagccatttcactactttatgtgaatcacagcatctttttaaagaagtatccttttttaaagggggagatgactagaaaaataaatagtgttagataaatagagaaaacaggaaaacattctagactaagacagtgattccagaactaaggatccacagaggcgagaatgcagaaagtgtaggtttcagagcagtgggtagactaagggtttggactagtggatttggatagggagttggagagtagcgaggtgagattagggagggctgtgaatgccaggttagtgtgcaaactccattatataagcagtaaggagtcactacagacttttcaaaaatacatacatgttccacctggcccacgggttagcaacattttcgttgccctggacccatttccttcccaataagttacaggtttgtgaagattctacctagcaaacatattacttttaaataactattaataaattatcttaccatgattataatcaaaggaatctgtaattgctaattatttctgattattaaaagataagcagtattgcactaaattgacataattctaactcaaagtaaatatacagatagacatggctatagatgtgaaatatgatttctgttagggctttttaaatttaaaaaaacttacgagttctcctccctccccctacccttaataccttgaaggcctctttgtgggacttcagggaccccttcagggaactatgacctaggctgtatttggggggctttctgggtttatagctggaaggctgccacagaggcatcgccacttgggctcagattcactttgtgttcaatgttttggcaatgtccccacctccccattccatctgttgacactattgcagcactgaccatctggttactaggttggaggatactccctcgggctcctttgaaccagaattagtgctccagtgattagataatagaagaagcttgtcataaaaagaataagccctttccctgctttttctccattctttgattatcgctggtagtcagtgatgatcatctctatgagtctatatcaatctcatcaggtcagtttgaacctcatctcttgaaatcaaagtttccataatgcaactgacccacaagggtgaaatgacatgaatgctttaaccatccatttatcatttattcattcattcaaccaacatgtatttagcaagaggcagcagagttagcataactatacatcccagttggcccaggacaactccagctaactctcgttgttttgataccattattaattatttctctttactctcataagtgttccactttggacaatcaattacatgagcatccttagcagggcacagtgtttaagggcatctttaaaatattgtctttaagaacatgtggttaagagaatgtctgtgttcaaatcctggttccaccacttaaaagctgtgtgacctcaagcaagtgacttaatctccgtatgtcctcctttgtcaatctgtaaaatgagactagtaatagaacttatggagttagtgtgagaattggaaggttactctacaataaagacatataaccagcatggtaaaagggttagcaattactatgtgaagaagcatccagtttctgacctcacagagattatctagcaaactcatgattttataaagaaaagaagtttctcatcaacagagactgaaatgctaccatacaatatacgttgcttttttttttttttttttttttgagacggagtctcgctctgccactcaggctcaggctggagtgcagtgttgccaccttggctaattgcaacctccacctcccaggttcaagcaattctcctgcctcagtctcccaagtagctgggattataggcacccaccaccacacccagctaatttttatatttttagtagagacaaggttttgtcatgttggccagactggtctcaaactcctgacctcaggtgatccacccacctcagccttccgaagtgctggcattacaggcatgagccaccatgcccggccaatatttttaaatattataaaatattctttatcaaattgcatagaagaaaagacagtttgataggtaatagatatataaataggtcaggccaactaaaagtgtcctgaaaaaattaatattgtgaaaacaaaaggattttaatgacattgataaaatctcaccctaaaagagattaaattaaaaatcaccctacttgaaccagttcagtgagatttcattagcatgctctcattactggcataatcagcttcaaagtcactaagcctctgaaaggaagatgtgttgcttattcttaataaaatggcataaaagtagatcattagtcaccaaacatgatagacttaccttttccatttgttggcatctcacattgtagatggcaattaaaatggaatccagggaaagagggggtggtttgtatagcaatggattatgaaacaaagtactggattattcaccgcttgacattcaggaaacattctgctccttacagaatatggcacgtgggccacagaatcttccgtgtgctaccttctcggtgaagaagagcacccccaagtttcttttcctaggagctaaccacagtaaacccattacacactttagcagaagggctcattctaaaggtcttaggattttaatcattttaaatttcctgttatgcttcaggctcttcaacacaaagtgaatattgtactctttggttttacataattatattcaattgtcatatttcaacaggacattatttgtgactttagatgggtcaataatgattttcattgtcagcagtaaagtcaataattacagacacatcacctaccctacttgtgtaaaagcattttttggtactaggagatttagtgtctgatcaacggtcctggatagcaagtaatatatcccccaaataatgaaaagtgacaagaaaataaatatgtttacttcagaaataaatggaaaattagtgctatctaaaatgtagtcttaagtctcatctgtgtacataaagtaaaatgagttttatgtactagttactcaaatttatcttccactccatttgtatagtaattaaactcttacactcagtaatatacaaattggtaattaacctctttgcaaaatgttaaagtgttcctaaatgtacaataagtctcctttcctgtctcattgtttttcgcttcacgtacctctcatgtaattatttcaatgattgagttcagtgtgaggaggtttatgcctagaaaaggtgctcaccaataatgtgcctcagttcccataatagcaagatcgagaaggttctttagtctcccggaacgtcacgttgaacatctcagttctatattttgccttgacatttgcattatatcagctgatcattgtcttgccctaattttcccttttaatattttagtgaccttctatgttaggtacaggttatttagaagtgttcctccaaggccagatactttttccttgaacaatttatttttaacaacttttagcgattttctcacttcaccaccctccgtttcataagtccacgcaatcacaattcctttctgctaatctgcacagtcaagatataaagtaagaatacctatttgaacatgtagtgagaactttacttctctgccaaaaatgaaggaaaatgctgccacttttgtatgtcacatgttttttattctacagcctcactcacttcatgtcatgttttagtgcagttttctggactaactgcttattttctcattgattaaactgcctatttgctcattggaattagagccaatttttttccttgagggtctgactagaagattaaactatgttcatgtgagaatcaatttctacctaagaaatgagttagaggagttatgggcagcaatatctatctggatgctacactgtgaaaaaggaagcgaggttatgcctttctaccccaatggggtagcagagacctcaggaactgaggtagatgcccccctggttattagcgcccctgaataatttgttcaaaaattgactgctggacaggtgtcgtgttgcacgcctgtagtcccagctgtgcaggaggctgaggcaagaggatctcttgagcccaggaatttgaggctatagtaaactaaggtcacaccactatactccagcctgagcaacaaagcaagaccctgtctctaaatttaaaaaaaaatattgaatgcttatgaatagagactaatataggaagtcataagtatttccttgggatagaatgctttccaccataattgacttgacatcctgtatttttgtatgtgtggacttaggttttaaatatttgaaacacagacaattattaagtcctgcaaatgtgtgagttaatagtggatataacattcccttccagggtgtaagaaaaggtaccacagaagtgagcagccctgaagcacagcctggcctagtttggcaggtctctgtgagttagcagcagactcacgtgaccacactctgtactgccttctgtttctgtttcaccccattaattgtgctaaagaaatgcacttgacacctatgctgtgtaatctcatttagccccaatagcaacaaaagtactaaccccattaaattgagtcatttcaaactgagccaaatgttgcactccagtaaatggagtaggcattggttataatgggaattctccattattcataatggaaaccacaggagtttgttcatgcagatcaaatgtgtcccaccaaggcaagaagtatggaaaagtggtgttgctgtattaccttgtaatttcaaagccttcccgtctgaatcttatttccctgctgtttcctcttgactttggttctttcacaaaggaaaattaagaacacaaatataaacattaagttaaaacacaactgaacaaagtgccaaacttaattggagcatctgaaaatgaaacattaggcagttgcagtggcctcttgataataattcacagtaactctctgtaagctgatcctgtctgaagagcagcaggcacaaggcccctggccatgaagtccatctcaaagggccaggctcagcaaagcaggatgcaaacccaggctttccaaataccaggttggggctcatgtcactgtgccacaggagcttctgtagaaaggctacttgaaaaaagtggccattaaaaatccaggtggatcctatctagggcagtgttggaaacactgatctatgggaggaggagcaggaaggaattgtttaaccactgagcagaaatgttacattgctacctgcctttagcagctgtggctgatgggtaccagttgctaagaagagcattacctaacagtgtattaagatagaaaaatgattttaaagcacggcacttagagaatgttgaagttttactttgctttattttgatttgtttggtttgactttgtctcctggagcatcctccatggatttctgttcattacaagagaaacctagggctctaacccaattcctaattcttggacacattgcacccttgttttgtgataatccagccttcttccttgagaaggtttgctggactggaggttacatgtattgaattttctaaaatgaaggtgcaaagctgtctcctcttatttctttgtggtgctcacttcactgtgagatttcctatcaatacagcccaagtcagtgggcatgcatgaggtggagatgagggagttaggaaggacttggactctcatcaaccatcaggatccctgaatccactaactgttcataatcaaagaagtttgaacaaatacttcacacacatgaaattgccaaaattttgcatttgagttgttataccagtaagtccagttgccatcatctccttgtcacaagtgtcttaaattttgcttttgataataatgattaccactcattcagtactaacttacttgatattagacactgcattaaataccttgcaaacattattttgtttgatcctgacaaccatatgagataggtactattcttatccattaccaaaaaaattaatttcatgaagacttttcccagagagagaaactttaaatatttacacacacacctctctccctgtaacaattccgtagtcctgataacagcaaataagcaaagtctgtgtaggatgctttaccaacagtcccacctagaggcaggagagtgaaccagctagaaaatattttattcatatttcttccagaaaggctccattggagtttgaactcaatttatgttataattttcttattatttttgtattggttttcctgaaaccaatacaaagtaagaaagcattggttccactaaaaatgtcctaaaaccagccaagcacagtggctcacacctataatcccagtactttgggaggccgaggcgggtggatcacttaagccaggagttcaagactagcctggccaacatgacgaaaccccatctctactaaaaatacaaaaattagcagggtgtggtagcacacacctgtaatctcagctactcaggaagctgagacatgagaatcgcttgaacctcagaggcagagattacagtgagcagagatcacgccactgtacttctgcctgggtgacagagcgagactctatctaaaaaaaaataaacacataaatagtaaaatgtcctgaaaccattatggggttaaagcaagaggcagggctggttcccaggattttctgtctaatctccagtgagccacagacctattcctgatcaacttgagaataaacacatcagtaaagatgtgtaaggctgtctgactttcccatttctgtagaattttatttgaagagaagtttctcctttctccaggccccatattgtttatacaaaaagacctttccagtaaatgtccacaaccactaccatcaactaaaatgttttcccactaatgctttcaatggtaatcagtatttaacagggcacttaggattattttttgatcaaccattgtttagatattcccacttataattactcctgtgaaggattgcctcggggcatcagctgatcctgagaaattatccagaagccatgagtgtgtaataatttagtcttaaacctaaataggtcagtattgggtgggacttttctcagctgcataatggggagaataaaaagaatatggaaagaagttacgtaacacatcctgggtcacaaacagaggtaagacttgaacacaggcctgacatcaaagcccatgccagtatgacttacaaaaggtagactggactacctgcatttgagtcactagtgatgcttatcactgggcctcaccaaagaaccttggaatcagaatctttggaggtagatgccaggcacctgcattgttatcaagtgctccagtgattaccattcactgtacagagccaaacagactcctgatgctggaagaaaattacagtgctcaaagtgcagggcagggtgtacatctggatctaaatcactgagcaaccacagggtttcaagagagggtcaaaacaaggactttctgctctctgtggccaaggggacactaagtttgcactgttctcagatctccaaagagactttggtgtatgggggatagggaggggggaagggggtgtgaaataaaaggagaaagtgaatttgattatttgattgatgaaaattgaaaagcttattgtagggcctagcctacagttgatgaaaaaacaatggatcaggaagaagatcagaacttgtctcagtcctcaactgttttcctcaggctttggttgaatattgccatcctgtaattcattatagcattttctgttgcataaacgcttagcaacaaagcctttttttaaaaaaatttgtaactcctcaatgaggattaaatgcttcttcttctaagacagtccgaaatatactcacagctgaaaattcagctaaccgcatttcccaactagccacattctatagaaaactctaagccatgcagatgagtacagacttgacaatagtgctcaaggctgggagtactattcatctgaaaagaatgctccctccaattggtgggccgttattctgctaggtttgtgtttggataattataagatggctatgtttttcttccccagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggtaatctcagcagagtcctgagcagatggatatattcatatgcagcacagctgggtgaacttccatatgcctgagcacagagacgaagtcaaaatttgctgcaggtgtgaggacaactaactcccatgggcagggtctcacagtgtagcattgagttagcaggaggtgcaacatggtagagaaatgggaatccatcatgaaagctggaattttgtcaaattttcccatggtgagtggattcagggaggctgattcatgcttttgaaatgtgtaagacttctatacaagcctcacgaggcaatctgtaggaaaaatgttacactggaaatattaatgtctatatattatattgatataagtataaataacatttgatttaatatttgtttaatatatgacattaaatatatatttaattaaaatattaaattagaaaaatatatttgccagaaaaggccagggtatttatgaacactggtaagcccattctagggtataatagcatcacatgggaccatagcaaagattagctcataggggatgtttcatccagttctggtatcctggtgcccttctcttcaacaacctaaacatatattcattcccatgagtcaggaggagctgtgctggagttcttctgaaaaatgctgtctttcacttttgtactctctatgctgtctcccacctatcccctcaaaaaacctttcctttgaaaatatacagtatagctgtgagtagtttagctgtgtccgtttccagaaattggaataagcattgagaaatgggatgtttgagaaagacgcctcaatccttttctgagcagtcagtcacccttcccgccagtagcaagtgcctttgtgtgataggcattggagatgcagagcaaaacaggagtgtgcctgtcatcagagccctgagagtttaattagatgagcctcctgttttctatttctcagagtttcatgtcttctgttagagatggcccttctcatctaaggttcaaaaaaccttatcctgaagttctgatgattctgttttcattctcagtctctgactgcaaatatccaactagaaacaaaggaaatcaggcatgaaaacttttaaagatataattgcatggagatcttcatttgtgctcgtgaggaatttttgaaagcattgctggggaagggtgtgtgggctctgatgcagcagtaagacactgaggctctcagaggtccgtggacgagtactgctgacttgggcaagaaccggaatagttacctgatgccttatccgaaacatgaaagttcggattaaatttgtatttataagctagtgtttttatactctcagaacaatgtcattgcgtttcacccaagtgagtcaagtcacgatttggaagaggcaacagaatttggctctctccaggtgatttatggcggtataggaacacatgttttactcagatacaggggagcaaagttccatttgctaaagtttactcccctgaccttcaaccagtcagtcttcctccatctgccaccactttgcacttctccagagaactaaggatgttcccgcttgaccagtgctcataacatggacagcagagggccactgtgtgatctctttgagatcactgtgactcaaccttcttctcacatcctaggccctaaaacaattaagtgaagttgctaggaacggtacctgctgatcttattgcagcattctcaattaggcctcaatgcaagatttatatcactggcagtcctggagcatttttgtttttcaaattacacatacccaaacacacggcatagcctccttttttgtttgtttgtttttttgagatagagtctcgctgtgtcgcccaggctggagtgcagtggcacgatctcagctcactgcaacctctgcctcctgggttcaagtgattctcatgtctcagcctcccaagtagctgagattacaggcgtataccaccacgcccagctaatttttgtatttttagtagagacagggttttgccgtgttggccaagctggtctcaaactcctgacctcaagtgatccacccacctcggcctcccgaagtgctgggattacaggtgtgagccaccgtgcccagccagggcatatccttcttgatttcaattgtaaaatagttcaaaaattttccatattttatctaatatttccagaagtgctagcttttaacggaccatttttttcctctgtgtgtttttttctcttcacctagcccagccatgctcagctcatttttgtactctttccactcccaaccaaatttagtgccctcccccatacatgcatacatgtacatctgcacaccacttttcctgcaaataatcaacccaaagagtgcttaaaattcctgacatcaacccacagaatctccaaggatgggacccagcatccatacattttaaaaactctccatatagttccaatatgcagccagatttgagaactagtggttcgtagcctgttctgatttaaatctcagctctcagcagtctatcccacgtcacataatgcagcccagagaaattctaggaccacatttttttctggtatttcatagctaatgaggtgcttttcaaatctaataggatctttggccagtgtcagtcaagatcttttatctcctcaataaaaaggaaataccatatttactttgatttgatgtatatcacataggtggatttaatacaaaattgtggtttacatattgtgaatgtgtatactaaaactactttgctttttcctaaaataagacaaagttttatattggaagtaatatttagcattttgtttgaatgaagttactcctattaaattagaaatttaaaagagggtcagtaataacagtaaagccaaaaggcatgacactgccaacgtaacataagctgctctgaaatctaccatatcaaaagataattatgctgggcatggtggctcacacctgtaatcccagcactttgggaggccaaggcaagagaattgcttgaagccaggagttcgagaccagcctgggaaatataatgataccttgcctcaaacaaaaattcaaaaattagccagcagtggtggcacacttgtaaaaatgcctgtagtcatagctacttcagaggctgagatgaaaggattgcttgggccaaggagttcgagactgcactccaacctgggaaatattgtgccactgcactccaacctgggaaacagaacaagaccctgtctctaaaataaaaagaaaaaaaaagatgaccacttctgaaatgacacctatcaatgagttaatcattcaatgaatatgtattgagtccctactatatgcttaggaacctttgtaatatcattaccaaccatgtctttcccaatacagacaatacaaaattcagcaataaataatatagcaccaacaattagagaataagacaacatgtagtatggtccaatatagacagtaaatacaaagacactgaataatatcagtaaaagtaaattcacatcaaggtcactacaccatgcgcccacccttatgatagccctcactggccctatcaattaagcaagagacatgatacaactctgtgcaagcttttccacaatctgcctaccattcagcactcagtcgctcttcccttcaattaagagaattgagcattcaagcatattttcaccatgatgcccataatggtatcttcaatgtcactgactgataaattcccagaaacccctcagagccccagccatgttagctcaaagcctttagctaaaactgaaagcctaaagcaaaagcagccctggctgcacttcggaatctactggacagctctttaagggattctgatttaatgtctggaatagggccaagaaccttgtattattttaaaggctcactagtaggctctaatatttagccgtggttgagaaccactgtgctaaatgtttcttaaatatgctttgtgatgtcatcataaattatattttagtattttttgtctttgttgcataagtgttctttcttcctccaaagaagaatgttacactcatttcttatttcagtttcctgttttcatagcacctcatcttaacactccaggctattatatagaaaagaatcaaatgtggagaaggctgtgggagaagggatgcctgtgccacaaaggcctgcattaggctgacctattgatgtcatatccaggactcaaaagactagtctgtggattatgactggtgaagttcaaaatgttcttattcttagagtggtatgagaagtagaaagagagagaaacagagaaggggaggagaggggaagagaggaagatgagagaaaggaaagagagggggaaacacctgttcttgacatacaggaatgattcaagacattttcttcctcccctgatgtgtccctttctcccctaacgcactatgcagcatcctgcagaaaattcaccacctgacccttttagaaaccctgagtagtaggagcgccaaatgacccaatcaagaattgcagtgagacagttagttttgaaaaatcagttaaagcatgtataatcattttaacaacaatacatctattcactaaacatataattttaatgtcaaatatttacgtgtaaacatattgaccaatctttcgatgtagttgggcccaataccttttccaaaaattgatcagttaatgggggttctatgggggtttcttttcttgccattattcacacttatgtcacattagctatgatttgcagttttaatttctttaaaattgagtagggactaaagacatctccaaaaagcctggatatagactttttacaacttttccatagcttttatagttgactcacccagtatctactaaatacttcactttctcacgtatttccaaaggtttctctccaccctcacaattttccattaatgtagtacttaattaaattagatagttaaattttcaaatgtgaattgctaaacaggtgtggaaataccattggctataatcaagcatataacacaaccatttgagaaggaaagtatgtggcaatattagggaagagccctttcctctcaagcaattcagcatttaggaaccatcagacagcaggacgatggagggaacagagagggttaacatggcaagttactgaagaggacttctactgaatcttgttgaattccccacttaatccagattgtatcatatcttctttcttttgtaattctaccatatcatcttagtcaatgccaagacttctgagctcataacatggtaacaaataccaaaggagctttcagtatcgtttagaaaggagagaagcaagtaacccagacaaacttgacaactgctttcccctatccaaccatgaagtacagtacttaggaaataaaagaaattgcttcactataattcatcatttcacttctaatatctagaaaatgtcaaatgaaaatattatagccatattttagtggcaatagtagcacataatatgatgcaacttaaaatgataaaaatattttcagggaataagattctgtgattctttccctaagaggtaattttgataatatgtacctgttttgtaaatgtcaatagtcttggggatacaggtggtgtttggttacatggaaaagttccttagtggtgatttctgagattttagtgcacccaatacccaagcagtgtacactgtacccaatatgtagtctttcatccctcgcccccactcccaaccttcccccacaagtctctaaagtccattatatcactcttatatctttgcatactcatagcttagctcccacttatgagaacatatgatagttagtgctcaattcctgagttacttcacttagaataatggcctccagctccacccaagttgctgcaaaagacactatttagttcctttttatggctgagtagtattacatggtgtatatataccacattttatttatccacttgttggtcaatggacacttaacattagttccatatctttgtaatttcaagttgtgctgctataagcatgcatgagcctgtgtctttttcatataattacttcttttcctttgggtagatacccagcagtgggattgctggatcaaatgatagttctactttcagttctttatgttttccacagtggtcatactaatttacattcccatcaacagtgtaaagtgttcccttttcatcacacccatgccaacacctattgttttttgactttttaattacggccattcttgcaggagtaaggtggtatttcattgtggttttaatttgcatttccctgatgttgacaatatttaactctttagttatagattccagctattatcaatttacacctattgcattcttctcatcttttgttttcttgtgattctgatgcacaaatatcatttgtgcaaccacttactgttgaacatgtctgatgaacacttactattgaacatgtctgatgaatgaataatgaaataggaaaagggattaaaactagcctttattaattgtttgctataggccagacatttttggatgtactatcacatttcatccaaacaacaacctaaaagaaaatactgtgattatccccatttcacatctaaggaacctggtctttaggaagattaagtcatttggccaagatcacaagtagaccacagagactagatttgaatgcaagtctgtttgactccaaacctttttactatctgcccatgacccctgatcaccaacatctcaatgtatgaacatgtgctttcttagctcacacaactcactcctgaccccttttttatattgcaagtgcatagtcattagtaaaaagaaggatttttgatgatactgacctcatcttgaatttaattaggctcatatgacagaattccatagatggaattgacatcctaggtcatatagtccaagtccttgtttatatttgatacctagtgagattaaagggacattaaaaagtaaagaaaggaaagacctcatatttcttaccttccagtagagaaatctttctatgaaatcagaggaaagaattagaggaccagaatttttcctaaaatcaactttcatacatcttttttcatataaaaggcatagctgcatacaatgctaaaatattgtattacatttcctttatattgatgggaggaagggggtaaattgcagaaaacattgtaaatttagatatgcttgggcctctgacagtgcctagcaaatatcaggagatcaataatgaaataaatattatcaaagagtagtcttcttgatgaaccttctctgagtatcacaactgctttaggaacctctagattcaaggtctagtaattgcaaacagtgagctgataagaaaaacagactgtatgggaaattacatgcttcctgcatgactgccttttgttctcccacattttgatataaagtcacattaacagttcatgagtaaatattcgataatgtgaacgtaaagtgttcaaataatagagtgactaaaatgcctgaaaacaaataatttttaattagaaactcataatcatttattttctctttttccacattatctcaagctcacaaattatatttattctttcctatggcaaaatccattttgttaacactaattttgagtttaacaagaagtgtactccaaagtagcctaataatactaattataatgtttcctgctatgttatcagtttgaatttatatgaatctttagacttgaggcttctttttcctagcatagtgatggtctgggctttttctcaatttttgccagagctcagctctcactaattagtttctttctgcatgagaaaaagattttgcttcatctttttccttataatagcagaacaaaaagaagaatcagctgcatccatgctaatttcccctgtgacatttccaaacaggatttgatttctctatgcatgcctctttccttctcttcatggtttttgaacatatacaaaagctcatttaaaccaattaaataaaattgtttttaatctctttctctagagtcaacttcctgcttactccaactctgtatctttgaaggaagtatagggtggtctatgccttttttctcccagaatctacacttgaaaagacacatttttccatgcaactataaaatgttctcctcactcaacattgaaattgtatagcagtgattaagagagtgagctgtagagccaggttccctgggtttaaatcccacttgttagtatcatgaagatgggcaagttacttacccttcctgtgtttcagtttcttcatctgcaaaatggggacaataatagaatgtccactataagattattgtgaggattaagggaattaatacaggtaaaacgtgtactgatgcaggtctggtacacattaagtgcctaataaatattcagtattatgatataaagaaccctataagtgtagactccttgagattaatagagtttaacgataagttttactttatagctggtcaagtttatttcttctgaactaaaagaatctatagagtctcaatttctggagcttcagagggaaggagagaagcaatgtaagcaacattctacagaaatataaataatactactaataattagcatcttaaaatttcaattcaatgaacatttatttagcgcctatgatatatgcaagacagtttgattttagtcatctgatgtatagccacatactaaaaaatactgattttagtcatctgatgtatagccacatactaaaaaatacttcctccatcagttccctcctcaggaagttcagttcccaaccccaggctagtaccttggttccttatgtaaataaacatccaccaattacatgctatctgcaaagcactctgctaggccctgcaaatggaaaaaaaaatgataaaacatagtccaggccctcaatgagcttacagtcaaatataatagaggagacaagaacagagaggctcataatacaactagaataaaatgactgccgaataaaaggaaagatttatgcaggtgttcaaatggaaagtgagataagtttgcaggttagtctttgcagtctcataaaaatctttatggagaaaaggacaatggtcatagggcttaaagagtaagtttataatcctgaccagtggagatgaaagactagcattgaaaattgcatgacaagacaattccattaaactgaaacatcaagtgtgtgtaggaaaagatgggggttatgactggaaacgtcacttggactgcaattatgaagggccttgacaaacaggtcaagagtttaagaagcagtatagaaagtcttcgtcctggatctagccctcccagagtgtccatcaggattataaagtccttaaaatattagtcaaaaggaacgacatcattagaaatgatagagaaacaataatgtgatgttttattacctttctctggatttatactctgatcctaatattcaaaactatcttaataacatgaacttttggtcatagttttaaacaaaaacagtgttaaatatattttttaaaacacagtaagtcttgtaagatcttttctaacatgacattttgcagggcccatattttccttctgaaatgggaaaaattcataaaagtagacaccaaactgggttacttctagtcaagcgcatggtacgcaaaggaccagacaaaaagggcctgtgacatttcttcttccttttgtgttttttaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgttctcttgcctcttcatgtgtctgaccctggagttcagattttaaaagggcagccactgaattagacaatctcacaagcaaagagataataaggagagtttgaaggaaaccagtgccctgctgagtcatttccctttgggaacagcaggccgcatctcttttctcttgccctctgatgggccaacactgtgggagaggtcttcaatctgctccctttaaaaacatacaggactgaacaagataccacaaaatgcagactgataattctgaggaagtgagcccttttcaaaacattgaaggttcctggcattatctcaagttctcccctgtggcccacagaacgcctcccccagcctaggccgtctgttaagatgtgatccctgacgtactgctgaattttgtactgccaataaacacactgcacacatgggcgcagcagggtcctgtcagtgacccaaatggatcttacaggaccaaaggaaccacatccagttttagcagaaaatcataaataattgaaaccacacagatttgtgaataagtacagtgggctatggtccataggagctctaacaagccaagtttagggttgcggccacctggtctctattttgaatatcctttaatatttgtgggaatctaatactgctacaaacaatgcctgagcttgatgtgaaacacatgagcttccaatgagcatgaaatgagttgtctcttcatactggttttctatagcttagtttggaaaacattacccgaattactcattgggtcagaccctatgataagccctggaa

SEQ ID NO: 13193 - DNA, 126200 bp, Human; identical to SEQ ID NO: 11824
  misc_feature (1)...(126200): n = A,T,C or G

SEQ ID NO: 13194 - DNA, 152524 bp, Human; identical to SEQ ID NO: 12683

SEQ ID NO: 13195 - DNA, 6972 bp, Human
gtagagaatttccaaaaatcttgccccttttgtgttgggattatcttattgctttgtactgtgtagctgtttctttctggaggcatgtctgcccagctctttgtttttcctgccctctggctgggtgtcagggtcctaaggcagagcttgtaggtggattcttccccctttgtctcttcttcagaaccctgtttttttttttttaccccttcttgctcaggcttagttgatttggagttgtcatagcaacattttagcaacagtgttgttctgcaggaaggcttgatgaataaaatagagaatgcttgaagacgatccacttgggctttagggtttctaacagattatataaatctggataccccaaaacaagagtcctgtcagtagaatggggcccaaatgccaagtctagtctttgtggtcagggatattcttccagtggtagtgggcttcagatttcctcttcctaggtttgaaaacagaaatgtcttgatggacaacatgtggctgagaaactggaagaagcatcagtgtccatgacactgtattttttgatggtggggccaatacatggcccttcctgattcccatgaagctgccatcatggcaggtcataatagctttaatgatccatttagagatgtgttgttggctgggtgcggtggctcatgcctgtaatccaagcactttgggaggcggaggcaggcggatcacctgaggtcaggagttccagaccagcctggccaatatggtaaaaccccatctctactgaaaatacaaaaattagctgggcgtggtggtgggcacctataatcccagctattcaggaggctgaggcaggagaatcacttgaacccaggagatggaggttgtaagccgagattgtgccactgcactccagcctgggtgacagagcaagattctgtctcagaaaaaaaaaaaaaaaaaaagaaagaaatgtgttgtttcggccaggtgcagtggctcacacctgtaatcccagcactttgggaggctgccgaggtggacagatcatgctctcaggagttcgagaccagccgggccaacatggtgaaaccccgtctctactaaaaatacaaaaattagccaggcgtggtggtgtgcacctgtaatcccagctactccggaggctgaggcaggagaatcacttgaacctgggaggcagaggttgcagtgagctgagatcgcgccactgcactccagcctgggtgacagagagagactctgtctcaaaaaaaaaaaaaaaaaagtgttgtttctgtcttccagtataattatccactctccaccaggagttggagtgataatggagggatggggaacactatttgtagccttgctttttcaatcactgtaggccagtcctcaacatcagtatggtggaggctgattgtcccctgcagatgactgggttattttcctggctatgtgttcatggaacctaagttctagaaccagagatactgttctgtttcctaaactcattgcaaacttcatgatttctaccaggacttagcactcaggcctgtgaatcaggaaatacaaagacctccaaaaaaggaccagttcctcggatgtgccccctcacagagagatgaaggggtgagtgaagaagaggtagggtctgggatgaaagatgggtggcctggaagaatgcaaaatgaccaagagcactgcctctggagtcaggcagacctggattcaggttctactctatcacttactgtgtgatttggtttctctatctataaaatggaagtagtgctatctatctcgtggtgctgtttttagtactaaataagattacatgtaatgtacttagcttagtgcttatgtacatagtaaacagtaaacactagttgttattctaacctaacccagcttctgttgggaatgccaatgagtttgcagccatatgttactgggccagtgagcttctcattgacttcttctcatactcttccttttgtcctttcaccacaaacaggcagcagaaaacagctgaaacggaagaggggacagtgcagattcaggaaggtgagtgctagaaacagaaccaagactaagaacccatcatggcctcccttccttccccaccagaccatctcctgtgcatcctcctccttccgtgacatgcaaatggaacgggggtagaaaggcagttaactcacagacttttcctttgttcttttaattcaggtgcagtggctactggggaagacccaaccagtgtggctattgccagcatccagtcagctgccaccttccctgaccccaacgtcaagtacgtcttccgaactgagaatgggggccaggtaagggagggggccaggtggctgcaggtgttatctggggttgggattgagggaggtaattgaacatgtcttggggagacctggcttggaggatgagttgaaagagtggactgttgcaggggagggaggtgctaatactggagtagagactggtgtgaggttagatgtatgctgaaacctctgtgtggggaaagaagggagaatggctgaatccatgtctctgaaggactttgttttggggccctatccaagggaagctttatgaggggccctaggattcccaacacttaatcttttcttctctcttcactccctctgccttcctctacacttctaggtgatgtacagggtgatccaggtgtctgaggggcagctggatggccaaactgagggaactggcgccatcagtggctaccctgccactcaatccatgacccaggtacagggtatgggctggggaggtcactagagttctgagaagtaagatgaagaagggaatcagtaggatgggggtgaagctaggaacagtgaggcatctaaggctgccttgtcccaaagcactaggctctccttttctggatgtttctctctctctctctctctctctccaccctacctaccaccccaagggatagaagctgcagagtggtgtagtgggaagaagtttttgactgttaccagaatcagttttcttgctccccttcccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtgagatattgcatgaggatgctggctgaaagggctagaataggctgtgggacatgactggtaggcagtgagccttcactcatgactcttagtgatcattaagacctggacaggcagtgagtccggggctgctcttctattagcatgttctttttagaggaggggaccagggtcttcacctcagggcttggtgaggttcctacccatgtcctgacagaacctaccctgcatcttcacaggtcaattctttgtgatgatgtcaccacaagaagtactgcagggaggaagccagcgctcaattgcccctaggactcacccttattccccgtgagtgacccttgtttcttctcagattccgtaagtggttttttttttttttttttttttttgagacagagtcttgctctgtcacccaggctggagtgcagtggcatgatctcagctcactgcaacctctgcttccagggttcaagcgtttctcatgcctcagcctcctgagtagctggaactacagacatgtaccaccacccctggctaatttttgtatctttagtagagacagggtttcaccatgttggccaggctggtctcgaactcctgacctcaagtgatccgcctgcctcggcctcccaaagtgctgggattacagatgtgagacaccacacccagctaccataagtggtcctaatacctgctaaatcttgtataattccttaaccccaaacttcaatcatgtattttgtcttcttactctggccaccctgggctctgttgtcaggaagtcagaagctccccggacgactcgggatgagaaacgcagggctcagcataatgaaggtaggtatgatctgggtggagctagaagctgtctggtgtgatctcagcagtgatgtctgaggggaggagggattaggtaattttaccctgggacttgtggcgagttttcactgagtcaccttgtcctccactttgccccacagtggagcgtcgccgccgagacaagatcaacaactggatcgtgcagctctccaagataatcccagactgctctatggagagcaccaagtctggccaggtcatggaaagaccctggtagtgggcaggatgcctgaattctgcctcctggtattgtttccagaaatggtagagagaggggcacacatgacagtagtcttatctctccctgaggttcctgtatccctgggagatattataccaccttccttagatgaaaatgaggtccaaagtgtgaacctacttttggaaagcaagctgggtatctgaaatcctagttctcattttgttgaccttatcttgcagagtaaaggtgggattctatccaaagcttgtgattatatccaggagcttcggcagagtaaccaccgcttgtctgaagaactgcagggacttgaccaactgcagctggacaatgacgtgcttcgacaacaggtcagactcctacccccagtgcagcccttctcagttctgctagccactgacccagtttgacaccctctactttgttctccatggagaaggcttcatcttttccccctcaccagtggatgtctgaatacattcaggggcttggaagtgccagctttactacccattccctttactgcctccttcccatgtcaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgtttttttttttttcttttcttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggggcggcgcgggaggcggtgcccttgcttccggatccggtctcagctctgggagggaacgggagatgttgcaggcgccgagagggcgggccagggccgcactccggagactcgcggttgctacgcgcaccatggctggaggtacctgcgggggattcctggggccgcggttctcttggtcctctgggttgaggcgtggcagggagtggggtggcggagcgaaggggcgtggctgaggggtcttcgtgcacaccctaccgggaggggcgctgccaggtgaggggatgccatggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacac

SEQ ID NO: 13196 - DNA, 35065 bp, Human
  misc_feature (1)...(35065): n = A,T,C or G
ggcacacaccaccacacccggctaatttttgtatttttagtagagatgaggtttcaccgtgttggccaggctgatatcgaacccctgacctcaagtgatccacctgccttggcctcccaaagtgctgggattataggcatgagccactgcgatcagcctacaaatagcagatattgtgtgatagagtttgtcagggaccacaagacagacacacactcagtggtacagctgctccgagttctgtttccaggggatgataggtcatccacatgcctggtgggaaggatggagctggtgttggggtcaggattggagaggctgattcctaattcacattcattagtgggttccaacagctggatcttgttttccacctgtcgtgtgaggaagtttacccttctttgttatatcatgtcttgtgcaccacttctcaaggttaaggacatggccagatcaactctgaagaaattccccagggttgagggctgccccttgggagcagacaaaggagagaagagatgataaccattagacccgctggaaaaagctattcagagcttaaaaaaatgaaaacaaaaccacaaaaacctcatctatgtccagtgttttttgtgtgcatattctggagtatcatttttaatttgatcctgaaaactgccttgtgaaggtggggaggatgtattgttgaccctacaggctcagacagcaacaaggccagaatcacataggttgtaagttgctgaatgggagctgcaagtccaagtctttgactctaaatccagcgctctgtccagagccccgctgctgcctctgttggcagctgaagctgtcagtctgctgccccctgcccagttcagacagggtggctggaaatggaccaaaggatggaaaaagagaataagagcggacttgaagggaactgaaagtatttgttaaggggaaagcagaaggaagaaagaaagaggcatgaaccctggggcctggccttgaagcacagtgttccaggggaggggggatgccgctgtccccacccctccatgggggcctaagcagatccagagctgcctggccttcctggagggtggcgtccaagcatggatgggaaggcagcaaaaataggcccatgtcacttctgggagaagacaaaagagggaagagaggactactatagaaaagtagaaaaagaggaagggagggaatctaggcatacagatcggaaatgtggagcaaaacaaaatttttttttttttttttgagacacagtgtcgctctgtcacctaggctggagtgcagtggcgtgatcttggcttaccgcaacctccacctcctttgctcaagtgattcccctgcctcagcctcccaagtagcttggattacaggtgcacgccacccagcctggctaatttctctatttttagtagaggtggggattcaccatattggccaggctagtctcgatctcctgatctcaagtgatctgcctgcttcagtctcccaaagtgttgggattacaggcgtgagccactgtgccccgtgtgaaacaaattcttatgaaacaaatttaatttacatgtgcttaaactttggtgtcaacttgcatggaatccccaggcttgctagatttttctagtgcctccagcccttaggtctcttcctatgttctctcagctactcctcctttccttcaacactgttagccgcttatccagggccctacgtttcagcccactcctcctccagcccctctccactccacctccacaatgtctgttggaatggaacagttggggatactggctgtttggcccccatgggggtctctccatataggattcagagaattggaagacttcttgggctgaagcagagaacgggatgcaattttgaaactggctttgtgagtcactgtgaacttcaagcaccctcccacttgaggtaagcttcaccagtttggcttgtgggaactgtcagaccagctccaggcgctggggctttctcagtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggtaaggaggtcctacctggcgtggggcgagggagggactaggagctgtgcccctcagggagatcagagccagagcctctgcttgtgccacatacacagtcatctggaacttgactccgagcagctcctgacagctctgacagtctaaatcagacaggacaggctggcagtgcactgggaggtctgtgagaggggtatctggccctgccaccagcaatccaggaagtcttgggtgaggagattccttcccactggcttcaatttacccttccgtgtagtggagagagaagcctccttccagccgcctgtaaagatgatgaaaattgcatcctccaattgtggcatgagagaagagaagcagtcccaaggaagtgggtggttctcgagctcagagacagatggatggacccctgaggcaggaaagctgagcccagggaggggagggcgaggccagcagccaggaagaagctggaaggcatggtccctcatctccccggcttcttcagccatccagatgccacaggagcctggaaattattagggacatgcagggttggggcagaagaaggagacaatatgaggaagctccacagcaaacctaaagctgtcagccaggcatggagccatctaacatttactcctggggatcccagctgagggctgctcccctctttctccagttctggggtccaggatgctctgaaacctggatcccgcatttaatttaattgaattaatttatttatttcatttttaatttttatttatttatttattttttgagacagagtctccttctgtcacccaggctggagtgcagtggcgtgatcttggctcactacaaactctgcctcccgggttcaagtgattctcatgcctcagcctcccgagtaggtgaaattacagacgtgcgccaccatgcttggctaatttttgtatttttagtagagaccaggtttcaccatgttggccaggctggtcttgaactcctgacctcaggtgatctgcccaccttggtctcccccatccaaagtgctgggattacaggtgtgagccaccatgcccagccagggttctgcattttagatcagtgactctgcaggggcttcacggaggtggagagcgtggaattagaggagggtacactctgggcacaaagaggggaaactgaggcatagtgttgtgtgggttcagggccaggtagaagccccatatgcaataaagtcccatgcccaggtactcaattcagttaccgagtccctgagcattcttgtgtccttcaggaagacacagtcaaggctcaggtggactcaacatttgtaaggatgcaggcagcctagggcagagcatgatgaggaacagggagcagggagggaggagtggagcctgcagctcttgtgggtgggttggggggcctagtggcccaggattctaggcaggagagctaggttggaacctggtctaaggatccttgaatgcagctcagacagccgaaggaggactgatgggattggtgcctggctgtggggatgagagtaacagagaagctgaggttatgaccctgaggtcatgagcctgtgtgacagagggcaatgctccctccacccccattcccagggcttcagcaccatagctgggcttggctatgccggcccttgcacggtgaagctggtgagtgacttgttaggcacagggagggatggacttgggtcttcctgagctgcttcctcctccatcctgtgtctatagggcaggcctggcataagttgactgaagctgctctatttctttaatttttaagctttttagtttgaaataattgtgaagttccagggaagctgcaagaatagttcaaacgattcttgaatttctttcatctagattcaccaattaacattttatcacatttactttatttctctttctctagctgtatgtatatgtgtgtataaatgtacaataatttttgctgaaccacttgagaacaagttgtgacattatgtccccttactcctaaatattttagcacttatatcctatgaacaaagacattctcatgttactacagcacaattgtcaaattcagtaaatttaacattaataccatcaaatatgctttccatattcacatattaccaattgtcccaagaatatgctttattttttttttttgctgacccaagatgcaatcaagatcatgtattacattcagttgttatgtttctcatgttcagtctatgaccatactttaacctttcttcatctttcatgatattgcattcttgaagaagacaagccagttgttttgtagagggttccttaatctgggtttgtctgatgttccctcatatgattcaggttatcatatgcatttttatttattttatatcatcattattattattttttagagatggagtctcgctctgtggcctgggctggagtacagtggtccaatctcggctcactgcaacttctgctcccccgggttcaagtgattgtcctgcctcagcctcccgagtagctgggactacagatgcatgccaccaagcctggctaatttttgtatttttggtggagacagggtttcaccatgttggccaggctggtcttaaactcctgacctcaagtgatccacccacctccgcctctcaaaagtgctgggataccaggtgtgagccactgtgcccggcctattattatttttcaagagaggatctggttctttcacccagactggagtgcagtggcatgctcacggctcactgtagcctcgacctcgcaggctcaagccatcctcccacctcagcctccctggtagctggaactagaggtctgtgccaccatgcctggctaatttttttttttttttttgtagatacagggtttccccatgttgcccagggtggtcttgaactcccgggctcaggcgatccacctgcctcagtctcccaaagtggtgggactacaagtgtgagccatcatgcctagccatcatatgcatttttaaaattattttttctttaaaaaaatttttttctgtgcccattgacagcagatattatatgcatttttgacaggaataccacaaaagtgatactgtgtctttttcagcgcatcccatcaggagtcatatgatgacagtgaaatttaaaaaaccactttgtttactgaataatttaacaggagtactatttatgtaagatgtgcatataactcttgagcattgcgaaattcttccaaagacttcttctttcatgcagagtaaaagccatgcattttacaatggtgcgtgacctggcgtccaagacccactcctctttgtctctcctcttgctcacagcatttcagccatgttgcctgctggtcctggacctcgctctctgttgtatccacagttttctctgcctgggatgctgctcctttgctggctacatggcctcttccctcaacccctcagagttttgctcaaatacctccttttcagtgatgccttccccactgaaaatgtcagcctgccattctgcaaactcttagctctctctccacttaatttttctccatagtcctcatctccatttatgttccatcctgtttacttatgtttttcattttctgtctcccagtctcctcttcagccccctagactgtaagatccttgaggccagggcttttgtctgttttgctcaccgttgtctcctcaacatctagagcagtacctgccacaagtcaaccctcagtagatacttattttcacaatagcagccccctctctgttcccattctttctctggatatattttgaatagctctgaaccagggctattgaggattcagtggcaagtaagtccagggcccgtttgttcagagagcttgcgctagattgcctgagtcactgttactacagttgtgattagtgcctggtgcagtgccaatgcagtaggtgttcaaaacatgtttgttgagtgaataagtgaattattttcaggcatcttaacgggcagcctgggatgttttttgggttagacatattgggaaggagggatcttcaaatcattgcccagggaataggcctgggccctaaaattcattttagacccaaaattcaggtttcagttgtccgttctgaggaaaccccaaaggacacacaggctggaggctatgaatccccagatgctttacagcctgagttgagatctgctggacaataaaagggcacaggtgacaccttatagattagctccaagggttgccagctgtttgcgtagattgtgttggaactgtcacttctcagggagtggtgtctaactgcgactgctttggctgggatccaggcaagctgtagaagggctggagtcgtttttgctcttctcttcctcattgcacctcccctccaacaaagggtgaatggcaaagtagctggacacagaaaagagattggaattcaatgtaccctgggctacagcaccatccagaaaggaatccactgaaatcacttcaaggagagacagggcatgtcttgtttttttttttaattttttatttttatttatttatttttatttttttgtgagacagggtcttgctctatcacccaggctggagtgcagtgatgtgatcacagctcactgtagccttgacctcctgggctcaagcaatccttctgcctcagcctccttagtagctgggactacaggcatgtatcaccacacttggcttatttttaatttttgtgtagagatggggttttgctatgctgcctgggctggtcttgacctcctgggctcaagcaatcctcttgccttggcctcccaaattactgggattacagatgtgggccactgtgcccagccaggccattgtcttcacagacaaacctctcttattgaagtgcaacatacagaaaagtacacaaaattacaaatgtacatctcaatgagctattgttaaatgaacacactcttgtgtctaccacatgttctctcccattcattacttcctctgtcttccataaatatagccacaattctgacttctaacatcacagatttgttttgtccgtatatatggaatcaaacggtatgcactcttgtgtctgactacttttgctcaacatcttatgagatttatgtatgttattatttgtagcagatcattttcatggctgtatagtattttatcgcatgactatatcatagtttattcaccttttctattattgatgaacctttgggttgctttcaattttgtttttgctattataataatgctgtgatgagccttttgtgcatgcatgtctgttgggtatatctctaggggcagaaccatggagtatgtgtacgtaactctagcagatgctgtcaaactgttttcccaaagtggttgaaccaaaatagtgcatgagagttcccatgctgctttggggccactggcttttggttctgaaggtctgcagatggaaaattaaattgtggaaatgtggagcttggcaagaggccaaaggcaagggaattacagctctgtgatttctctggtatcctgcatgaaattctgacaatagagtcatttttaggagttatgtgagatgcattgttgaattaattaatttaaacggattcatgaagcccttgcttgggttgttcattttgctgttgtgacgtttgaatttcttgtctattctgcatattagttgcctgtaggattcatagtttgcaattttttttcctattctattggttgccttttcactctgtgaattgtttcctttactgtacatgatttttttttagtttgctgtaataccatttgtttattttgcttctgttgcctgtgcttttgaggtcttattcataaactctttccccagcccttattatgctccaagaactatgcaaggttttgtgggggaaacaaagatgaaacagatgtctattctacccttaagaatctttcagacagaggaaaatgggtatgtataattacaactataagggaagatggaaatgctatgtgtcattaacaggcaagatacatttagaataaaaaaggagctaagaagatgaagattccttcctaggtaggaacactggggaactggccttgaagaataaataagagtttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacccaccttccctgttcctttctgcatacaccaggcaggccttggctttttctttcaatggcagctcccacccaccgcctctgggcagccactcctaactctgcagggcagaggaaaacatgctttccttatgcttgcctcacaccctgggcacacctccatagcacattccatattgcatttcagttggctgttttaggtctatcttcctttttcactttttttttttttttttttttttttaggcagggtcttgctctgtcacccaggctggggtgcagtggtgcagtcatggctcactgcaacccctgcctcccaggcttttctgatatttagctaaaagttgggtttagctgagatgagtgaggaaatctacaaattcacttgctatggtaatgtttccacaatgggcaagtcatattttgcttttatcaaagtacatcttagttaatagtcagaacagttgagtgagaggtagtcattactctttttctgcttttttaccaagatacaactcacagctgtgtgcacaaaatttaaatcaacagcttgatgaacttttatatgtgtaagtacatatcaaaactacccacatcaagatgtaacacatttctagcacccagtcattcctttttggcccttcaagttgataacccccctcctgcaagggtaatcacattctaacctctctcaccatatattagtttttccagattttaaactttatatcagtgaaataattcactatgtactttttggagtctagcttcattaatactcatcattgtggtgagatccatccacattattgccaggaaaagtagcttttctttttcattgctgtgtaatattccttataagactataacacgatttatttgctcatctaatcgtgatagacatttgggttttttctcattttgagttattatgactaaagccattattaacactcttgtacatatttttagtggatataaacaccagattttctttttttttgagacggagtttcactcttgttgcccaggctggagtgcaatggcatgatcttggctcactgcaacctccgcctctcagatttaagtgattctcctgcttcagtcttccaagtagctgggattacaggtgtgcactgccacgcccagctaattttttttcttttttttgagatggggtttcaccatgttggccaggctggtctcaaactcctgacctcaggtgatccgcctgcctcgacctcccaaagtgctgggattacaggcatgagccaccatgcctggcccagattttcttgtgtacaaattcttctggatcaaagggtatatgtaagtttagttttagaagataccgtaaaatagttttccaaagtgctggtaccaatttacactctcactagcaataaatgagaatctcagttgctcccatctctgtcaacccttggaattttcacatttatttatttacatttattttcgagaccaagtctcagtctgtcacccaggctggagtacagtggcgtgatcttggctcactgcaacctctgcctcctgggttcaagcaattctcctgcctcagactcccaagaagctggtattacaggcgccaccaccgtgctctgctaatttttgcatttttagtagagatggggtttcaccatgttggccaggctggcctcgaactcctggcctcaagcgatccacccgcctcggcctcccaaagtgctgggattacaggcttgagccgcttcgcccagccttcagacctttaaatgttagctattttggtgggaatgtgaaatctcattattctctgataactaatgttgttgggcacccttatgcatgcctattggctattggatattctctttcctaaagtgcctgcccaagtctgttgctttttttgtcattattgtcatcagtgtattattgatttccagtctattattgtcatcagtctattattgatggaattctttatatactctggatatgagccctttttcaaatgtatgtattgcaaacattttctcccagtctttggcttgctttttcactctctcaatgttgtctttcaccaaacagaagttctaagttttagtgaagtccaatttatcaatattcttttatggttagtgatttatttttgtgtgtgtgtgtcctgttaaagaaacatttgttgtttgggtgcagtggctcatgcctgtaatctcagcgctttgggaggccaaggcgggtggatcacttgagcccaggagttcaagacaagccttggcaacatggtgaaactctatctctaccaaaaatgcaaaaattagccagtctcataatctggtctcaaaataaacataaaaatagattaaaatgtaaaaataaaaaaggaaacatttgtctatctcaagatgtagaagatattctcttgtgctttttcctggaagctttataggtttagctttcatatttaaatttatgatttgttttaaattaatttttgtatatgatatgagggagatatcaaggttttttttccttatagatatcaatttgaccaagcaccatttattgaaaagatcaagtatgtgttggtttgtgtgatattgtgaaatatatatttggttttcaacctcctttcctggcatacaattcctaaaatttttagaaattccgaagtgatgtctttttgtaggctaatgaggtgaccgatggctggcagcctgtaggcagcttcgggataggggccggtcaccagaaagaccaaggcagggttggaatattggactctgagcccgtccccaaccttcaggaaaaggagagggattgaaggttaagttgatcaccgatggccagtggtcaatcattcccatttattgaggcctccataaaaacccaaagaacaaggttcagagagctaaacatgcggaggttcctggagggtggcacgccctgggaaggcatggaaactctgtatcccttcccctacaccttgtcctatgcatctcttcataggtaccctttgtaataacctttataataatccagtgaatgtgtttccctgagttctgtgagccatctagcaaattaattgaacccaaggagggaataacgggaaacccagtttatagctagttggtcagaagcgcaggtaaaacaatctggagcttgcagttggcatctggtggatatctacaggtagatagtgtcagaattgaactgaattagaggacatccagttggtgtccactgaagagctgattgcttgcttggcacgtgggaaactccccacacgttggtcacagaagtcttctgtgttgattgttgtggtgtgaaaccagaggaaaaacagttagtgtttttcccacacacagggtctatttctagactattatattccatcgactacttttcaatccttgcaatactggaatgctatcttaatttctgaagttttacaatatatcttgatattaggtagtgaaaaccttctagctttgttcttcatcaagattgccttggctattctatgtcttttacattttcatataagttttagaatcaacttgttaatttctataaaaataacctgcaataatttttattggaattctattgaatctataaattaatttaggaagaattgacatcttagcaatattaagtcttccaataaaaaccatggtatagtctcctgtttatttagctctttaattttttctcagcaatcttttgttgcaataggtgtataggtcttaaatatttcttcttgaaattatttctatatattttatcttttttgtgctgctgtaaatagtattgttttcaaaatttcatttttatctgtttgtactaatatatagaaataaaaatgatttttgtatattgaccttatatctagcaattttgcaaaactgacttctacactcaaataatttttcatatagtcctcttggtttcctatatacacaggtatatagtttgtgaataatgacagtttcacatattcattttttttttgagatggagttttgctcttgttgcccaggctggagtgcaatggtgccatcttggctcactgcagcctccgcttcccgggttcaagtgattctcctgcctcagcctcccgagtagctgggatttcaggtgactgccacccgcctggctaatttttgtatttttagtagagatggagtttcactgtgttggccaggctggtctcgaactcctgacctcaggtgagctgcccaaagtgctgggattacaggcgtgagccactgcgcccagcctcacatattcatttctaatttttattccctttgactattttccttgttttgttgaactagccatgacctccagtacaatgttgattaaaagaggtaattatggaatcctttttctgttcctgagtttgcagggacatggatgaagctggaagccatcgttctcagcaaactaacacaggaacagaaaaccaaacaccacgtgttctcactcaaagtgggagttgaacaatgagaacatatgggcacagggacgggaatatcacacaccagggcctgttagtgggtgaggggcaaggggagggaggcattaggacaaatacctaatgcatgtggggcttaaaacctagatgatgggttgataggtgcagcaaaccaccatggcacacgtatacctacgtaacaaatctgcatgttctgcatacgtatcccagaacttaaagtaaaacaaaaaaaaaaaaaagaaagagatgggtacaaatgtgaatgtttgttgttttgaacaaacctctccaaccatgtttttcctctgctcccacatcaaaataataacaatcatcaacatagaagacttctgtgaccaaatgcagggaggtggatttctcctcacagcaaactgaataatgtattctgcagtggacaccagctgggtgttctccaattcagttcagacactaactggagagagtgtcagaccacagaggctgggggctcagtccccaacaccacccctccaccacaccagttctaagtctgggcctccagaacttcggaccaaccagcttccagttggggttctcacaaccccctccttgggttcaattaatttgctggagtggctcacataaaccagggaaacatttatgtttgctggtctattataagagatattacaaaggatacagatgaagagatggcatagggcaaggtatgggggaagggacacgaagcttccatgccttccctgggcacactgcatgccaggaatctccagctatctggaggctctccaagcccagtcctcttgggtttttatggagacttcacttcataggcatgaccaacaaccttgtagaaatgtgactggatgaaaagggtatgattccatactaacaggctgagtggagaaacccagcaaggcctgtctgttcagattcttcttggtctctctgtgtagcatttctttctctagaatctgaggcaggaacttctctgaaatgagggtcttttgatttatatcagattagagttgtctacactcagcaatggtgatcttcttgctggtcttgccattcctggacccaaagggctccatgctgtctgcaatattcatgccccctttcaacttgccaaataccacacgcttgccatccatccattcagtctcggcaatgtagatgaaaaactgggaactatttgtgttgggtccagcatttgccatggacaagatgccaagacctgtatgcttcaggatgaagttctcaccatcaaatttcaccccatagatgaacttgccaccagtgccattatggtgtgtgatgtcaacatcctggcacataaattctgcaataatcctgtgagagcaggagctcttgtaaccaaatcatttctctctagtgctcagaacacaaatgttttctgctgtctttggaactttatgtgcaaacagctccaaggagacacggtccaagggttcatggtcaactgctatattaatgaacatggtggggttgactacggttgatagcaagagactctaggtggtgaaggcacctccaaagcaccaggtatatacattttaacacttttatttaatgaatttacttttggctttgctaattttctctattgtgtatttgctttttattttattgaagttagctcttacatttactttctcctttctcctttctctggattatcatcatcatcatcattatttgaattactatttctttttctttggtttcttgagattgaatcttgcattattgacttgcaaactttctttcttttccaatatacaaatttaaagctataaatttccctctaaacactgccttagctatattgcacatttgatactcattatcactttgctctaaatatttcccaaatttcatttgatttattctttgactcatgggtttttagaaatatgtttcttatgttttaaacattcagagattttctggttatttttctgttattgattttttgtttaattctactgtgcttagagggcataattggtatgatttcaatactttgaactttgttgacacttgttttaatgcacagcatatgataatactttggtaactattgcatgtgcacttgaaaagaatatgtattctgcaattgttaggagaattgttttatatataatttatatatatattggtttaatgatcttcaaattcttatagccttattgatttttttgtgtgcttcttgtagcagctagagagacagatgtaataaaactctccaactatagttgtggatttacttctccttttagttctatcaaattttattttatatattttaaacttgttatatgcatagaaactgaagatgattgtttattcctacttaattggttcttttataatgatgacatttccttctatttctgtatattttttatacatcttatgtctttttttgttcattttctccgttattgccttcttttgtatttaattgatatttttgtgctgcatctttttgattcccttctcatttctttttctgtacattttgttattttctcaatggttaccacaggtattacaatgaatacctccaacaatatagtttgaattgatgccaattcagcctcaatactatagaaaactcctatacagctctatccccccacttttattgtcacaaattacatctgtttctattgtttttcacttcttgtgcctgagtttccattttctttatatctaaagaacatcctttggtatttcctttactgcaggcctttttgtgacaaattctttccgtttttaattttttctaaaaatgtctttatttcagcttcatttaaaaaattattactattttttgagacagtctcactttgtcacccaggcaggaggggagtggcaccatcttggctcgctgcagccttgacttcctgggttcaagtgattctcgtgcctcagcctcctgagtagccgggattatgggcgcgtgccaccacgctcagctaacttttgtatttttagtcgagatggggtttgccatgttggccagcctggtctccaactcccgacctcaactgattcacctgcttcagcctcccaaagtgcggggattacaggcatgagccactgcgtctgctttcatctttgaagtaccgaaattctagataggcagttattttctttcagcactttaaatatatcattccttggaaaaccaaacaacgtatgttctcactgatacgtgggagttaagctacgaggatgcaaaggcataagaatgatacagtggactttggtgacttgggaggaaaagtgggaggggagtgagggataaaagactataaatagagtgcagtgtatactgctcgggtgatgggtgcaccgactcacaaatcacctctaatgaactttctcttgtaaccaaacaccacctgtaccccaataacctatggaaaaataaaaaaaaaagataccattccatcatctgctttttattatttttgctgaaatgtcagctaagttgtttgttttgtgaagggaatttagttttcccccactctggctattttacgatttttctatttatctttggtttccataatttttttgatgtattgagaggttgtcttttgttcattggtttgttttttttctttttttttttttgagacagagtttcactcttgttgcccaggttggagtgcagtggcgtgatctcggctcactgcaacctccacctcctggattcaagtgattctcctgcctcagcctcccaagtagctgggattacaggtgtgcaccaccatacctggctaatttttgcatttttagcagagatgggattttgtcatattggccaggctggtctcaaactcctgacgtcaggtgatccatccacctgggcctcccaaagtgctgggattacaggcgtgagccaccgtgcccagcttgtcggtttgttttgatcttgcttggggtttgtaacacattttacaaatctatcttgatggcttttgtcagttttgggaaattcttatcttttatctcttttgcttagttcctctttcctctctcgtctccttgctttccaattacacttagtttaggggttttgttttgtttttgctatatctcaaatatcttttacactccttcttgtgtatttttatccttttgtttttctttacttcactctggatattttataacagttttctaattctcttttcaatggcatctaaatggcctttttaacctttcaattgagtttgttttacagttattttacattttatttctgtaattttcattgaattctttaaaaaaaatccaatttcaggtaactattgctgcataatgacctactccaaaatccagtagtttaaaacaactacctatttagttagtgattctgctagttggcaatttgggctgggctcagctaggtggttcttttggtttcctcttgcatcagtcatgcatgtgtggtcagctgccagactggccacgggtggctgattcatttatttattttttattgttttttgagattaggtcttgctctgtcatgcaggctagagtgcagtggcatgatatctcggctcactgcaagctccatctcccgggttcaagcagttctcgtgcctcagactcccaagtagctggggttacaagtgtgtgccaccatgtctggctaatttttgtatcgttagtagagacgaggttttaccatgttggccagggtggtctcgaactcccgaccttgagtgatctgccggccttggcctcccaaagtgctggaattacgggcatgagccaccgcaccaggccagggctagctgatttagaatggccttagctgtgttggcttatctctgtatcatgtgatatcttattctccagcaggctattttaggcttgttcacaggtcagccagatgaggttccaagagaacaagtagaaatgtgcaatgccttttcagatctaggcttagaactggcagaacatcatttttgctgcgtttcatcatgaagaccagcccagttccaagagacagggaaatgaaccccatttcttgataacagaaggagctgtaaagtcacattgcaaggacatggtatttttgcattctatcacgctagttctctgctgaaattcttaaacttatgttttatttccttgaacatattagacatgattactttaaagtttatgactgacaactctattatgtagatgccctgtttgttggtttctgttgtctctattcttctgttggtttttggagatgtttccttttcttatacttcactttggatattgtgtatgaaacattctaggaataatttaatgctctggttgatgttattttcctctagtcataacttatatttgcctctagttggcagccaggttagggctaccagagattccagatcattagttcaatccagggttgtgatgattcaaaattgagcttcagttcctgtgagggctgttcatttctcgttcactcttactctttgggtatagccctctgtggtaccaacctcaacactgatggattttatgtatacccgctttctaataggagggacgtgaacttcatgttctcttagttccttgagttttattgtgagctctgctcagcttctcagccttttagctgccatttatggaatcagaagatgcctccagggaacaacagtcagaaatgctgatctcacctctctgaatttccttcttccagatattggccccataatttttcactgctttataaactctctgataactttaacaatgtgcttttacatgttgttcatttttcttctagctatttttagtgggaggattggttagcatgtcttaacctggattttcattacataattagaattccttcgatgattttttatctcaacaattaaggggatgctgtagaatgaaagtgttctgtttccagatcacaaactctctggagtcaggaatcatgccttatacatgaagaggccctgcctcttcaggggctggattgcagtgggactcagtaaggactgaataattgatgaagacagtatatgtcctccttgtaggtttagtaatgattttttccattcacctttgttctcagggtctttgtgcaatatttggtaggttgacttgttcttataaatagtgctaggatcgtaggagacagagacacagagatgcacagcacagtctctgcttttgagaagcttttggtttgctaatgggcagagccagtacaagtcatataaatataaatgggaacctatgtgttttagtcttaggagcatcaagatcaaagaaacatatttcatcaaacaaatagtattacaagtcctttaattatttacttagtctcttgagaaaatgccagggtgaagctgtggcttggagagactgcattcataatgcactggacatataaaaacccctctgtctcaattgctctcttcttaatagcctccattttaacggagccacttgtaaaactctccccatctcttattttctcttccaaatcctccctgagcctccccaactcacccagagagactttttaatttcctgcacctgctgggccatgccacatagctttattactaaaaatggctgtaggaacttccagttttgtacactgactgcacagaattgctctaggttgtcacacccccatattcattaggtttcatcttgattctttgagagggaagtgctgggatctgcctgggaagtgtagttttatttttaaaattgttttctagggagaaatttttgtggagactttctgatcactgaaaaactggcaaacatcaataagtaatgaccaaaatccaatgaaccaagtgccacgagagaggattatgtattcagctctgtgagaggatggttgaggggccatgagttcagcttggacggttagtcttcctgggcctgaccattcagaatttccaacagtcactacttgccattagtagttgcctcagcactgcttggagggagtcaccttagatgtggtatttatagcatcatggttaagaatttatcctctcaagccaaactgctgtctttacaaagagtaaacaaataagctccctagcacctgtgctcccagctactagggaggttgagatgggaggatcacctcaagcccaggagttcaaggctgcagtgagctgtgattgcgccactgcactccagcctgggtgacagagtgagaccctgtctctagaaaacaaaacaaaagaaaacaaaaacataacaccaaactgactaggtttcaggctcatcattcttttaactcatcataccttttaacttaaatagttaaaatgtataaagtgtgaaacctgcctgtcacatagtaagtactcaagattttagctattggtctatgggatccctcagactagggacacagagcttggggacaaggggaggcagatggaggggatacgctttaaggtgctcctaggttctgggctcctcatactcatccccacccaattggcttaagggaagtcacatccagctgcccacattgctcaggcctgacactcttcccgctactttcagcttgggttctctttcctaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttggtaagtctccaggactgttcatactgccctctctgattcctataggcctctaagttctgtatttccaatgcctttctgatcagaatctctgcttccagataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcagggtaagtggaacacactgggctataacaagcgctgaaggtttggaccccgcaaccaggctcatgtgcaagacagatgtggtatgagataaaatcccttggcctcctctcccagtgccttgtagcccttcccagggtagccctggcctccaggcacacagttcctgtaaagctaggcctatcctactctggaaaaaaatgttatccctatttccttctgggagatgcaagcttttcttctgcagagggagggcatagttgtttggtgagtgacagtcctgaaatggctcctgaacattattttcttcctgggagaggctgatggagaactgtcctctcctcttgagtgataactttctccaagccacatagttcaagaggtaactacactgtgcagcagtagcctggagcaggagcatcaggatgaccccagggatacctagatgagttcttgggctgttgcttatgctcatcctaagagttacctgagttaccgttccacaactttttattacataaacagggacttaatgtaccagcagcatgggcattataggaaaaaaaaaccatacagctctcattcataaggaacttatagccaaatggggcaacaaaaataactacttgtggacaaaaaagaaacaagactgaggcaggccgggcgcagtggctccctgtaatcccagcactttgggaggctgaggtgggtggatcacaaggtcaggagtttgagaccagcctggccaacatggtgaaaccctgtctctactaaaaatacaaaaaattagctgggcgtgttggcgggcacctgtaatctcagctactcaggaggctgaggcaggagaattgcttgaacccaggaggcggaggttgcagtgagtcaagatcatgccactgaactaggacactggcttcatcattcagaagctctgtgatctcttagaggtcaggtgtggtggctcacacatgtaatcctagcactttgggaggctgaggcaggtggatcacttgagtccaggtgtttgagaccagcctggacaatatggtgtaatcccatctctatttaaaaaaaaaaaaaaaagaagctctgtgatctctggcagattcattaacctctctgagcctcaattttcttcccccttgagtaaaatgggggtgataataagtacctcacaggattgctgttaagagtaaatgagataatgtttgcaaagagccttgtcagcccttggaacacttaattccttttccttcctcttgttggctggattatatatcaggctacatgtgtgacacaaatcttttaagtagaagttcaaatgaggaagagccatgaaggaaggaatagtggaaaagtgagacggaaaacttgcctgtacaatgagtattttttgagttaaaaacaaaggaatggataaatgtaacatttgttgtgctacatgtccctcagtatccatgacgaattagttccaggacccacctcgcaaccacagatgccaagatccacgaatgtttaagtccctggcataaacaggtgcagtttttgcatataacctatgcacacatccttctgtataccttacttaagtcacctctaaattagttataatgcctgatacaatgtaaatgctatttaaatagttgttatactgtattgtttagggaataatgacaaggaaaaaggcctctacatattcaatacacatgcattttttttccctgaatattctggatccacaattcattgaatccacattgtggaactcaaaactttggagggcaactgtattagatcatgtaattaacccctataggtagataacgttatccccttttacaggtgagaaaatctaagaggctctgaggcatcttccaaaaataagatgacttgagaggcccagagaggttaaataaatagtgcagagctcacagggttagaatttgagccaggcctgtctgatatatctatgctcttggcatcactcagaggaggttaaccaaatgagcaaagagaaaaccttgaccgtgagttctcagagcacgaggcaatcagccacaacacagagaaaagtgggttttgaggcagcccctgcagcaggcaggtgggaaggaagaagagagcgagctgacagctcagttctcacgccttctgtattcctcagaattcagattttggccgtttttggtgatcatcgtgattctaagcgcactgttccttggcacccttgcctgcttctgtgtgtggaggagaaagaggaaggagaagcagtcaggtgagtggaaggtccttagggtggtgctcctgcctgaggccttggatcctgtgactttgtcctgcgtccagtgggatgtgtctgggagcacagcatctccttttcctcaacgagctttggtatgtttgtgtgcgtggtggcggggggcaagcaggttgctaggctctctctcccagttcatgccttctgatcccaatgcgcagatttccctgtagacagctggtttgggaggaggtgtgggaggggcagttcggttgctgcctctgtgctctttggggttcctgggaagagcattaacttgcctcctttctagaaccttttttaaggtttggccatttggggtagaggtgggacctgttagaagcaaaagcccttctggaggtttctgcagctctgctctttgttttcttcctccctcagagaccagtcccaaggaatttttgacaatttacgaagatgtcaaggatctgaaaaccaggagaaatcacgtatgtcatcccggaggctggggtctctctcagctggcttggaaaatgctctttcaatgatggttattcagagcagagggacaaaaaggactgaacgactgtccttttgatgtgaccctcagcccttccccatctatcttttctccacctgcttcctagttctggtgatggaggaaaagaggaaacaaaaggagcagaggagatgaaagggaggctgaaggggcatcttggtgcagaattgcacctgctgagaagggatggagcacaacagaaatcaatgacagaggcagagtgctgctgtggtatttgttgtctgaccacaaattctttttcctaatgagtcagggcttacattcatgagtcccttaatggtgacacaggctgggaagtgtgaccagccaaagcataatagttttgtagctggctcaataggctgcattcacagccttttggaagaagaggcctgagtgtggctgaggtactagagagagtaaccagcctggcacaaagcccaccagcctgagtgggctcctccaggagcctctcgcctgctcttcgcagcaggcaggggccaactctgcctgtcatccaagaattagaagaggaggaaattgcagagggcctgcagatgcccccactgctgtgtctcgcttagggcagatgtggtgacaggcccaggggaaaagctctgatggagcctaccaaactgctggcaggaagtggggcagggtgggtgaagtggggcggaagtgccttctttccactgccccctggcgctttgctgtggagacccagcagcacgcaggaagcacatgtggtggggctcttccgcgctggccacatacgtgaggccctgtgcagcctcgcagagcaggcaagcatcctctcccagatgcctctgggttcagaggctgttagagcagctccccatgcctgtttttttatttttatctttatttatttatttatttttgccccagcagtggctatgggaatgtgaaaaataaagcagtggctattggaatgtgaataataaaaggggactttgtttctctcactgctaccagactctggtacaaattcctgaaagcatgtgaatctacccacagccagtgatgcccgggtgcttgctaaaaataatctatttttccaaaaagaagatgacttgagattaggagaccacaggaggaaaaacaacttagagcaaaggaaacctctttgggattcaggcctattagcttacttcttccgactcaagagctcctccctgcctggcctcagccctctctggcctctccctattgtctcagggctccaatttgaaggcctaaatctcaagtttcatgtggtctcactttgagacccagctctaatctttctagaaacacttcacacgggtctggacgggagagaaaagcaacaaactcctgcagtattttaaaacacaaatgaagttattgacattgtcagatgcccatgactccccagcctctaaggacagctgacagttctctgcttctcttagcttcttcttgcttccaggaattttgcttgcaccttgcctaatgaaccctgctgcctccactggctcccagtagaacccaaactggcaatatgctttcagtggccagcagcatgaaatacctccaccaccgatttcctaaggggtaggaacaagaaaagggaagcaggaagctctgcttcctgctttggcccttgggttcagggctgcacccagcactatagctgcccagggcgctgacttgaggtcaagggcaaggtggcctcaaagatgatctagagagggcttaactgtgtttggtctttgaaatgtttaaactttctgaatttcagtgctctgaggtaaggctcagataacagccctactcagagctctgcaaggaagggtttctaagttactaaaggaaagaaagtgacagcattctctttgagcagggttgctggaacccctcacacctaggtggttccttgctcctgatactaatggttccactccaaactgctcttcttcctgtctcttcccatcttgggaggatcaatgactctccccagtcctgccacctccctcccagtctcctgaaaagccctcttctttgtgctgtttttccccactcaatctaaatctggacagaccgaactgtcgctcatgttaccccatctccatttcttgtgcaggagcaggagcagacttttcctggaggggggagcaccatctactctatgatccagtcccaggtacctctccagtttctctagtccattccatacctatctctggggtttcctaatgcccccctgaaactcacaccattgaatggcagaataagatcttggtgcttctagaatccagaagatagcttggcttcagttgcattaacacattatttgaaaagatccgtgtgatactagagcatcttaacacagctgggaagcctgatgtggacattccttcttcttccgtgtctggcagaaggtctggcccagataaagtctataggagcagaaacctggttaggggactcaacttctgctttcttgccctgctgctgcttctaatacttggggcccttgcactttttatccctattccctattatattcgttttcaggaaagaatgaatctgcattgatctcttttattttattatgacttagcaataatgtccattttcttttcttttaaaacaattttattgtttagagacagggtctctttatttattttttatttccataggtttttttgggaacaggtggcatttggtgtcatgagtcagttctttagtggtgatttgtgagatttttggtatacccgttatgagacaggatctcattctgtctaccaggctgagtgcaatggtagaatcatagcttactgaagccttgaattcccggcctcaagtgatcctcccacctcagcctcctgggtagctaggtctgcaggtgtgtaccactgcacccagctgtattttcttactaaatctcacataacagcctcatgaaaatagttctaatactttagatgtggtctacattccatatcacaatgaggaaaccgagactcaggtcaactgatatctcaaggctacatagctaggtagtggcagagctgagccaaagggtttctgagtctccattgcacctcctcatactccacctcttatattctgggattacagaaattcactcataaactggagaagcatcctttaatactgatggctaaaatgacattgataacccaggctgggacatctctcccaagggaaacactgcctcctggtgcccagtaataaaagactttctgataaaaatggctttaaaaaaaagaaaaaaaaaattgagcaccatcttcagtttggtggctgagctgtggggcaaagaaaatctgattataagagcggttgatatctgccagttctctagtttcagccacattgaactccaatgagaggaatttctatcagtgcaagaaagaggtcccctcaaactatggtgttgggtgagaatgacagtcctcctctggagcatcttaaaaggagaatgtttacctgatttagaggacacctggttccagtccagggaagggaggcaagttgccaaagggaggcattgaggtgttgaggaaagagccctggagagtcttgggtttgaattctgcttctactgtgtacgcactgcctgacttgggctatttatccttttggagcctcatttgtggcatggggcaaattatgatcattcttattttataggagtgttaaaagagttagagaagaggccaggcgcggtggctcatgcctgtaatcccaacactttgggaggccgaggcgggcggatcacgaggtcaggggtttgagaccagcctggcccacatggtgaaaccctgtctctaaaaatacaaaaattagctgggcatgatggcaggcacctgtaatcccagctactcaggaggctggggcaggagaattgcctgaacccaggaggcagaggttgcggtgagccaagatcgagacattgcactccagcccaggcaatagagcgaaactcttgtctcaaaaacaaataaacaaaaaaacagttagaggagaatacatgtataagataaatgctcaacaaatagaagctttcattaatgacagagcgagactagcactcaggttgtctgacctcctggctagtccagggctcttttcactaacacttgaagcttccatctgggcagggttgaggaggagaaacggaagagataacctttgtaagattgtgctggatctgtgcttctgaaatgattttatttctcttctcattagtcttctgctcccacgtcacaagaacctgcatatacattatattcattaattcagccttccaggaaggtgagcctcttcccgtggtggtggtggggtgttgttgatgtagatgtgtattttgcatgtgtttgcagtgagagtgtgtgtgcacatcctggcaagttgttctttattgtgtgtatctgagtagcttctgttaaatgactgtatttaaatgtcaatgggccaatgagaaatgccttactggttctgtctggagaaaaataacagcttctagactaagagaacagtagactagatgagtttttgggagtttctgtgggaggtaaaggacagtcagagacagaaaggaggtgctttgcacagagagactacggggtacttagtaggtcagctgaggctatggtgagagatactggaggggtttgcaaggcagggcatattgcctggagctggaggagtagactggatctagagagacacaatcttgaccttcagagaccagagaaaggtcctggccagtcagtcacctgctggtggaggcctctggactgaggcaacccatccttttgcactgaaatccttctccaagctgagttcgtagctctcttgtgtacttggaaacagagttgggtatcctggtacacatggtcattgtttttctcttgtatggaaggggatgggaagagtggtgttcccaaggctggagccacagtgtgaagccagaaagccttaacatggtagtatgggaatttgggagtccacacaactgtggaagtccatgcaggtcagggaccacaggtttgaaggggtttaggacagattttcagacttttcattcaacctccttccaataagccattcaacctacttggatcccatcgtgagagagatttgtttttaattatatgctacaatataaggccatatagatgttcacaggcaccatgttcacctgctttggtgtatgtaaactctatatgctactgaatgtgcctctgaattctagtgtccttgggttggcaattatttatatgcctggattgtttacattaagggtgtgtgtatgcatgcgttgaagagatacatggtttggggcagtatttgcattaggattgcctgagggatatgtgtgtatgtgtatgtgtatgtgtatgtgtatgtgtgtgtgctctgggaatgtgtgtgtgtttatatatacacaatatatgtatatatatgtgnnnnnnnnnnnnnnnnnnnncacacacacatatgtgtatgggttttaggtgtatgtgggtatggaacagcaaattctgattttggttcagaaatatcatattataggcaaatactgtatatattgtgtcttccctggagaccataaacaccattgttttgctcctagggtgacagattctattcattttctggctgagagtgcctcagaatttttcctgggccctgagtctcttttgggacctctcacatcacttaggagtgggagagcacttatctcgaagttaagtattctttaccttctgaatttctagtctggatccaggaagaggaaccacagcccttccttcaatagcactatctatgaagtggtaagattctggaactcctcaatgggtttactgtctgttgcatagccctgaaatctagccatgaaagggtacacttaggaaaagatcattcacacagtctcagagttgtagggaatttagagatcttctaatgcaagtctttgttttagagatgaagacactgaagcccaaggagagtgagggtctgacccaagatcatattgcgtgtttagatatgatacttactgggcagcttgggttttaaattagggccgtccccgagctagttcccaggctgtgggccacaaactggacatctctcctttccaagagtgttcggaggaggggtcagagaggggaagataaaggactctaaatgattttctaaaattagcaagtctttgggagccattccaggacataggtgagcttaatcttcttcaggggtcaacactgttcagagatgaccactgagcctggtggttgaattgattcccatcagagcatttagggactggaaaggagggactcaacatttcttgggggtttattatggataaggtagcctgccagtgtcttcacatggattattttatttagtcctcacagaatgctacaagataggtataattatactttccatttatactcagagaaattaaggcatggagagcatcccccaacctcccccactacccattagcctcatactacacctgagcctccccacctgtggtccaataaagatgctgccattggtcagaagggagggatgggtggctgcctgctggaattcctggcacttcagctatcacccaacattaaagccaactggacaacccagggtcatagagggcactgtgtagacccaggtagcttgtgaggtcatgaaaaagcatatgtggttaagagagtactggaattggagccagaagaactagattcaagtccctcctgcacttcacactagtcgtggatcctgagtaatttgttttgtcactctgagcttcattttttaaatctgtaaaatggggatggcaagtcatacctcacaggattgtgataaggacctcccagtgcaagggtctgaagtttctccttttcttttgcagattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctgagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctccataccctgcatttttattctctatagcagccgaagggcacttgtgggccatcaacaaacacatgtctgtttgaacactgctgtagagggtctgacttcctggtgagctggcagtgtccttcagccctgttcacactgggacagcagagaactagacactaggggctattccatcttgtgaaggagagccaaggcactcacttggtcacatcctgcaggatccctttcccctgagactgtgctgctggccaggctggtttcctcctggagagaagtgtgaacagaccacatcttaaagcaagtgagaagcttaaaaaccaggcaaatatattcagaaagagcctgggggtccaaggcaggtactgggagttgagttgcagagtcaaggagtttagtgagtagaggcagcaggaaatgacggggttcagaaacagtccagatgaacaccagggactctgaccattgactgctgctggcctttcatgtgtcctgcatagatcttgaactggccagatttatttaaggagcagaagagaccctatggggtcagggcttttgaggatgctgtattctagaaagaaagatgtacaacgtcatcatgttatgtgtctgattgttgagcttccgtgacaatgcctcacaaagataattatccatgcaacaagccagtcaatgaacaagcagtaattaagctcctgctgtgtatgaagcactgcctgaactcctgggagtacccactgcaggtgacagaagccatactgagttcaggatcatgtgcaggagagcatgacagaggcagcacacaattaaaggacctagatgggctgcaaggtgatggtaacagaaatgtacactagagtatcacgaatataagtcaagtatagtgcatcttacaggcagaggagagggctgtggccacagtcttagggagagatactgtgggtattctgtgtccagactggacaataagaagggaagttcttttgggtaaatatgggaggcttatttgaaacaggcattttaagcacctttacaaaatagcaaagaagtaatacacacatatggttttaaaaaaatccagcagtacaaaaaattgtgcagtaaaaaatgtctctttcccaacttgagattcccagttcctccccagaggcagccactaatgttttttgtatttctttccatagcttttctatgcctatgtaagcatgtagacttacattttttcttttcttttctttttctttctttcttttctttctttctttctttctttctttctttctttctttctttctttctttctttctttctttccttccttccttcctttctttctttcctttcctttctttcctttctctctttctttctctctttcttctttctttcttcttttttttttcttgagatgaactctcgctgtgttgctaagggtggaatgcagtggcgcaatctctgctcactgcaacttccgcctcctgggttcgagtgattctcctgcctcagcctcccaagtagccgagattacaggcacacaccaccatgcccagctaattgtttttttgtatttttattagagacggggtttcactatgttgaccaggctggtcttgaactcctgacctcaagtgatctgcccaccttggcctcccaaagtgctggggttacaggcatgagccaccgtgcctggccaacatacatttttttttttaaatccaactggtagcatacaatgcacgtggtcctgaactttgttttttccactccataatgtatcttagagcccattccatattagcacctattagtccttgcttgcttcccaagcggcagggtttgccgttgcatgggtatataatcatatatgtaactggattctcactgaatgaatggacatttaggttatttcctgccttttattttaaataacactgcagtgagcatgatattatgtacatcttgtgtcatgtgtgacaatt

SEQ ID NO: 13197 - DNA, 36917 bp, Human
ccaaagtgtaacaatttgaccaagaggaatttgattctggtgctgtttcaaattttatttgcagggttctttcttttcacttttatgtttttttcccttttatttttagttgacatataataattatacatatttatgggatacagagtaatattttgatacatgtattcaatgtgtgatgatcaaatcaaagcaattaggatacctatcacctcaaacattgatcatttctttgtgttgggaacattccaaatcctctcttctagctttttgaacatatacattaaattattcttaactgtattcactccatagtgctacaggatgctggaacttattcctcttctctagctgtaactttgtatctattaaccaacttcttcccatcctccacttccctctacccttcccagcctctgataaccacaattttactctctacttctatgagctcattttttaagcttccatatatgattgggaacgtggttttttatctttctgtgcatgacttatttcacttaacataatgtccttcaggtttgaggactgagaagagcagacattttattgttcatctccatgttgagaatcagaaatgtccccaattaaaaagtgattacaaatatgttatatcaggaactgtggcttgcctgtgggtcctgggtgggcaaataactaatttacattcaataggaatgagcttgaaatttcctagacatgatatgatttggctgtgttcccttccaaatctcatcttgaattgtagttcccataatccccacatatcatgggagcaacccagtaggaagtaagttaatcatacgagcagttaccatcatgctgttctcgtgatagtgagttctcactagatctgatggtttcataaggaaggggctttccccattgctgctcagtgcttctctttcctgccaccgtgtgaagaaggacgtattggcttccccttgcaccatgattgtaggtttcctgaggcttcccaagccatgctgaactagaagtcaatttaaccactttcctggccaggcacaggcccatgcctataatcccagcactttgggaggctgaggcaggtggatcacttgaggtcaggagttcaagaccagccgggccaacatggtgaaaccctactaaaaatacaaaaattagctgggcatggtggtgcttgcctgtaatcccagctatgtaggaggctgaggcaggagagttgcttgaacctgtcaggtggaggttgcagtgagctgagattgcactgctgcactccagtctgggctacagagtgagactgcatctcaaaaaaaaaaaaaaccaaaacaaacaaaacaaaacaaaacccctctctttcctttataaattacccagtctggggtatgtctttattagcagtgtgagaacagactaatacagactacaagggtgggaaatccattcttttgggccaagtaatcttactttttttctgatgttcagtggataggctgatgtcaaacttcaaatagtgaattatcataaaggaagaagagcagagggtggtgctgggggtaagatatgcagcacaaaggctacgtgggtctgatttcccagacttcaggctctgaatgacacctacccaggcttgactgggaagctcctatgtcttagcccctgaattaatcagagggattcctgcctgggaacgaaaagcagacattctctatcagggtcccttattcttttctgagtactggcccccctgagagtacagtagaagctatgaatcttccccctacaaaaaagcactcatgtaccttcaaacaaaattgttctcagtttccgtgatgctcttagataaaaaaatttacaagacctccggtttctggtttctggggccccacacaagtgtgctgggtggagagaaaatctcagtggtttttttttttttctctctaaccctgtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtactttccaccaactgtgtatctgtgattgtgcactgaaggcatggtcagttgggaaaggggagacgggatgtagttcaaccctagaagccagatctggtgtctggaaagcaggtatttccattccaatagcatggccatggcatggttggggagcctttcttagcactgatgaatggagcttcatctcctttcccacggggatgtgatcaaaacaggaacctggggagcaagagaagtaggctcctcatattttgtcccgtggttggtggtccatgaagttgtggaaaagtgtttgttttttcattttgaataagaagaagctctacactgacagctgctgcattttatgctcagacacactgtactcccttaggcattctttgagacctctgtatatgtgaggtgttgcatcctgagccaaggtaaatgatattgtcattgacccaaagaaaagatagatcaaaattataggaagaaaagcttggaaaggattgctgtctggggtctctgaatgagggtctgagaagaggctggaagtgcttcagcatcaaaggaaccttaacacatctgattgctaagagttaaggtccattcctctgccacagcctgttcggtccccggtgtgtgaccaagggctgagctaactttccttctcctgttagagctgcctcaccctctttcttcatccagtacctctcttcttatgccagctgagaaacagcagtgaaacctttgactttcttgctattcccccaagtaaatactcaagtctttttaatttaaagggctttaatgctcaccactctgagtaaaacagtaaaaatcaacaaacatgtggtagtcacactgtggcataaaatgatgatagtttgtaacttttggggagatgaggtagaatgtgtggaggatcggtctctcacatattctacctctcaggtagagtcctttggttcatgactgtgtgagtctacggctatataggttctgtgggcctgactcaatgcataggacattggtatgaccttgggactgggggctgatgtgaagtattcatctaactattgggaaaagcagggttgccaatgagaattggaatattttaggactttctctaggcatactgaaaacatcctgacagttgacctttctctgacttcttttctaggcttcatcttggtcatttattcttctttgaaacaatcagaccacacctgattatgttatcctttgaatggataatattggttttgatgaggttagtaaacctgggttataacacccgggctataacctgggttagtaaaatacaaattaagcacttactgtgtgtcagacattgtgctaggccttttgcatactttttcatttaactttcattagaaaatagtgaggtggctattattatctacatttttcagatgagaatactgtcttgcagagagattaagaaattctcctaagggcacacaggtctaacttccaaaccattctattatgattatacctttcctagactaaggcgagggaatcttggtgaaggtcaatgtgtctaaatctcttaattttactgtttgccttaaaagaggcgttttctcttacctctgggcttatgtacatgccttctttccacctagatttctctccctcctgccctctccctgcctctcttttaggcttctgtttttatgtgacttcttcttggactgtctgcctgtgactgtgttctgaaggcatggttagatgggaacctcaggctccagattatggtttgtgaattgcttggtggatcatctgtttccttgaactttttgaggacagaaaccatgtgcagtgttgtgctgctgaacttagcacaggcctggagtgtggcatgtgctcaataaataattgttacacaaatgaatgaacaacttcaaaaaacttccttttggactacacatccatatcttcctgagaagtgcaagtagttctctcctctgccgtaagggatgcttctgtggaaaagtttgagaagcactcttagctctcttcttccttctctcctcagacttgggtttctcagttctttggtttcaaggcaatgatttagggcatgctccacaactacccaattccccatctgtccacaacacttagcaggatgaagtagacagagtattgtactagaaatgagatgacctagttctatctgggttccatgctgtggaattttcaacaagtcattaaagcttcctgagcctcagcttcctcagctccataatgggtataataatctgttcctcatttcttcaaggggttgctattaagatcaaataaaataaaaaatgtgcaattgctttgcaattgtgacacatgcggaatccgatacagatgaaaacctgggaagagcatcagtaaattcttaagccccaagcagtctcctgagcccaagatcagaacttctgtctcttaaacatcttctctagactctccagacacgtgtctaaaacttaagtcatcatctctgtttccgctatgtattgctatttaacaagctgccacaataccgtggcttaaaataataacaatgatttactttgcccacagatttgggggaagactgttcatcctgtctcactttcatgtgcttttcatgtgcttgcaatcagatcatggtgtggcctagagtcatgcaaggctcttcactcacagggctactgcctgaacagagggaggctcaaagtgctgggtggctagtgccactcagcagaagcctcccagagttggtgtcccaagagaaataggcaaatgctgcatggtcttttctaagctagctttgcaggtcacacttccggtgtattccattcattgaagccatcaccgagcctactcaatttcaaggtgaaggggcacaaagtccatcatttgatgagaggaccatcaaaaaatttacagacttaaaaaaaaatactacaatccttcttcccccaaacctactgctcctccactgttccccacctctataaatgacatctccacttgtctagttgctcaggccagaattctaggagtcatccttgcttcttttctctcccttgcttctcatgcccaatgagtaagtcctgttaattctactttcaaaaatatctctcaaatatgtccaattccatccagccccatgctacctatctcagatcaagccaccattttctcttatcaccaatttccacaatgatccactatcctaactgctctatttactgcattctctctagctaacctgttctctaccctgctgtcggtatacattttctaaaatggttctctgtttgcatcactcttctgcttaaaatctttagtggccactgtgggaaatgagaaagcagaagctgtgagcctaaagttcacatttcataatgagctcacttgctaccctccttagtctatgtcctagccagtgagctacttcctactccgcaaatgaatttcatttttgtgtttctgggcgtttgattctttttccctcttgttggaatattcactacccccagtcgtcatctttccctggtttcatcccacttaggctaattcctcgtacagaagccattctcaacccccaaattcaagtgaggtgctcccttttatatgccctctaagcattccgtattttccttttcctaacacttatcaccaatagcgaaatcatctgattaattttgttgattcactggaatgaagctcaagggaaggagccacatctatctattgcacccttacagagccaagcacatagtaactgcttactgcatagttattcgatgagtgaatacatgaggaagttcatgtacgcatgtatgcatggagggatgggtggatggagggagggagcaaaggaaagaaggaaggaataaattttgagtcattgtttcagtcaagctggggtctcagagtagctcttactggccctgataaattctttctcccatttcccacagtggctatttcaaactttcaccctatcctcaaggccccttacctcagtcctctgccctctcagcaaagcatgtgcctccttctttgcagaagaaatcgaaactagagaccattaggcaggaagcccttcaacttcctgcccactatcttcaaactggtaacttttctccaccaccagctgtctttcctccttctcttttccctcagaggatgaagtgtccctcctcccagtcaagacctgtgccactaactctgctctgagtcccactagcccaggctcgtcaatcacctcccttctcttcatgtcttccctccactgaatcctttccttggcctaccatagcttaggtctttccctacttgaataacaaaaacaaaatactctctactttttcatgaccctttacataccgccctaccattctttttcccattcaaattgcaacgtctgaagagaagagtctatttttattgtttctccttcctcaccttcagattgcattgcagtgttgcccactgaactcattatagttcccatctcaaaaaatagtagcctgctcagcttctcaccaagacacaaacctgaggtcttggtagctattgcaaaattacttcctaaaaagggttgtacaggcttgttaaatatttaatcttatgagagagcttcaggtaactctgtctccacatccttaacactcatcttcttttcttccttaagagttttactagaaaccatgtgttttgtttttattatttttatttttctcaatatatgaggaaaccaaagaagccaaccatgtgtcttgttttattggagtaaccagaacttactctttaaaacctttccctttcctggggagactctatggtcctgggattatgacttcctttgatctgaattttttcccgttacaattctgtttttctacagactagaaacatgggcgggcacagacaggatctggttctatttcttcttcttttttttaaaagtgaaagcgagttcattaagaaagtaaaagaataagatccaactttgttactttatcccaatcatccagacatatcaccaaatacttcctgttagaattaaatcaaaatagtagttttttaaaaggttgcttcagctacttcctaaaaagtggaattgttaagaaggcaaatcaagattttatcagcagttaatcacttctttatttctcggtaagaagttacagccaaccatcaggacagcctttttggaattgttacacatgggtggttaaggagggagagaagaaagatacaatactgtatgcttacctgtcatcagcactcataatatactgaaattggctgagcatggtggttcacacctgtaatcccagcactttgggaggccgaagcaggtggatcacctgaggtcaggagtttgagactagcctgaccaacatggtgaaaccccgtatctactaaatacaaaaaattagcccggcgtggtggtgcatgcctgtaatcctagctacttgggaggctgaggcaggagaattgcttgaacctggggggtggaggttgcagtgagctgagattgcaccactgcactccagcctgggtgacaaaagtgaaactccataaaaaaaattatatatatataagtgatctgtctggtgttactacctgcctctgtcatcagacagtggattgtgctatcttcctgagtgtaagtctgagacatcctggggagtctgccaaagatgacctagctcagtacttctcaaccagggtgaatgtgggagaattttgtccctcaagggacatttggcaatatctggatacatttttggctgtcacaactggacaagtgttactggcacctagtgggcagataccaggaatgctggcaaacatcttacaatgcacagaacagccccctacaaaaaagaattatgtggcccaaaatgtcaataatgtcaagactgaaaaacattgatctagactgcctattatgaccgcttctattaattcatgtggaaacaactaacagaaggagaacaaatctggaatatgtctagtgattttaaactcctagaaagaatgtcctcctaggctgtatgctccaagaggccagagactgtatctgccttgctgacagcagagtctagcacagcgccaggcatgttgtggttgtgcgatgactgtattcatgtaatccattttacaaaacatatcttaaacattaattagaccacagcctctgtcttctctaacatccccttcatcacatttctgtttttgttgggtggcatctcagttatgggcattttgaggtctggccaaggggaagtagaaatgggaagtacttagttggggttagtgggatacatgtatgagggttgaacttattctgtcagagggattatagggcatgggctggaccaatcagaagcactgtagaaatgaatgcctaggtatttccgtgtacaaaccaggacagggtaagtgcttaataaacatttgttgaatagatggatgaatggttggaaggctgaatgaacaggaacttgaaagccctggggtcacagacatttttatcttttagtggttgagaatgtttttggaaatgatggatatgtggaaagtgaacagctagtatatatcatgttgaagagtacaactgagtttttgtgcggcagcatatgacaccagagtgatataggacatatttcctcttcttctacctttagcttttattccacagctcttgtttagcctttgtatacatattctaagttctccctccacaaaaaggaccaatggacctcccttcatcttgtactttgtccttatcatcttttctttctccttaccttaaccaaaccaggtttttaaaaatgacctgaggcttatataatttggagtattctcatgaaaaagaaaaataataaaagaacaaaactggaaatacaaataggaacaaaaataaattcaattagaataaaaaaaaagaaatcccagggaattagttcaggttaaaaaaatacaaatactacaaagaacatgacagcataaaaaatagcagcataattttagttaattaaatgccttcgtgcttccacaatactttgctactgaatagctctggctgttgttcacttccaacctgctttctcctctgcttcccacctgcagcccgattgcaacatgtccatggccattgccagtgagtcagtgcagagggcagcaagaatattcctggatgccatttcttcactgaagtgggtagcgggaacttcacacacaagagtttgcaaccctcatacatgtatcccgctaaccccaactaagtacttcccatttctacttccccttggccagacctcaaaatgcccataactgagatgccacccaacaaaaacagaaatgtgatgaaggggatgttagagtagacagaggctgtggtctaattaatgtttaagatatgttttgtaaaatggattacatgaatactgctagggctcctccagggccatccaagaagccctgaagcttcagcttcatcactttcacgggaaatctgcctctgatccaaactttgtgaaacaatggtttatacagtctccactttgttaccttctaataacttgcttctaaatacattgtaaatgcacacacaagacatgagccacttttacaggaaagcattttttttttacaggacaagacattattaataaagctaaaatgtatctactctctccaatctcactccctctctgactgtgtctctcaacacccaatccccttgttcactccacactacccactcgccacctccttgctgttgtttatgtatggcaggcaaatccctgccccagggcctttgctctggctctttcctctgtctgggtccctcctaccccagataccctcttggccacctctctcctccaagtctttactcagatgtgacctacttatcaccttataaatgaagttcacccttttgcccctaccagtacttgtgactccccttaccttattctaggttttctcctctgtcatggcagttatcatctccttacatactatacagtgtgttctgttagtgtgttgattgcttacgttttttcaccccactctaatgcaagctctgttaaggtagggatctttgctgcatgtaccatagatatgctaattcttctctcttcaaacctccagcatcagctaatggctccaggaccaaactacactttacctatcattctccaggccatcccccatccactacagcccctcaccctcctgtcgtttcgggtcctaaaccggtctgcatcgatatgcgctgttcaatcttaccttttttaaaagaatttagggatgcttgtactcagtatggtcctacttctccttatgttaagatggttttacaaacttttcgtactgaagtcacttacttcccttagattgggaccttttggcaaaagctgttctaaccccatctcagcatttacaattccgtattccatacctggtggtcagaagaggcccatttgcaggctcagctaaatagcagtaatggcattctaattactcaggctcagctcacaggctccgatagtttctctgatgcttatgcccagttaaactttgatgcccttaccacagaacaagtaacaaaggtgtgtatgagagcttgggataaattacacgctccaggccaagctcctgttccttttaccatagttaaacaaagtcactctgaattatacccagattttttggctaaattacaagatgctgttcaaaaatctgtctctgatgagcgcactcaaggcattctcctttatatgttagcttttgaaaatgcaaaccatgaatgtaaaatggccatgcattctgtccaacgcaaaatttacctgatcacgaggtgttgcctgcatatattaaagcttgtgaaggcattggatcagatacccacaaagctattctgtgggcaccggccatgaaggacaccaaccaaactggtcccattaattcttctcttggagcctgctataattgtggccaacttggtcatattcaaaaaagttgcactgttaaaaacttacaagcggccaagtcggttcaacaaacatggccaaatgctgctcctactgtttgcccacgttgtcgcaaaggtaaacattgggcaaatgtttgccgctctaggtataatgtagatggaaaccccctaccacaacaccagggaaacagggagcggggcctgggatggacccgacatcaaataggacacttcaaactcagaccaacattgcgtttccacttcaggcagtcccagtgcaacccccagcacaaacaaatctacctacaaccaaaccaaataggtcccagcctctacttctgtctcagtacaatgcttgtcctcctccacagtaggaggcggggtggttgatctctttagtactattcctctaaatttacttcctgattctttgcctttgattgtccccacgggggtcactggccctttacctcaaggttcagtgggcctggtgttaggtagagcatccacctctgctaaaggattcaccattcatactggtctcattaattctgattctgttgatgagattaaattaattgtgtctgccaaggttcctatttccattgcgtctggtgagtcagttgctcaactgcttttactacctaatatcattttaaacaaaggcgataagacatgtggccctgggataggctccggcggtgaaaaggccacttactggattaatgtaatttctaaacaacggcccacctgcaccatacacattcaaggaaaaaagtttgagggcctagtagatactggtgccgaagtttctgttatttcctctagtttatggccttcctcttggcttaaacatcccactaaggtaggactagtaggtgttggaaaggccgaggaaatttatcagagcacatttatcttgctttgcactggccctgatggtcaaaaaggtacaattcagccctatatcatgccaattcacattaatctttggggtagagatttactggcaaaatagagggctgaaattaatattccacataactcttctagtgctcccagtcagcatatgatggaaaatataaggtttgttcctggattaccaaacccctcccagtcactataaaagaaaacagggctggtttaggttattctttttagtggcggccactgccatacctcctgatcccattcccttacaatggaaacctaaaactcccgtttaggttcagcagtggccgctttctaaagaaaaactggaggctttaaatcaattggtttctgagcagttgcaacttggatatgtggaacattctctttccccttagaattctcctgtgttcctagtaaaaaagaaatcaggcaaatggcggatggtaaccgatttaagggccattaatgctgtaattaaacctatgggggccgtccaacctggctttaatacctaaaaattagcctctcatagttattgatcttaaagatttttttttatattgctttacataaatcagattgtgaaaaatttgcttttactgtaccatctatcaataatcaggaacctgcagttcattatcaatggaaagtacttcctcaaggaatgctaaatagccctacaatctgccagctttatgttgggcaattgctttcaccagttcaagcccaatttcccgaggcctatattcatcattatattgatgatattttaattgctgcccccactgataaagaattgactgttaccaaattttgagctgctgtgttatagaggttggattacacattgctcaagataaaattcatcagaccactcctgttcaatatttaggaatggtggtcgataaacaatgtattcaacctcaaaaagttcaaattaggagagattctttaaaaactttagatgacttccacaaacttttaggtaacattaattatttaagacctactttaggcattccaacctatgcactgtctaacttgatttctatgttgcggggagattccgatctccacagcgccaggattttgacctctgaggctttaatagaactggaatttgtagaagaaagaatccagactgcccagttatctagagtacagccatttcagccttttcagcttctagtttttgcttcattacactcccctactggactaatagttcaacataatgatttagtggagtgatgttttcttccttattctgtctcaaaaactttgtctgtttatctagaccaaatagccatattaattagacaggcttggtgcagaatacttcaaatttctggatttgatccaaatataattgtagttcctttaaattggctcaaagttcaagctgcctttcaacattctgtactgtggcaaattcacttggctgattttattggcgttattgacaatcattatccaaaaaacaaattatttgattttataaaaatgacttcttaggtggttcctcgattaaccaaaaatcaacccattcctgaggctgttacagtgttcactgatggctccagtaatggcaatgctggctatgtaagtcctacagacaaacttatttctacctcttatacttctgctcaaaaggcggagttaattgctgtgattactgccttacaggatttccccaaacctttaaatattgtctcatgaaggggtgggttgcccctccacacctgtgggtgtttctcataaggtggaatgagagacttggaaaagaaaaagacacagagacaaagtatagagaaagaaataagggggcccggggaaccagcgttcagcatatggaggatcccgccagcctctgagttcccttagtatttattgatcattcgtgggtgtttctccgagagggggatgtgtcagggtcacaagacaatagtggggagagggtcagcagacaaacacgtgaacaaaggtgtttgcatcatagacaaggtaaaggatcaagtgctgtgcttttagatatacatacacataaacatctcaatgctttacaaagcagtattgctgcccacatgtcccacctccagccctaaggcagtttttccctatctcagtagatggaatgttcaatcgggttttatactgagacattccattgcccagggatgggcaggagacagatgtcttcctcttctctcaactgcaagaggcatgctttcctcttatactaatcctcctcagcacagaccctttacgggtgttggtctgggggatggtcaggtctttcccttcccacgaggccatatttcagactatcacatggggagaaaccttggacaatacctggctttcctaggcagaggtccctgcggcctttcgcagtgtttgtgtccctgggtacttgagattagggagtggtgatgactcttaatgagcatgctgccttcaagcatctgtttaacaaagcacatcttgcaccacccttaatccatttaaccctgagtttgacacagcacatgtttcagagagcacggggttgggggtaaggtcatagattaacagcatctcaaggcagaagaatttttcttagtacagaacaaaatggagtctcctatgtctacttctttctatacagacacagtaacaatctcatctctcttgcttttccccacatttcccccttttcttttcgacaaaaccgccatcgtcatcatggcccgttctcgatgtcactgtctcttcggagctgttgggtacacctgcagactaacaacagacaaaacaggcacacaacgattaatatgagatttataatcatagtacttctgatggtcttaatccaagtgacagggttaagatttgcgaggccatcagcaactcctgcaattgcctcagttcctggcaccaaatttaaatgggcttttgatgcttcgaaaatttgttcttttaatttggaaatgtctaaagtgagattatcttctcttccctgtagatggcgtctaaccatgtcccagtgatgctcagactcattataaatttggggtgtaatacaaaaatctgacgtattccagtcacactgtaactggaaatgatgttctaaggtcatgagcctgtctcccatccaaatgacagtttgtctaagatcattaatttgacttgccaatttttgatcaatactagattgtgaattccacaatcttgtagaattcttttgccaataattaacaaagtttactgactgaacagaagagtgcaatgcaactcctgccacagcagccgtagctgtgactgcaattaatcccataatcactgcaattaaagtaaaaatgaatcttttggatctatttaaaatgccttttaatatttcagtcaaaatatggatggatggcgaggcctcccacggtcggtccgtggacacagggatccacatgccttctcttgctctcaccagcagaatacggtgctgccaattaaaagttgaatcaatgcaagtaaacaatctacaattttcacaggttatagtttgggaggctggtttaataactatatttcctacaactagcatataagggggctttatgcaactttgtaaaggaaccgttagaatggaatttaggtcgatagtataaaatggcttacgatatcttgtttctaaagtttgatttccagaccaaattctaatgtggtgtgaggccacagtaagcctccacaattctggatgttcaggaccagaaacaggacttattatttttggtcttggggtagagattcctttttcttcccattcccaaaggtagaaagactgtaattttttatgcttatgtttgtctagactttctgttaagtcgctatcgacagctggactcacttgtgcacttggacacgactgagtttgtcctgagcaattgtggtagaattgacctcgaggtgcccaatctataatagttccgaattcattgttttgtaatatcaccacactattggccacacattcttcccaaactaaaacttctgtattctttgatcctttaggaatttccttggggcaagttttccctttaggtctaaattttaatgatctttgataagaaaagtcttgtaaataatttacccgtggcctgagtgacatcccgcttaccatgtgataagtgaatctactgttaggactgacagtaggtacttctaccaaccaattttggactgcaggcattaaacatcctggtgctctccctaggcaaataggaggataatgatacccaatggaaatatttatcatcatcccttcttcctcaggtttggcagggcagcgatcatctgtggggccaggtacccatacactatcattaacatatacttctataggattatccatccatgtgactggtgttaccatctccgtggaggcgcttttctttgcatctctgatgggttcattgtagaacttcaaatgtctagtgggtatccaaacaggaagctgattttctcctggtgaaacacaagcaaaacctctcccccacgttatcagcttccctatttcccatgtcttattttaattatctttccactaaattagttttccttcatgtgggctgttctttttaccagtaagatgttctgcagaagtagtagtctgatttctataaatgtttaaaaaatttaaagtatagagtgctagattaagttgcatctgaggagtggtacactccttactgtctcccccttctttttgtttaactaattgagttttgagtgttctattagttctttcaactatggcctgtccttgggaattataaggaattcctgttgtatgtgaaattttccactgacttaagaatttttggaaagctttactacaatatcctggtccattgtcagttttgattttttctggaactcccattacagcaaaacaagacaataaatgttttttaacatgggaagtactttctcctgtttggcaagttgcccacatgaaatgtgaataagtatcaactgttacatgaacatatgataatcttccaaatgaaggtacatgcgtgacatccatttgccataatgcattaggacacagacctctgggttaactcctgcctcttgagtgggcaggtctaagacttgacactgggtgcaatgttgtacaatatcttttgcctgtttctatgtgacatcaaatttgttttttaatcctgctgcatttacatgagtcaaagcatgaagttcttgtgcttttatgaatgcagatgataccagtaagtcagcttgttcatttgctttagtcaaaggccctggtaaattagtgtgtgctcgaatatgagtaatataaaatgggaagtttctttttcttacagtttgttgtaataaattgaatagctggtttaactgatcgtccatgctatatttaattagagctgtctcaacatcccttgtagcctgtactacatatgcagaatctgatataatattgataggttgatcaaaatcttgtaacactgtaatgactgcaaccaactctgctctttgagccgattgatatggagttttgattactcgttcttttggccctgtgtaagccacttttccattgctggaaccatcagtaaatactgttagagcattttctaaaggttcacgtctggtaattttaggtagaatccaagtagtcaattttaagaactggaagatttttgtttttgggtaatgattatcaataattcccacaaaattagcaagaccaatctgccatgcaccagaattgataaaggcttgtctaacttgttccttggttaaagggacaactattttgtctgggtcatttccacataattttattattcgtaatcttgtcggaccaattaaagtagctatttgatccaagtacaatgtaaaagtcttaactgtactgtgaggaaggaatgaccactccacaagatcagtattttgaataatgatgcctgttggagaatgtgcagtggcaaaaatcaaaagttggagtggggctaagggatctattctatttatttgcgctgactgaattttttcttccactaatttaatttcttttgttgcctctggggttaacattcttttactatttaagtctgagtctcctcttaagatagagaacaaatttgacatggcataagtaggaatgcctagagttggccgaatccaattaatatctcccagcaatttttgaaaatcatttagtgtttttaatgtgtcttttcttatttctattttttgtggcttaatttttctattttctatctgcatccctaaataatgaaaaggagtagaggtttggatcttatcagatgctattgccagtcctgcattggcaacctctgcttgcagaaatgtataacagtcaattaatttatctttcgtttctgcagcacataaaatatcatcaaaataatgaataatataacagtctgaaaacttgtctctaactggttgaagagctcgacctacaaaagtctgacaaatagttggactattaagcattccctgaggtaacactttccactgaaacctggtggctggttctttattatttatggctggtatagtaaaggcaaatttttcacaatcctgctctgccagagggatggtaaaaaagcagtcctttagatcaattataattaaaggccaatcttttgggatcatggctggagagggcaacccaggttggagaggccccatgggttgaattacggcatttacagcccttaagtcagttaacatacgccatttgctggatttcttctgaattacaaacacaggagaattccaaggcgagaatgaaggctcaatatgtcccttttctaactgttcatttgctaataaatgtaaagcctccagtttttgttttggtagcggccactgatttacccacaccagtttttctgttttccaagttaacggtatgggtttaggaggctctacagtggtcacccctaaaaaggataccctgttccttctcttccgtgatttattttagcctcaattggaactttaatgccatcttcattttttcctagtccctttcctggtatatatcccatcttggtcatgattttttgactcatggggctatataatgtagcggtcatggtgatttccgcaccccattgttgtaacaaatctcgaccccacagattaagaggaattgaagtgatcattggctgaacagtactttcttgattatgtggccctaagcaatgtaaaatctcagtactctgatacacttctgaggctgtgactatgccgacaagtcctgtaacagtcttttgtttaggccaattttttggccactgatttaaagcaatgatagagacatctgctccagtgtctaccaatccttcaagctgttttccttgaataacggccttacacacaggtctgttctctgagacctgacttgcccaatatgcagcctttcctgtcggatcagtgcttccaaaccctcctgttctttttatttcactatttccaaccttaatatatggcaggagtaataatcgagcaatcctgtctcctggactggcactccaaggaattgaagagctaataaccaattgaatttcacctttatagtctgaatcaaccacaccagtatgaatttgaactccttttagatttagacgtgatcttcccaagattagtcctacagtctcctcaggcagcgggccatatactcctgtggggattttttgtgggggctcccctggaagcagagagactgcttgtatagtacataaatctactgctgcactgccacttgtggcgggggacaattgttgtactgtggtaactggcttattccctgaggtacttgggacagtgggggttgttgtccctgaaaaccctgaggaacaaagggctgaattgggaatgccccagtttgttgcagggcctgaggctggcccctttgctagtttcccgacaatggttgcccatttttatcaaatttggaacgacattgactagcccttttggtagtttcccgacaatgattgcccatttttatcaaatttagaatgacattgactagcccaatgttttccttttttacatcttggacataagtcaggtggctctctacctgttgttgtagtagcttgaatagttatattctgtttatttaagactgggcaattcttttttaaatgaccaatttgaccacaattataacattttcctccaaatgttctaacttgtcctcctaaaacaactcctgttattgcttgggccataagcatagctttatgcgtagctcctccaattccatcacgggcttttacatactctgagattacatctgatcctgcgggaacctttccttttaatggcttaatggctgattgacactcaggattggcgttttcgtatgccatcaactccactatgaccttacgggctttttcattggcaattgacttttgagcaacatcttggagccttgccacaaaatcagggtagggctcttttgaaccttgtcttactgtattaaatgtggagcaggcgcttcctgggtcttggattttttcccaggctctaaggcagatagctctaacttgctcaatggcctcattttgcattaatgcttgttgactaatagtgctccaattttgacctgttcctaatagttgatctgcatctatgttaactggaggattggcagccctatttcttcggacctgttcttgtgccccatcaattcaccaagtcttaaattgtaaaaattgagagggtgagagagatgattttgccagaatctcccaatcataaggaatgagtctatgtccatgagcaatggaatctaataatgtcctcatataaggggagttgggtccatactgttttactccctctttcatatcttttagcatttttatctaaaaagacttgtatctggcctcaactgtgagaggctctccctcttgggctccttctccaggtggcatcggttctaacgttactgggaattgccacgcctcagtatctccttcctttcttgacttctcaataatttcatgtaattcactaccctgtctactaggtggtgccataggattgtctcctagtgggcggctgagggtatggctccctgccctgtggtgctgggggcattcctagatatccatactgactttctgggggtggccgatactgaagttcggccggtggccagtattgataagctactggcagttgggtcttattttctctaacctgcgcttgaggttgtaatgttacggtcacctgacctgctgaaagaggacttggccctcgtggtttagactctaatggccccactaattctggaccttttccttctaattttaatgtttcaggatatatcacctcctgtaattgattatagtcaacattttgcgttgactgagccattaacggctctgctacatattcgcaatgtaaagtttccgtttccttctgggattttttccttgtcttttcattacaatctattatacagcttccaggggcatcagaaactgaaacgctatcttctgtttgaaatggttctaaagctgctttaataatgggccaatcattccatactgtaagtggaatgatattacccttcctacctgcttgttttagttccttaccaattcttttccaatcttctagatctaaatttccttgttctggaaaccatgggcaaaattgttctgttgtttgaaatagcttgattagatttttggtggatactctaactccccctctttttaaaagaattttaatgaagctaagataagaggcatatttacttttagttttagtttgccccattgtcaccctagcttcttccgagtgcacaagcttaccgtaaggctgactgtagatgtactcgggatctcttgtcgacttgtcctcaatgaccacgctcgagtgtaccttcaccccagagaaaagcctccacgttgggcaccagatgaaggggtgggttgcccctccacacctgtgggtgtttctcgtaaggtgcaatgagagacttggaaaagaaaaagacacagagacaaagtatagagaaagaaataagggggcccggggaaccaacgttcagcatatggaggatcccaccagcctctgagtccccttagtatttattgatcattcgtgggtgtttctccgagagggagatgtgtcagggtcacaagacaatagtggggagagggtgagcagacaaacacgtgaacaaaggtctttgcatcatagacaaggtaaaggattaaatgctgtgcttttagatatgcatacacataaacatctcaatgctttacaaagcagtattgctgcctgcatgtcccacctccagccctaaggtggtttctccctatctcagtaggtggaacgtacaatcgggttttataccgagacattccattgcccagggatgggcgggaaacagatgccttcctcttgtctcaactgcaagagacatgctttcctcttatactaatcctcctcagcacagaccctttacgggtgtcgggctgggggacggtcaggtctttcccttcccacgaggccatatttcagactatcacatggggagaaaccttggacaatacctggctttcctaggcagaggcccctgcaggcttccgcagtttttgtgtccctgggtacttgagattagggagtggtgatgactcttaatgagcatgctgccttcaagcatctgtttaacaaagcacatcttgcaccgcccttaatccatttaaccctgagtttgacacagcacatgtttcagagagcacggggttgggggtaaggtcatagattaacagcatctcaaggcagaataatttttcttagtacagaacaaaatggagtctcctatgtctacttctttctatacagacacagtaacaatctgacctctcttgcttttccccacagtctcagattccgcttatgttgtacatgccactaaaaatatagaaactgctactatcaaacatattgataattctgaattggcttctttattttcaaggttacaacaggtggttcaccagtgtagacacccttcctatattacacatattaggtctcataccactttaccaggacccatgtctgctggtaaccatgaagttgactgtttggtgtctttaatgacccaagaagctcaggagttccataatctcactcatgtcaatgccactggcttaaaagataaatttgctcttacctagaaacaggctaagtttattgttcacagctgccctcagtgccaggtcttcgtacttccaaatcaggaacctggtgttaagcctagaggcctaactcctaatgcttgatggcaaatggatgtgactcatgttagctcctttggcagactgtcatatgtgcatgtctcagtagataccttctcaggttttatctgggctacttgacaaacaggggaaggcacggcccatttttaaaaacatctgtattcttgctttgcagttatggggcttccatatcaaataaagacagacaatgcccctggatatgttagtaaggcttttgattcatttatacaacagtaaggaatttcccatattactagaatcccttacaatcctcaaggacaggctgtggtggaacaggccaatcgcactttaaaaacccaattgtccaaacagtctgaacaaccaaaacatgatttaactactccacactcccaattacatttggcattatttactttaaattttttaaatgttcctaaagataatactgtaactgcagccaaacgccattatacaggcaaaaaattttccataaacgaaggcaagtcagtgttatggaaaaactctcaaaccaatacctaggaacctggcacaattataacgtagggaagaggatatgcttgtgtttcaccaggagatcatcaatcccatgtctaggtacccaccagaagactcaagcttcaggtgaatactgacaactaaaaccacagacaaaaaacatctgtgtcagagattgccttcagacgtggtgagatctctgctgactcctcagaaacaggcacaccaaatcacaataggtgtaaatcaatcctccctgatggcagtggagacccatctaactaatcccacttctcctgattacttttctttttctccttacaaacctaaaaatctcaccatttctattagcctgaaaataacatccctctgttcttctcttcctccttcagcactcaatctcacttacactaggttttatttaatgattctcctccttatactttctgtctcaccagtttcctctcacactgatttacctgctacacataattattcttattaggcttatgtgccttttcctccacttattcgacctctcacctagatagatgctcctgcagaaatctacactaatgatagtgtgtagatgcctagagccacagatgaccgttgccctgctcaaccaggagaagaaggcactgcatttaatgttaccatagattataaatacccccctctgtgcctcggacatgcacctggttgcatccacctagaaactcaattctaggctgcttatcttccgaaaacatcagctacagataaaataggacatttagtctctggcctctccctttctcctttaaaacaaatgaaaggagaagtaatgggagataccccatactttcaatataaacctgcaggaaaaccatgccctaaaaattttgagggcccatctaaaactttaatttaggatgattgtgttaactcacatgcagtaatattaaaaaatgactcatatggtttagtaatagactgggcaccaaagggctatttaaaaaataattgctcctctagtggaagggaattcctggaggctaattattttatttcttatcaggagaacgagaatcatcattctactttgcataggaggatcagctcattctttcccttaaaatgggaagataaaggcattacccgccccccaagcctcgtatgatactccccattctgagcccagaacacccagaactttggaaattggctattgccatgtctggactgcgagtatgggaagggaaaactattttgactgttgttcccactactgtcccactctctcagtatcaacatagacccagacattctgctttacttacctccaacctgactattcccatacagagttgtgttaagcctccttacatgctgttagtaggaaatattaaaatttggacaaataatcaaactttccaatgcattaattgtcatctatacacttgtattaactcccattttgactccaggaaaagtgtaatgttggttcgagtttgagaaggaatctggattccagtaactttacctagaccttgcgaatcctccccccaatacatttaattaatgaagtgctacagcaaattctaaaaagatctaagagatttgttttcactttaatcgctgttatcacgggcctaattacagtcactgcaatggccaccactgatggaatggcattacatcaatctattcaaacggctcattttgttaatgattggcaagccaattccacccaaatgtggaattctcaacaaggcatccatcaaaaattggcaagtcaaattaatgatttaagacagtctgttatttggcttggagatcaggtagtgagtctcaaacatcacatgcaaatgcagtgcgattggaatacttcagatttctgcatcaccccgtattcctataatgagactgatcattcataggaaatggtcaaaggacaccttctaggtagagaagataatttatcattggacataactaaattaaagaaacaaatttttgaagcctctcaagctcacttatccatcatgcctggagctgaggcattagatcaggtggcagaaaatctttatggattaaaccccactacttggattaagtctactgggggctccactgtagtaaattttggaatatgtttctgtgtttaatcagcttgtttttagtgtcccagaccactcaaagaatcctgtgtcaaaatcaagagaatgaacaagccttcattgccatggcacatttatataaaaagaaagggagagatgttgcaggaagtcagggaccccaaatggagggaccggctgaagccatggcagaagaacgtggattgtgaatattttatggacatttattagttccccaaattaatactttcataatttcttatgcctgtctttactgcaatctctaaacataaattgtaaagatttcatggacacttatcacttccccagtcaatacccttgtgatttcctatgcctgtctttactttaatctcttaatcctgtcagccaaggaggatgtatgtcacctcaggaccatgtgataattgcattaactgcacaaattatagaacacgtgtgtttaaacaatatgaaatctgggcaccttgaaaaaagaacaagataacagcaatgtttaggaaactagagagataaccttaaactctgaccaccggtgagccaggcagaacagagccatatttctcttctttcaaaagcaaatgggagaaatatcgctgagttctttttctcagcatggaacatccctgagaaagagaatacgcgcctggaggtataggcttataaacagcacccccaggtgctcctgtctcttatggtcgaaactgcagaggtgaaatagactccagtctcccatagcactcccaggcttattaggaagagaaaactcctgcctaataaattttggtcagactggttgatctcaaaaccctgtctcctgataagatgttatcaatgacaatggtgcccgaaacttcattagcaattttaatttcacctcggtcctgtggtcctgtgatctcgccctgcctcctcttgccttatggtattctaataccccgttaagtacttgatgtctgtcacccacacctatttgcacactccctccccttttgaaaatctctaataaaaacttgctggtttttgtagcttgtggggcatcacggaacctaccgacatgtgatgtctcccccagatgctcagctttaaaatttctctcttttgtactctgtccctttatttctcaagctggccaatgcttaggaaaaatagaaaagaacctatgtgaatatcagggcagattccccgatagctgcttagttcattgatgtatcccaagtgtctcaaatagtgcctgacagatagttcttaacaaatattagcttttaatcaccctttggcttaccctagtggtcatctcctccaaagagatttttcttagtattttctccattttctatccctaccctccggataggaatatattcccatagcacactgtgtttattgtcaggagtcaggaaatgatgccctaaaatgatggcctcagaagcagcctcagaagtgaaagtttttctctgaccttctcctgccctcctgtctatcagtcccattctcccctaggctagccatagacactggaatccctctttcccaaggtgggccatagaagccaaaaccccttttccccaaagccagccataaaacttaaatataccaccctaactttccttgagcctttctctgtaaaaaaaaaatagctataaagaaattatctgacctatcttgtttgattgtgaatcataagacccccattctagagagggcctgacccacacacgggaggaaggaaagaatctggcacagaaaggccaagcagaatctagaaagataggccttgctgggtttcccgcagtcagtctattggcattcaatcataccctttttgtccaatcatatttctccatgactgtccatactttgttgaacctaagcataaaaatggacaatttgccctgtatctttggctcttcattaggaaggctctgcttacacgttaaattgatctgtatgcctttcctccttaatctgcctcttgtcagtgatttttggcaaaccttcagaaggtgaaggggaagctttcccttggtccccacgttacctttattatagtcatcaagataatatattaggattatttgtttgtgtgtttgtcctcccacattggtatattaaatatttttaaacagaatcatgtactttttatgtctatgcctctagggactaacaacatgcttactgaaatgagaatagacaggaaacacaagaccagagcagagatatgacttgtcatcagtttatttgaaagtctactggtatgagagtaagggagagagccaggcccaacctcagttggccttactcaattctttcattttctggggacagtactagattaattataagcagcatccccttcccccatgcccacttttcaagcttcaacttttcttgagttcctaagcaggagacctggacctccagtgaaaaccatactcactgctcctaagcagaaatcccttccttctcacctgttccaccagcccaggctataccctgggcctgtcagcaacactgcctcctctagcgcaggtctcactctgaatctcattggcaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttggtgagtcaggggagccaaagagcaaatccccactccagtggccccagatggaccactgtagggcttcctgggaggcatggggcactctcggggaggaggagagaaaaacctcaggacaggtttgattcatttttccttgatccaattctatttgggagtgagcctaggtcaacagatatccaaattaacaatcttaggacatttaacacctcttctgaagttagtgagtctaagctttgaagagaaggaaaactagagatttttcctatttccttcattttgtcctgtgatcaacctaaatcagctcagctcatcttgattatatctccgaaattaggcttcattggacttaagaaaaaagagaatgtattaatataaagaatggggcaggagttatcaggagaatttttcaactttcataatgggcaggacaaaaaaacttccactcatagctccagtctaaccagtgtatatggaataaggactcaggcattatacctggagccagacagacttgggttcaaaactggtcagttgctcactagctgtgcagccttgaaaaaagatcttcacatctctgtgcccatattaggtaagattcttttgatagcaaataacagaaactaattcaatgtacctttaccaaaaaaggagaatttagtttaagaaactagggctatttaaagcaattcaaagagtttaaaagagctaggaagggcttaaggggagaagattgaaaaccaggttcgggccagaacccctagcttcaggaatctgtggactgtgcctatggatttggattcctgccattttacacatgttatctctcaaaacttagacttttgctcctctgagtttcaattctcagggcaatttaaagagagagaaactgatagtcccaatttagttcaggtgtgtgtacctgatctaaacatttttggtgaaaggatcagattatagggcagaaacatggatatggggaggggctccaggggttggggtatgcaattcttgtagaagagcggggctaaataatccaagagtggtgttcccttgagagccttgggttcttcatcatattatgagaataattctacttacctttcaggatgttattagagtcaaagtagataaggaaagtgaaaacattttttaaaatgtcaaaacatgcaaatgaagagtgttgtatacattcaagttccaccagccagacagtccctgatccaagcagtcagattccccttctaactcttcttccatgtcatatgggctgaaaattcagaaagtcctgggaacaaaaagattcaaggtctcttacagtggtgttctggttaacaagctctacaagatttaaaaaaaaaaaaaaaagccctaaagcgtagcatttaccaactttgtaatttctgtggtttaaatactgctaccacagttgatttcaataaactaatggtttcacaaaaagcttgcaaaatttctgagtacttaaaaatccacaaactggcttgggcttcagcacatcctgcctgagggtaagatttccaggaagtgattagcagaaaaaatggtcctctggtccagcccaagcatttctgacagctcaaagcgagcatcttggagctggacaacccaagctggctcaattaattccatcagcaaagtgcccagtgctgtgctgatcaccatgggaaatgcagaaggagtgtaagatatgaggctagaacacaggaaatggtgaaaaccaggataaaaattgctcaattaaaacatataggggaagtccaggaaacttttatcacctctgtagtctgagcaatcttttagcgatctgagatcagcttcacagaggagacaaaactagagttctagagaccagattggtagagcttctagagcctctccacacatacaaccaagaggcaagctctgatctggtcaattctctgccaatttttaatcttatgggatttgagttgcattgattctgcagatgtttcaccctgaccagaatgaaaagatctcagaggattgcaggtaaaccggccttagccaaggaaggaccagatgctgggactatctctcattctctccggcagcagtacaacagtaataatggtaaaatggcctctagaatgtatgcaatacttacactcttcaaaaagcaattatccatgacaggtgacgttttatcttactaacattgcgcgatgaggtagagtcagtttacagatgacagcaagggggttaactaccttgcctaatgtcactccactagagtcaagtccaggacccaggctggtctcactccaaaactagtgtttttgtgtctacttgcctccctccctccctccctcccttctttttctttttcctctcttctcttcccttctctctctctttcttcctttctttcttcttttttttttttttttgaaggtcttctccttacccaagctggagtgcagtggtataatcatagtttattgcaccctggaactcctgggctccagcaatcctcctacctcagcctcctgagtagcagggactaaaagtgcacaccaccacacctggctacttttcttttcttttctttcttttttttttttagaaactgagtctctcaatgttgcccaggctggtctcttaactcctggctgcaagcaatcctcctgcctcagcctcccaaattgctgagattacaggtgtgagccgctgcacccggctgtgttttatcctttctatctcataactacttcattcatcctttcatgagatacttatagaatacctgccatgtggcagggattgtgctagacatggagataccaaagttagcagaccaatctgtttatcacaattgatgcggctggaagttacatgaagttcttctctgtagctctgccagagtctagaaggctggcacctgcactggatggttgtgcaaaggactttgccacgcgcagacaggtacctcttaccttaggactcttgctgaagctgaatccgataattggaaagacagaccagccaaggtgcccgccatgaaccgttgctagagaagggtccctgagcatctcaggcagttgatatactaagtctgaccccagcaagtctctgggctgttcgttcaggctcacacacgatcataaccccattttgttcccagagcatatgatggactgtggcgccccctccaggacgcagcttagcttcactgcctagaagccgctcttgcagtgagtctgtgaggcctcaggaggtcaaggctgctcactggctccctctgtagaacttcttcttcatgactctgcctcctggggcattcaggccccttccctggatccctttgttctttgttggctaaaccttcacagcatgaatgcctcactgtctcatcttataacatcctcctcactttcagaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctgggtaagaaggatccctgggagctgaggggggcacagggtaactggagttgttttgaacaaagaaaggctgggggtcctactcagcctccttgcacagtgtggtggtgaatccctaaggtgtctgggagagctgggagacgtgggttctgccaccagctctaccaccacctcccagccagcttacctcaacttcgtggggctcagtgttctcacctgcaaaggacgtttgggagagatctctgatactcctcttccctctcccgctctaacaaagcatagtcctaacatctgaggccagggtcatcatagagtagactgaaacatcagggtgagcagggagaaggaagggcaagtgggcgagcagctgtctagaggggcttcattagacagccgaagtcagccaaggaaagagggaccgaggtcattagaccgccaaagtcagccagggaaagagggactgaggagacgggcctgagagaggccgtcgaggaggcgtgagagcctgagcctcaggcgaagcttctcctccccagcctgatgttcctagatgaacttaggaagccagattcccctgtctcctgggaggatccactcatgagtgtcacacctggctctagatcaggcctacactggtgctagcatgggacagctaaggccatgggttttagagtcagtcatacctggggtcacttctaggactgtcacttactagctaaacaagttacttagcttccccaagtcatgttcttcctaaataaaggacaaaataacagttcctatctcgtgctaaggattcaatgagacaagacacgtaactgcctatcacagtggctgacaagtccttagtaagcgggagctaaatgagacgcagtctcttagagttttggggacccttaataaacttggatcaatatctccagcactctgggaaataccagagtcagataccctccacaatcctgaagtcagatccctgagccctagcgtacacattcttctagaataactcagacctgaggtgctcacattcacctgtgacccctgtcatgcccagtcatcagggattctggcctctgagaacgttgctgttttgtggtcttcctgggctctgtctaccctccttaactgcactgatttctttatctctactcccacatgtggactacggagactgtgtatgctcttccttattcttcctaactaattggccctgtctctaccagcctctcctgatatgccttgctcttctgccaccacagacccactgtgacagtgtggtatctgaccatgagaacacaatttggctggtggttccaacaccaccctcatatcaatatcacatcctgagatccagaaaaaggaagacgcacattccctgtcctctataaaatgggtgtgactgttcatccgaagagaggataaaagcaataataaatccattttttttggaagggtaaacccatctgtcactttttagtcaccgaaattatcctagaaagccccctcaaactcctttccctactgtatcactcattccttttttttattttctccagctcagcccttccccaccccagcatctaagctttccttccatcctttttcttttcctttccttttctgtcttcctttctcttcccttcttcttcctagttggtgcagatacttagtggggtagagaaacaaggaaaggaagtggtccttttctctctaaagtcagctgtgcattgtatcatgtggtcatctgtctgtacctgaagatctaccctacctcgttgatgtccagagtaggggagcaatgctttcccaggccacagatatgtcgaggtaacctttgagcacagggcccaggtaagccagtgatatttaaggaatttctgcattttttatactttatgtttggggagattgaggaaaagaatgtcccagccaaataggatgggattcagggaagaaattaatttccctgctctgtgagctcccacaccagtgtccagtacacttgccccttctcaatacattagtcaagataaagatacctaagcatatagggttttcttgctctttcagcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaattcctgaagttgtcccaaatctgtcagacagtgcctgctccatcagctgggagaaactggaatctggagacacagaggggagagcctggagccaccggctcctgtgtgtcaacacagctgaggagccaatttgtgctacctctgacccttattccaacatccatgctaagcttcctggggctccagctcccctgccaagcctttgcctccttcccagtggcttgccttgctctgacccctctgaggaccactctccttaagtctgctgcaaacataggttcaggcttgctctcgcagaaggaaggatgcagctctatctcataagaagccttcctgccccacaagcctcgcatagggagctgaattctctctcctcttttccattgactgtgtgggcaagtcttcaactcctagtcgtttcactggatccaaaaaaaccatcagatcgacacagtgttctcaccagagttgtccactatatgcaggtaggcgcccccaggcccaccactgacataacacctgggatttttgcttaatgtcccctcctctaagtctcctcatgtgcctggagctgaaagggtcactacagaatgcacttccccttcagaaaactgcccaccacagactgcttgcctttcaaaccagaccagcctcccccatctccctcgtggcccttccctcctcaccccatctcctcggtgacagatacagtgctatgtgtttgccaaaccttctcattttcccctggatgagtgaaaaaactctttttcccagctacttttgtgtttagctggagccatgtgatgaaatctgtccaatagaaagtgggcggcatggatgtggcaggagtgaaggacttcggaagtctggctatatgatgcaaggaactgcatcggagccattgtttggaaggcagctgcctgccctacattgcacaagcatgataagaaaggtagggttttgtcttttccacaagacagcctgggcttccgaagaaaccccccaccctgagcccagcctgtagtcccatccaaaatcacctctgagcagcctgcatccccatccaaactcacttctgagcagtctgcatcccatccgaactcacccctgagcagcctgcatccctatccaaactcacctctgagcagcctgcatccccatctgaactcacctctgagcagcctgcatccccatctgaactcacccctaagcagcctgcatccccatccgaactcacctctgagcagcctgcatccccatctgaactcacccctaagcagcctgcatccccatccaaactcacccccgagcagcctgcatcccatccaaactcacctctgagcagcctgcatccccatctgaactcatctctgagcagcctgcagttccatccaaactcacctctgagtatcctgcatcctacaggtggaccatttccatcccctttctgtaagcagcacccttttccttcccctcacttttctcagtggaagaagagggttttggggggaatttcacgcacacacacacacacacacacatatacacacacgcgcgagcgcgaatgggataaacaagcagtaagaaggaaacaaatgccactttctgtcacaaataagcacattcctcagctgctgaggaaccagcgtgcctctgcggacattgtatttgtattatttccagttactggaaacctgaggtaaatctcaccttagacggctcaggtcacagacaccaacggttccctgctcctcccatccctcaaggcagtgccagatacataatttgtggggctcagtgcaaaatgaaaatgttggctccccttgctcaaaaagcaaggaaaatgtgccaataaaagta

SEQ ID NO: 13198 - DNA, 37492 bp, Human
tgcggaagaaaacatagaagcagcagtgccagaaaacaagctgacattagacagtctgacagaaggcttctgactattcgggaccgcttttgacttcttttatgatatgggcccatctatggtatgatacaggcactaaaactaaaacaaatggtagaagtaagaaggggtaccatatagaaatatttttagagaaatgaacaagcaaaaaagtcagacaaaaattaaatatacttctgaaaagttacaccgactgtgcctgtctcttccaccttcccttcaacctcctctatctcttcttccccagggacccctgagacagcaagaccaactcctccttatcctcctcctccttagcctacttaacatgaagatgatgaggataaagacctttatgatgatctaattccacttaatgaacagtaaatatattttgtcttcatcatgattttcttaataccattttattttctctagcttactttcctgcaagaatatggtaaacaatgtatatgacacatagaatatgtgttaatcaactgtgttgttggtaaggcttcctgtcaacagtaggctattagtagttgagtttaggggtgtcaaaagttatgcatggattttcgactggttgaggggacagcactccaaacccctgcattgttcaagggtcaactatattcagtattatgtaagtatatatgggaaatgatcagcaggattatttaatgtgtgactctagaggccaggttacctaggaatgagctagctagcatgaggactcgtctcagttaaaaaaaagctcctccaggtctcaggggtagtgtccccagccttctcattactccccaaaacagctgagtcaaacttaaatattcatttctatccccattcccagacaacatctcccatacacacattacacaatcactcttattcttgttaaccaagatgaagaccctctacaagaaatagtcctgttacatctagctcaactccacctaagcctgcctctgcacctgctgtctctcatgcccaggagtcacagtctttgccaagtgacactgctggcttttaactcagttccctaattcactgtgtgatatagggaaaagtcacttcctctccttctgagccagtttctccatctgcaaaatagattcaatagtctaaaaatcccttttgacttcatttttatcaaacactttttgtgtccctaataaggtgtgatcataatcataatgtttcatgatgatatcatggaattatacataattatatgtatgtagttatactatattatatattaatatattatataattatatattattgtatcatatataaatataattatatattattaatataatacttaatattgattatgttaaataatatcacatgttgattatacattataatacataatcatgtacttgtgatcattttatataactataattatgtaattttaattgctatgtttttttaagctcctaccatatgtcaaaacatttttcctctttcatatcccccatcgccattcacctaataatggtaattcattctttgagcctgtctcaggttggttgtcagtttctttaggaagcctactccaacttttcttagcctgagttagatgcccctattcctctcatagttccctgtatttttcctattgcaatgcttattacattaaattggaactgcttatagagttgttgattactccaaaaaagagtataaatgccatgaaaggagggtgatcaattgttttgttgctctgtatattgccagcacccagaagagggcctggcacatagtaggcacacaataaatatgtgttgaataaataattaatgctaggcactttaaattggaaaaaactagcacagtaatacaaagaccaatgttaactaaatcagttaacatgcacttcctttcttaaatgtcgttataaaaaggaggaagaaaactcaagtgaaactgactctgctagaacagtgccgtgcttttccacagaaggttagaccctgaaagagatggctcagcaccacctatggatcttgctcctttgcctgcaaacctgtgagttctgacccttgctgatcgcctcctagttttccataaagttttaaaaattgcccttaaggaagacattgaactgtctttttgatctgtgtttagcagaacaccctgggtctcagtatctactgtactcaacaggatccaactggctggggagagacttaaaattcaaacctaagtgtttaggttcagctttaaagtttatattactgagttatatttctgagatctggagatctcagtttccaaaggtctgaggcaaatccttctcagaggaatcagcacttggtaaacccacccaaaaagcctggcaaaagaaagatcttctaaaagcttgaatgacttacaagcaatttcttcttggcattcaattgtgatggcgtttgagagagaaaaatgtctttcctaattatagttgattgttctatcaggttagagtgatggatgactcatcgttatcattgttgagcctcatctctataaactccctttattttcaaaacacagagctattactctgcttttatcctcaacaaactctaaaataaatgaggaagagattactatcccattttttacaaatagtctcaaaaaagagttggagaacttgaattaaaaaccctatttttcttacttatggcataacagtaaactaaaagaacgacatgaatattgattgttatttgtacaaagaaaattgtaacattaacatagatctgggagtgctgtgtcattgtacatgttatctccttaaatacaaacaattgctctaacagaaatttactatgtttggaacttctagatctacttctagtatctcttgccagttctgaaaatgcactagcagaattctggcatgagttagaaccctgggaacctagtacgtttggattttctgtaaaggtagaatcaatgcaccgtgatctctctggttcctttggccatttcaagctatggctcctttaatttgaacttcatggagattgtaaccactagtcagaccaaatttttggagcctctgctggtcgctctagaatggcagacagaaaatgcaagtagatgaggaatggtactagggatgtccctaatcttccagagagagaccagacaaggtagcatttgataccacttaatttgcaaaacattctacaatgtttatgcctacattcttatgtcatccatatgaaaaccattgagatgagcaagatagacgttattaatcccattatgcaagaaaaataataaattaagatttaggggtttaaaaattcacctgaaatttcactacctaaattggtagagctggaaatagacattggtttttctaattccaaggttaatcccaatcccattggttcttctttctgctccacctgacctcttcactcattgctttcaaatttttgatgctcttcaaaaggttaatacctgctaagataaaaggtagctctaggatacacttctttcatctactgaaactgaaataaagttgtcaaatcagctagtagtgaattgtttacaagttttgtgacctagacgaagttacattcctcctctgactcttgtttcagcttcaaaatggggaggtattaatacagtagaattgttttgagaatcaaaatgatgataatgcatgtacaacacttgccatggtacctgaatatagtaagtgtttaacagatatcagctaatgctactatttttcacactcgcttttcattcattattaggaagagccatggctttaccacacagagatcctgggcaggactcctctgtcagggaattgtccaaggaacataaacaggagaaaaggtggtgggagtttgagcttaggtgttggttgtctgggttctggaaaaggaaactaggagtgagatattcatttcatcaaggatccatgaaaggggaatgggagcttgtttttataaaagtgaagccaggagtactttttacatactgtccacctttactgaattatctgtttgcctcttaaggattattctgcaaaccttttctgagcacaaaaatataccatgaattcctcctgctgctgttcctggtagaggtagtcccttacattcagtattgggcttaggagtctacactttacacatttccctggaattcagagcagttgaagaggctgagaagcagtggagagatgcagggagaaatccccatttcccctcagaaatcaccgacataaggaaagtctgagtgtgcaaacttatgactgttccatgttggaaaagttttctctgagtcaaaattcacagtcttatgctctgatgccaactttctgatcatgactttggaaacaccatgactctgactgtctctccacataccctgggagacactcccactctgagggtaggagatgaaggagtccaccagttttaatccttgcccaccccctctacatatactgtctcatactcttaattcttccttttctctgccccattcgtatttctatttcttcaactccctgtcttatctcccatcaataatagtaataagtaaccatttatggagcaatcactgcatattcagcattactctaagtagtctacagttattattttgtttaatccttacaatacactatgagatagatacggtttatgtgcacatatacagatgaaagcattgatacacagagagtcaaaggccacttaaccaaaaagtgaaagaagtagaatttaagcttcagagtccttagacttcacctctgagtcatgctgcctccacccacattgatgctgaagtggagtaaattactctccctactattaatgtttgggaatatgtcagtaaagagtgatgatttatttatttctgtcaagacaggattattcggatagaatctgtgcctttctctatacccacccacagaggaggaaggagctgttggcaggtccttgccaataacggaagtttaggcagggcagtgaggcagaatacccaagcaaacaaccatctccagacatatttcaaataccgttcactttaatattattcaaatgtgatttgaattagtttctttaaacaaataaaagtccaatatcagcatgatgttgatgtcttgttggatgttaaacatggtcatgggcatttcagcagttgagacctaaaattctaagaaatgagtgggctcactatgggtaactggaccccaaccatcatcctggggctcagagacaggaagcatacctgtggaagtatgctgacaaaacaacctgccactgatctgaagtccttgcattgaggggtcttcaagataaggacaaggcctctgtattagaatgagatttaagcagatgactaccacagacattcagaaaagggctcaaaagcagaaatccagttatagaaatggaaatatattacatatgggtaaaactgcttatcaaaaacccagcttccaaacagagggtggaaagctgttccccctgtgataactcaggccttcagtggaaggcagtggaggcctaccttgtcagctccaagtgcttgaagcagtcctggagatcaatatggaggccaacaaggcagccagagcaccttcgcaacaggagcctgatggtcagtgccaagccattcaggctactggagtattcctaaatcaaacctttcttgtcttggaccttaggaaagggatggacctgtaagtttggagatcactgggctcatctatgtgaaacttggaaagaggtatgagcaatcagctgggggctgatataggtggaactgactaggtactcttgtttcctttgttatactcagtgttcaagtacacgctaatagagggcagcaatgttaaaacggatggctatgatctcatgtctgttttgagattttgtgtgtgtgtgtgtgtgtgtgtgtgtgtgttttgaaggaactgattcaagtaaacctaaatcccaataaaggtgatataaagtaaaactcccaggggaaaacaatgtactattgcatgggggtagtaggttcctttttcttaaaacctcatgatcaaggactttccgtcgctttggagaatgacacaaaatttctgcctgcccagccctgtgcttcctcttcccctctatgtcccttcactcagtgtgagcagttataatggactctcttttgggcaccacatgctaaagctacctctggtcactctcccagacctacaatactcagcgatgttccacccccactttttgactctaggaggcagtgggtggagaagaggagaggaagtttagctagtgccacaaaaaaagaacaagaaatgtttgtctggaggatcctaagaaagtaagggggtggaggtgtctgttaagcaactgtgcagtcttccccatttccactcttattaatagctacttgctgactttaacatctccccaataccccaactctaatttttcccttcgtagttgtctgaggtgttattttagtctctttgaagatgtttatttgttttacatagcaaacatatatagtgcctagtatatgccaggcactattctaagaggtctacaaatatcaattcatttaaccctcataatatttttatgaggtcaaatattgtgctactattaccttcaccaatgtgctaatattaccttcattttaaagctgaggaaactgaggcacagagaggttactgactttccctggggttcatggccagtccctgacagagccaggattctagcccaggcaggctaggtctcagtgactaacccatggtgacatacaggtgattccacaaggcaaggctctccttaggaccactagactctcctccattagtacacacacttgagagcaccctcatgtcatttaatcctaataattcctcaaagtggcaggacagctctgttttatttcttttaccaactagaaccctctgacttagcaagtaagtgacattcatggtcatttagctagtcaacaacagaccctagactcaaacatgtttcctaatccctgattcaggacacttttactaactatgctgtgggtccccattttgtggatctaaaaaattttcttcacaaacagtatagaatatagaaagaaattgcagttagccatctgattcttgttaataatcagtttaaatacttgacctttcacatcaagacccagagatcagtaaagagtcctctcttgccttcactctttctcttgctgagattttctgccttgtttttctattgttggaaaagattaattgagtcagttgcaaaaaaaaaaaaagctttgtttttttttgtttgtttttgttttttgttttgagacagagtcttgccctgtcacccaggctggagggcagtagcacaatcgtggttcatggcagccttgacttcccaggctcaagtgatcctcctgtctcagcctcccaagtagctgagactacaggcatgcattaccatgcctgactaatttttttttattttctttttcatagagatgggatctcattgtgtttcccaggctggtgttcattttttcaacaaacatttaataatcatccactagttcttggaggaacagtagtgattgaaacagacaaagactcacattcttgataattgcattatagtagcagtgtattgaggggatgggttgggagacaatcaataaataagcacaggcaatgctttagtggtgataactgcagtgaagagaaggatagtaaggcaaggcaagagagaaggatggggtggggattgctgttttaggcacagtgaccaggaaagctctttctaatgagatgatgttgggagaaaaccctgaacaaagtgggggactgctgaaaagagtgtggtaggaaaagaggagaacaacaggtgcaaaagctctaaggcaaagtgcccttggcctgtttacagaacagagggagctgatgtggttggagtagggaagtaggggaagatcaggcagagcctagtagtgatggttaagattatgaaaggagaatagagagctccccagactccaagggtacactgtgttcatttttaatagaaactaaggagaattatggggttttaggtctatataacctctccattgtcatccatatttgactttggattccacccaaaacatcagtaagtgttgcttgcccagccttgaagaattttcctctcatgagttaaaagcctcatacctcaacaatctttatacaatctatatatatgggtttctgattcttttctatttgttttttgttttttcaaatattcttctttttctcacgatccctattgtcttcttctagtcagtggctttgagctgcctaaccatgaaatgtacatttgtaaaatccatccatatccctaggatcatccagggaaacagggttatcatcttagacacagaaaggtgtattgcattgggaagggtgccccagcccaatccaggaggggaaggcaacctccagtgagcaaccagtcctcagtgatctctttcaacactggtcatcctgctccctgagtcctgggctccctctttgccatagctacctaagagtcacagtgaacaggtttttccatctaagcctgcaccccagggtttcagccttttcttgcctttgcttctcctctagaggtatggcctttctcctacctttcccatttgtgttctggcataagaaggtcacgaaatcacactctttggaaaaggttgtaaatgtgggttaccacttcttcactgggctctcaagggtagttagcaaacacttgatccccttcatcaatctcttgttgactccctatggtgttccttatagtaacattcccccccccaatttttacattcaccaaaataatagcaactaccatttatatgtgccaggcattgtgctaagtgctttatcttcgcaattgcatttaataattatccacactttacagatgaggcacctgaggaacagtgaatttcaataattttctcaagataacacagctacgttcaaatattcctagattcaaaatctgcacctttagtctgtatacctcctagctggtcccactcttgcctcctcactgttgccagttagtctcccctcctacattactgaagagatgaaggccaccaagaatgactatcttccattttatcctatctattccaaaatgtccactgtgtattaagcaccttctatgtgtcctcaaaacaattctataaggcaggcattattatagcccatcttgtagtcaagtaagatcagggcctcagcaaatgtcagggattgaacatgagcacaagcccacctggctcaaatctatgctcactctacttcaccaagcagcctcttcctatcaccgtctttaataacatctcaaaatacctttgctctttcacttatcctttcctttcccctttccacttcaggtgagggtgtgaccctccttaaatctacagcttccactgcctgccctttcctttccatcttttgttccatgacaagcattagtagcctgtgtatcttgtgctgttctgcataccagaggtttaaggcaaggcccctggactcagtcattcacagtgtccagaacacagacacgcagattgatgaccaccacacaatgtggcaagtgctatgagagggaaacctggagttccagagaggccatgagcaggagcatctaacctagagcaggcccactggggacatctctctctgcttaccctccctagctcctcccccccaacccccagtctcttctattttaaaacaaaaataaattagtttcacctgaccttctagctactgtcctatctcatcacccttctttcactgtcaagtttttcctccatgctttaccacctactctgtcagtcccctagactctggccttccatcgagttgtcttacttgtactacattctcaaaggccatcaataacctcgtaacgggcaaacccagggccattttcagtctttatcccgttgaacgctgaatcattagacatcagtggcaatctcctccttgagactctttctcctctctgtgatatggcccactattggtgcctctcttgcactcttactgcttggtctcttctgtttcttttgatggtgtctcttctataaatgtgagcactctcgcagggctcagtcgtggacttcaggcttactcttcctgaatgaccctcctctccttcacccacgccatttctgtggatgatctctaaacccgctggatttcagtgttacagtaagtaccagagacactaaaataagaatggcttaaacaagaaagaggtttatttcttgctcatgtaaaaaagtgcggagttggcagttcacagtcagtagaatagttcacaaggtcattggggttccaacttctatcttcctgctccaccatcctcagaacttggcttcctcctcatgactcagaatgtctgtctaagatccagctgtcatgaccttctggcctgcaaaagcaaggaagagatgaaaacagcaaatttccctctttttatgtatttatttatttattggttttcttctgagacagggtctcactctgtcacccaggctggagtgcagtggtgtggtcttggcttactgcaaccttgacccccttgggctcaggtgatcctctcatctcagcctcctgggcagctgggactacaggtgtgcaccatcatgcccaggtatattttgtacttttttgtagagacagggttttgccatgttacccaggctggtctcgcactcctggactcaagcgatccacctgccttggcctcccaaagtgttgggattacagatgtgagccaccatgccaggttcccactcttcttaaagacacagaagtcatatacaacacttccatttttattctgttgggctgaacttagtcatatgaccaacgttagctagaagaaagcaggacaatatagtctttactctgggtggctctatgccctgctaaaaattagtgattctattaataagaatgaaggagggaacaaatattggaaaacagctagcagattctgccacagtgccccaaataatacttcaagtccattctctctccttatcttccatcattccaagagcttacttacatggtccaccatcatctgaagtttaatatttctaacactaaactttcttccccctttgacttctttccatcataaactttatgagtttttcaatgacataaagtagaaactcaaaatatattgatgaacaattgaattctagcagatgcctctttatttcttgcctttctttgtgttatcatcaaatccagcccttcctttccattcccattatcgtcccctggttcatgcccagaagactacagtatccctaaatggcctctctgatgcagcctctccttcctgttttcctccccacacatcattactacattacaatgactaaaacattattttaatcttcactcgcaaaaaccttaatagttcccctctgcctctgatggagacctcaaactcaaggctgtctcaaatctaaacctaatttgtatctccagctgtacctctccccactctgatatgcaaatctatattcatccaattaacatcacaggttctgcttctaaacttttgttcaggatccgaggacttgagacacccctcctttccctttccatcaagtagaattctattcagccttcaaaatcctcctcaaattctactttctttgagatgttttttctaaccactacagctcagcaatccctcccttcttagaattcctaccgtaatcactgtttctaccattcacttgaatttattattcactatctcatattgcaaaggagaattgtgtgtgtgcgtgcgtgcgtgcgtgcgtgtgtgtgtgtgtgtgtgtgtgtatcttatttccctaaccgggtatcaaattccccccgaaaggcagagaatctgtctttgccatagactagcatagtgcatttcatggtaagtcctcaagatgtttttgtgccacaagttatctctgaaattagattttactaaggtcacttccagtgataacataatgttagagtccctttagcacccagaaaaataaatattgggattgattgatatggacactctttcttttaaatcttaaaatcttttaagagcagaataaagtctatccagggtacctgaaactgtccctccaggctttacttgaattagcccttaaaaatggcttttgatatatgctccagtatggccccggcatcaccaacgccatcataagggtggcctagggcaggcccaaagggcatgtaccaattgttgaagtgatgataaagaacatacgatgaatgttaatatatcagtatcaactccagaaataactaacatttattttaccttgatgatcagcaaagcatttctactcatattacatcatttgctgctcaccaaacaggacaaatagcataattattattttcattctatggatgaagaaactgaggttcagaaaggttttgtgacctgtaatcccagcattttgggaggctgaggcgggcagagcatttgaggtcaggagttcaagatcagcctggccaacatggtgaaaccccgtctctactaaaaatacaaaaactagctagccgtgatggcatgcacctgtaatcccagctacttgggtggctgaggcaggagaactgcctgaacccgggaggtggaggttgcagtgagccaagatcactccactgcactccagcgtgggtgacagtgagagagtgagactttgtctaaaaataaataaataaataagaaaggttttgtgacctcgttaaggttgtccagttcataagtagaagtacttgcacctacaccttctgcctccctatctttccactgcatgcaatggttttgcagctgcttctctcagagcacagttggagtgtttgaaggtggcagaatcttcatcttaaacatgtgcaacccctttgccttttccagcaagcaaagtattcttgccaacaacaccagcagcacaaataacagcttcccccagctttgcctacccaccacccccactgcctgattgctctttgataccccaccaacacttcctgaatgacttgctacaggagatgagacatacttttaaaactgcaccacacaccaaccactgtggctgctcaacggccctaatattaagaaggtctcagccttaacaatctacctacatacttcctggggtttagtgagagaacccagcaaaattacgagtctgtggaatctatgttctgtctctctcctcacacctaatctcaatccacagagtggtgtggcaattaagcactagggcctgacttcaaaaaagacttgagacgtgggagatctgagaccaggactggctagataatttgcgaggcccagtgcaaaacgaaaatggagggccccttgtttaaatagtatgtagaatttaaaggtggcaacgcagccttaagtccagttcagggtccttttgaattcagggttctgtgcaactgcatagatcacatgcccatgcctggaccatccagggattcacgctgggacactccaaatacccctctcctagaacccgtcagcccagaaaaacagtttatctgggaagaattaatgttcttaaattttggcaaactatgactcttaccaccaaaggcagcattagcctctttctgacccgctaccccaatggcttatttctattgcttttaccatttagcactcatcgtgttgtattgtctttcacttgtgaccacatctgtcttattttctaggctgtgagctcctcagggctgcaacgatgtcctgtttatccctgtgtccctaacacagcatctgacacataattagcagttaataaatgtttgcagataagggttcccaatttcccccttcctactcccactccacatactccccaccctgttgtatcttctgtacttagccaacccccaactaaatcctcaggccttgtcccggatactgctcctacgggaaaatctctgttggtcagaaaggaaagagctttacatcagctgttcctggggctctttcagtggttgctgagctgaagagcaagggtagccatagtgagacaacaccatcaggttaagaaatcgctttttttgtgccactttcaagggacgtgtatactttatgatccttattcttccgtataccaagccttggataaactttagggtcaacctgaacccacttatgtggaaaactgatgtctggtcatcagagcctacatgcaaccagtacacaccagaaccgctcaactagtttgtttatggctaacaccctttctgattggtcaaggcccacgtcatattggttattaaatactttggatatcatctatgcttgccccaaacagtgtttctcactaaagagccctcattgagaattataggataatgaagaagaggaggagaaagagcagaaaaataatgtcttgaagttacattgtctctcattttacaaactatatattaaatcagtttatcttcaaaagtgatagaggagagaaaagggaggagaaaataagcttttcatcttcccatgttacattttaaaagtattcatccttaagttttcactaggaaatgttccctcgattcccagaacagatcaagtccccttgctggtctctctcaaatcaccataatgcttacatattttgtgcctatccatttgtttctatggttatctgatcaacattggtatcttcctctgattgtaagtctcaaagagcaagaattatatctgtttcttctcgccgttgtatcctcagctcctcgtatcttgtttaaaagagtagatgtccaacaaacacttacattataaattaaattaacaaatacccaccatagtatctggagcaaaactgatcctgaataaatacatgcaaccattcacaaatgtatgaatgaataaacgaaacttgcttacttcagaagttgttccaagagagtctaggaaactcatgagtaaattctatcaattaattccacaaatatttattaagccccttctctgtgttaggcactcttctagagactaggaatatggaagtaaacagaaaaatatccctaaaaatcaccaacttagggaatattttctccagagactccaaagcactctctgcttctatcttccaagaaaagagacaaaagtgttacttgctttttacagagatcacaggaaaataaaaagcaatgacccaagagtccatcagccaagatattccaggttcttgttctagctcttccaccacttggcaatatgatcttgggaaagaagtgcacctaatatcttagactacgtggaggcttatggccttcacctctcaaatgccttctagctttcagagtctgtaagtctaggtaaaaatatttttaacaaaatggatctctagtgagaaacttagtttttgaatgagaatgcgttagaaaatttagttgtcataacatattaaatacacctagagtagaatgccaaaaaaaaaaaaaggcatcctcaagaaactgggtgaactgcatttgtggcagctcctcagggagctccaaggccaaaaagattaggaagtgaaaaagctgcaacagtcagatggctacagttttctttttatgttctcagggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtaagtcatgggaagacggagagcttgtgttttatttttactttgcaagtttgctatctgaaacacatctacatttctgataattgggtcccctaaatctttttatatctataaatacttacatattgatacatcaatacttataagaggatgtagtcttatttcagtcctgactttgcctgtttttagctatgtaattcttccatcagtagttggtcccctgggccttggttttcttttttacataatgtcaatgatcatactactcacttcccagggttatcatgaggatcaaatgagatagtgtatgcaaagtgctttaaaaaaacttttcattttgagatcatgatagatgcaaagaaggtacaaataaatatacagggaggttctatgtacccttcaccctgtgttaacaccttgcataactatagcacaatatcaaaaacaggaaattgacattagcacaatctatagagcttatttaggtttcaccacgtatgcatgcattcatttatgtgtgagtatgtgtgtagctctgtacaatttaatcacatgggtagttttgtgtaaccactaccataatcaagattaaccatcacaagattccctcatactctccctttatagccacatctccatctttcccttccccagtccctgaaaaacaaccagtttgttcacatctacaactatgtcatttcacacatgttatgtagatggaataatgaaggacgtatctttttgaggttgggtatttttcacttagcgtaatgtcactgagattcatccaaactcttgtgtgtactaatagtttatacctttttattgctagatagtattccacggtatggatgcactaggttgtttaaccattcacctcttgaggaacattttagttctttccagtttggggctattacaaataaagctgctgtgaatatatgtgtacacatttctgcatgaaataagtttttatttctctgggataaatgctcaagaatgtaattttatgataagggcatttacagctttaaaagaaactgataaactattttcaactttccattctcaccaggaatgtatgagtgatccagtttctctacatcctcactagcatttggtgttattatttttcattttggccattctgatgggtgtgcagtgataactcaatttagttttaatttgaatttctagtagttaatgcaaagtgcttttgaaaggtaaaatattataactatttgttatcatcattataattgccacaattcactgggagatgtgcgtgctttgttttgcaagctaccccaagtgtggtctgtagactggcagtatcagcatcaactgggagctttttggaaatgcgaatgttcaggtcctccccctgacctttgtgaatgaatgaagtccaggaatctgtgtttaatgttatctctggattattcccacctgtgccaaagtttgagaaagtacggacctagtgctgccctattcactatggtagcctctagacacatgcagctcttgagcatctgaaatgtggtgagtccaaattgagatgtgctgtaagtgtaaaattcataccagatcttgaaatcttagcaccaaaaaaatatataaaatatctcaataattttcttttttttcttcaatgtttattttaagttcaggggtacatgtgcaggatgtcaaagtttgttacataggtaaatgtgtgccatggtggtttgctgcacagatcattccatcatctaggtattaagaccaacatccattagctaaccttcctgatcctctctctcccccaacccctctccaacaggtcccagtgtgtgttgttcccctccatgtgttctcatcattcatctcccacttataagtgagaacatgtggtgttcggttttctgttcctgcattagtttgctgagggtaatggcttccaactccatccatgtccctgaaaaggacatgatcttgttcctttttatggctgcatagtattccatggcatatatgtaccacattttctttatccaatctatcattgatgggcatttgggttgattccatatcttagctattgtgaatagtgctgcaatgaacatacatgtgcaagtatctttataatagaatgatttatattctttggggtatacacccaataatgggtttgctggaacaaatggtatttctgcctctaggtttctgaggaatggccacactgtcttccacaatggttggaattaactaatttacactcccaccaacattgtaaaagcatttctttttccctgcaatcttgccagcatctgttgtttcttgactttattaataattgccattctgacgggcaggagatggtatctcattgtggttttgatttgcatttttctaatgatcagtgatgtttagctttttttcacatgtttgttggctgcatgaatgtcttcttttgagaagtgtctgttcatggtttttgcccagtttttaatggggctgtgtgtggttttttttctgtttgttttttccttaaacgtttgtttaagttccttgtggactctggatattagacctttgtcagatggatagactggaaaaattttctcccattctgtaggttgtttgttcactctgatgatagtttcttttgctgtgcagaagctctttagtttaatcagatcccatttgtcaatttttgcttttgttgcaattgcttttgacattttcatcatgaaatctttgcccgtgcctatgtcctgaatggtattgcccagattttcttatagggtttttatactttggggctttacatttaagtctttaattcaccttgaattaatttttgtttaaggtataagggagtggtccagtttcaattttctgcatgtggctagccagttctccctgcaccatttttaaatagggaatccttttcccattgtttttgtcaggtttgtcgaaaatctgataattgctggtgtgtggtcttatttttgagttctttattctgttccattggtctatgtgtctgtttttgtaccagtgccgtgctgttttggttaccttggccttgtagtatagtttgaagttgggtagtgtgatgcctccagttttgttctttttgcttaggactgtcttggctattcaggctctttttcatccatatgaattttaaagtagttttttctaattctatgaagaatgtcaatagtagtctaatgtgaatagcttagaatctataaattactttgggcagtatggccattttcatgatattgattcttcctatccatgagcatggaatgtttttccacttatttgtgtcctctctgatttctttgagcagtggtttgtagttccccttgaagaggtccttcactttccttgttagctgtattcctaggcatattaatctttttgtagcaattgtgaatgtccttcactttccttgttagctgtattcctaggcatattaatctttttgtagcaattgtgaatgggagttcattaattatttggctctctgcttgcctgctgttggtgtataggaacattagtgatttttgcccattgattttgtatccttgaggattgctgaagttgtttaacagcttaagaaaatattggcctgagattatggggttttctagatataggatcatgtcatctgcaaacggagacagtttgacttcctctctccctattcgaataccctttatttctttctcttgcctgattgctcttgccagaactttcaatactatgttgaataggagtgatgaaagagggcattcttgtcctgtgctggttttcacagggaatgcttcctgcttttgcccattcagtatgatattggcgtgagtttgtcatatgtggctcttattattttgaggtgtgttccttcaatacctaagttatggagagtgtttaacatgaagtgatgttgaattttattgaaggcccttctgcctcagttgagatgatctgtgggttttgtcttcagtactatttatgtgatgaatcacacttactgatttggatatgttgaaccaaacttgcatcctagggatgaagccagcttggtcgtggtggataagctttatgatgtgctgctggttttggtttgccagcattttactgaggatttctgcatcaatgttcattaaggatattggcctgaagtttccttttttggttttatctctaccaggttttggtatcaggatgatgatggcctcagaatgagttaaggaagagttcctccttttcaattttttggaataattttagtagaaattatgccagctcttctttgtacttcttgtagaactcagctgtgaatctgtctggtcctggcttttgttttgttttgttttgttttgtttttggttggtaggctatttagtactgcctcaatttcagaacttgttattggtctgttcaaaaattcaacttcttcctggctcagtcttgggagtgtgtaagtgtccaggaatttatccatttcttctatattttctagtttatgtacatagagatatttatagtattctctgatggttgtttgtattgctttggggtcagtgatgatatcccctttatcattttttattgtgtttatttgattcttctctcttttcttctttactagtctagctagcagtctctctatttttctcattttttcaaaaagccaacttctggatttgttgattttttgaatggttttttgtgtctctgtctccttcagttcagccctgatctttgttatttctcatcttctgctagctttggggtttgtttgtttttggttctatagttcttttagttgtgatgttaggttgttaacttgagatctttctagctttttgatgtgggcatttagtgctgtaagtttccctcttaacaatcctttagcctgccttgcagagattctggtacattgtctctttgttctcattagtttcaaagaacttgatttctgccttaatttcattgtttacccaagagtcattcaggaacagattgttgaatttccatgtaattgtgtggttatgagtgaatttcttaattttgagctctaatttgattgtgctatgatctgagagactgtttccctgaatgatttcaggtctttcgcgtttgctgaggagtgttttacttcctattatgtgatcaattttaaagtaagtgcatacggtgttgagaagaatatatattctgtggaattcgggtggagagttctgtagaggtctacaggtatacttgatccagagctgagtttaggttctgaatatctttgtaaactttctgccttaatggtctgtctaatatggtaagtagggtgtttaactctcccattattattgtgtgagagtctaagtctttttgtagatctctaagaacttgctttatggatttgagtgctcctgtattgtgtgcatatatatttaggatagttagcactatcctaactatcctggtaaagggtagttacccattaccatcatgtaatgtccttctttgtctttttttatctttgttgctttaaagtctattttgtcagaaactaggattgtaacttctgcttttttctgtttcccatttgcttggtaaatttttccctatccctttattttgagcctatgtgtgtctttgcatgtgagatgggtctcttgaagacagcatacaaatgggtctcagcataccagtttgccattctgtgattttttaaattgggggcatttagcgcatttacacttaaggttagtgttgttatgtgtgaatttgatcgtgtcatcattatgctagctggttattttgcagacttgtttatgtagttgcttcatagtgtcactggtctgcatacttcagtgtgtttttgtagtggctggtacctgttttccctttccttatttagtgcttccttcaggagctcttgcaaggcaggcctggtggtcgcaaattccttcagcatttgcttgtttggaaaggattttatttcttcttcacttatgaagcttagtttggccagatatgaaattctgggttgaaaatggttttcttcaataatgttgactattggcccccaatctcttctggcttgtagagtttctactgagaggtacacttttagtctgatgtgcttccctttgtaggtgacctggcctttctctctggttgccttaacatttttactttcatttcgaccttggagaatctgatgattacgtgtcctggggttgattttctcatggagtatctcacttgtgttctctgcatttcctgaatctgaaggttggcctgtcttgctaggctggggaagttctcctggatgatatcttgaagtatgttttccaacttagttccattctccccatctctttcagctaccccaattggtcataggtttggtctctatacataactccatatgtcttggaggtttcattcattccttttcattcttttttcttttttcttgtctgcctgtcttatttcagaaagatagtcttcaagttctatgattctttcctccacttggtctgttctgctgttgatacttgtgatcagtatctcgtgttgtggttttcagctccatcaggtcggttttgttcctctctaaactggctattctggctatcagctcctgtattgtcttatcataattcttagcttctttgcattgagttagaacatgctcctttagctcagcaaagtttgttattacccaccttctgaagcctacttctgtcaatgcagccatctcagcctcagcccagttctttgcttttgctggagaggtattgtggtcatttggagaagaagaggcatcctggctttttgagttttcagcatttttgcattaattctttattatctttgtgggcttatctactttttatctttgaggtcactgaccttccaatggggtttttctgaggtcttttttgttgatgctgttgttttctgtttgttggtttttctttcaatagtcaggctactcttctgtggggctgttgcagtttgctgagggtccactccagaccctaattgcctcagtttttcctatacctggaggtatcacgagtgaagtctgcaaaacagcaaagatggcagcctgctcctttttctggaagctccatcccaggggtgtactgacctgttgccagcctgaatacacctgtaggaggtggctagggacctctgttgggaggtctcaacctgtcaggaggaacaggatcagggacccacaaaaagaatcagtctggttgctttttgatagagcaggtgtgctgcattggaggctcccttccttgtccagactctctggactctccaaagccagcaggctggaacagctgagttgactgaatggcagaaatggtggccgcccctccccataggagctctgccccagggagaattcaaaactctgtctgtataaccctggctagagtggctgaagcccctgcagggaggtcccacccagtgagagtaaagcagcagtctgatctggcaaagcagctgtgccgcgttgtaggggacccttcctcctccagatcatttgaactctccaaagctggtaggctggaatggctgaagctactgaaccacagagatggcagacgccccctcctcagtaattttcatattagggaaaagaaatttttgttatattgggttaaatataatgcataatttaaaagtaatattacctgcttgttttgacttttgaaatgtgattattagaaaatttaaaattacataagtgactcacattacatttcttttgggcaacactagtttctagcatagagaacaccttggccatttctcaaagatttcactgttcatctgcctcattgcagaaaaacacagaaatgtgggtaatccatgttgtgacagatgcaattcaggtatataggtcacccactaaaatgcaagttccataaaggcagggactttgtatattgtttatcactgtattcccagcaccaacatcatcaggtacatagtggatgctccagaagtatttgttgaaaaagaatgaatgaatagtattattcccaggtttcacagtgcttagcaattgtgaatgttcgattaatataagatgattgaatcagtttctataccgatggacagcatagcggaaagaacgctaatgttgggattaggcatactttgccagctgtatgatcttgggcaagttgtttaacctctctgttccaaagtttcctcacttatagaatgtagatcgtaattgatggtattaaatgagataatggtagttgagctccctagtatagtgcctgccttaaagtaaatgctcaataactagtaatcattaattttttaatccttatcccttaaaaaaaatctcattatgaaggacttcctagatgaagaaggctctgaactaggcttgaataatgtagtcaaagagccatacccaaatgtcaaccctttagaaaatatttaactcattcgagaactttagctgagaaaataaagatggtattcaattttaagatattgatttttaaccctttatatgtttaattttgcctacccaatcttcagaaagtcttctaccacgtgcaattaggacacagtacagtaatatcttagagaaagctgtactgtatatacaataaaatctgtaccttatgggtagttagctgggaaaataaagagaaggaaactaacatttattgaacatcatttatgtgtttggcattctaatatctattttaaaaatatatagactatacatatttaagcactgtatgcacaaaaagagcaaaagataatacaatgagatgtaactctctcttctcagaggcagtggctgtagccagcttcttctgtgtcttccatagataattaatgtgcataccagcatagacagacagatagatgatagataagtaaataggtaattagaataatctttatcttcaaaatctcatttaatcctcacaacaattgtatttagggaaaaatttttaccctcatgttataaataagggagctgaagctccatgaatctgtataccttctccattattccatagctagagagcagtagagcctggattctgaaccaggtctccagtggcttccacaatcttggcttgggaggatgaagatctgtcggccatgactctgactttctcttcccagcatctttgtgcaggcaacacctctgttcctgctgagaaaagtgagatgggatcctcttctttaccactgtcccctacctcaacacctacccccaacaattggtaaacaccaagcactccctaggcatttttgtaaatcaaatttctaaagaaacacacacgcacacacacaaaattttgttcactttctactaattgatatcgtatcagtcactattatagttaatccaggtctgtaccccaaacttgttttgggtttattccaagtcttcactaattctaatatggaatagatccctctaaaagattgttaggaccagaatttctggctagcttggaatcaaacatttttacagcttcttactgttcatgttgagttccttcacaaacgcaagataatggttcttatatcttgtgtctacacttctgaatttattgcctttctagttgtgcaccagttccttctgactcctctattcccttcctcacatagctacagtggaagaaacaaaccccaccacagcaactttgctgagagggcgctgaacttattaactccaaatgtggtcattttcttattcctggtaaaagaaaagaccttaacgcttccccatgccagctccagtcctagctatcacttgaattattattgttctttagtaaccctttactagccttcaacttttatagtttactttttgattgcttaagtaaaaacattttaatgaacttttaaagaaattatagctttccaccatggatagtttttaaaaaataaagaaaatatacatacaccagaaaacagaatgaaaaaaaattttaaagattattttggctgggtgcggtggctcacacctgtcatcccagcactttgggaggccgaggcgggtggatcacgaggtcaggagattgagaccatcctagctaacacggtgaaactccatctctactaaaaatacaaaaacaaaattaggcgtggtggtgggcacctgtagtcccagctactcctcgggaggctgaggcaggagaatggcttgaacccaggaggcggagcttgcagtgagccgagatcatgccactgcactccagcctgggtgacagagcaagactccgtctcaaaaaaaaaaaaaaaaagattatttcatgtagttgtgtgctgataaatatttaattagctcttaattgggtgtgtgtattcatatatatatataaaatttatgtttagtacaaattttattgacttgaaggatgtgtagcacacagtttcattaatgataataaatatataatagtctttattgtaaattctatatagaatttattttgctgagagggcactagaggataaattccaattattcttacagaatgctttcattgatttttgctaagcatttatatccctaatcagcttatagttgtaattgatgtatgagtatagttccaacacaaacatcggttgatattttcatttcagttaaataataagaaaaaagtgattcaacaaagacatatatattggagcttcatttgtttatcaatgacacgagcgacttctttgctgaattggataatggtttccaaataccagaagaatacttcctattttttgtgctattcacaatgtaatggctacagatattatacaattttaagtttcatctgcattcctccattgctatcttaagtctagagcaacaatcatcaaaacagtaaatcgagtcctagcttatagcaattgcaaatttctgtggggtaatactcctaccatggctgattttaagacatgcagaattagaaagacagatactctgttaacaaaggacagatacaatagatgtagataacctcgagagcatagacagcaggaaaatgtcaaaaaaaggattagaaagtgatgagttttgaggatttattatctttatttttaacataatttatttaattatgtttttataatttaatttttaatgatggcttgcaaatttctgagaatttaacaattggctcccacaaactagtacaagccagctccagctcactattggctcatgtgtttgcccccacaggtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcaggtaaccagctctgcccatctctcctggtgagtctcagagatcactctgaggagctgcaaggtctgaacgtgggccacattctctagggagatgtgcttcctttatctttggcctggtcactgagggcatcacctcccaagaagcctactgggaaagaggccaaagccttctgagagatgctagacatttctgggtgttctgtggcagcccctgatcaactctctgattcaatttctcatcctggcttttaatagcagaaagtttagtttccctaggagctttggcactccttcggagggcacccaattttcataatgcccctgactgtgggcaaacctgcccagcctcttgggcctatttcctgagaatcaagactcactgcatcttctatttccagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggtaaaatgtggaaactcaccttctctcctcctgggactgaagccatttatccaaggtttagctgaaaggcccattgttccagggaatctgcctttttccgatctccaccccaccacctcccagaatgatggctctgaggatggtatgacattaccctgaatggtcttcagaatccattcctgagatcaccagtagctggtgggcccagaacatgggttcgagcttagtacatacatgaacaagctgtgcttcactgtacgagtgtgttcacctttccagctcagggccctcacatgtgaaatgtttggactagaggatctccagggtcacttccaatttcattgtattttgattatgactattggagagtcattgagaaacatatactaatcctgtactccatggttgtcactatgtccctctgaatccctctggatcattctgtagttgtgccattctccattcagaaaacctgatcttagaccctcaaggaatcattataccctccgattcacccacatcccatgtccacccaagaacttccttttcccaccaatcacaataaaaaacatggaacttctgcttccatgttcctgactctcctttgggtctgattcctcaggttcctgcttgaacaccttcactaagaacccttgtaagttctcagccacaaagttccttgaataacaattgggagggatggggagttcccaacagagtggttaagactaagcacgtgatttgcagtcagtctaggcgtgaaagtcccagcttgaccatttatcagctaccagtttttttatcattgtaagcttccattttctcagttgtaaaatattcacagtaataaggtgtgctgtatatacttattaagtagattaaatggaattagaaatacaaaatacttggcccaattcccagtacatagtaagtacttgataaatgttagctagtatactgataactgattggcctggggcatggtacggaggaggcattctaggggggaggggatttgtgacgtgtgccatactcaaatggcctcacaatggggagaaggcatagcctgcttgaaccacaggtgatctgcaaggtccctcaaagagatattgtcttcaatccctcgctgactcttgggaagagaaagggctattctttgcatctataaatgagacaagagagagcactcagtttgtctcatactcaccaaataagtgataggactaaactctgaatgttggagccctgtaatactgctcagctcagacctgttatttgtaggtatgttggtgccctggattatgaaggcccaaaattctggccttcttttttcaccttgaccctaaaatgttctgtgttagtaccaaagcaaaggagtacactgacgtgaatgtctcttctagcctatacattcttaaaaggaaagacttgtctactgtcttttcttctctggggcctcacacagagcctggcacatagaaggtgcttaataaatgtttattaactgtgtgaactggcagggtgctgtggctcatgcctgtaatcccagcgctttgggagatcaaggcatgtggatcagctgagctcaggagttcaagaccaacctgggcaacatggtgaaaccctgtctctaccaaaaatacaaaaaatttgctgggtgtggtggcacatacctgtggtcccagctactcagaaggctgaggtgggaggatcacttgagtccagaagatagaggttgcagtgagccatgagttggtgcaccactgcactccaacgtgggtgacagagtgagaacttgtctcaaaaacaaacaaaaacagactgtgaatcaatcaaacaagcaataaatgttcatgaaacatctactatgggcttaacattgagatggttacagcaaggtctgcaccaaaagaatgtaaaatagtatataactagaaagaatcaatcaagttaaaaaactaagaccgtgacatggaaagtcaactagccatgcaagacagtcagtggtaagtgtcagaaacatgaagggagatcctgggtagaagagctacatttgactggccacacagggaggggttggggaaattgtctttggcctaatctggactctagagtagaagagaattcccattgacctgtgggtgaggcctcagccaagtgactcctgagacattctgaggatccaagcatccatttcaaaggatggcagccatttaatccctgggggcttcctttcttcatcttaaaaagagaacattggaatagatcattgctaaaaaaaccacctttcacagactgtgggtctatatttatttgtgagacagatgctgcctcaaagaaaaccatatacacatatatcatggcttcaaggaacacccagccagcagagtccagaatctatgatgaaatcctgcagtccaaggtgagctgatgcaattcatggacacccctgtgccaccatctccatgacagggagtcatgggcagccattgcctctgcttgttgttgtctagaaagcagccacggccaagagtccagaggttccaaccaggaaataccatgtcagggaagtgatgccacggatctttctatgaggacaggaacgtgacccattgtcaccccatggcagcctccatgggctgaggcactgagtgtcccacagtgggcccggctccaggttagatgagccatgactaggagcaaggcgccccctagaggggccacacaacagaggagctactggagtgaggtgagggctgctatgtgactaccaacgtggtgaacaggttgctaagggggctacgaggcaacagaactgacagacaagttcccttgaatgcccctcctggtctagcagcagcggcttgctttcctcagactcagagtcactgttccacacccctcctcccatccgccctttacctgcctgcccctccctcccctccaccctggatcgccctctcctgtgtccccaccagcctgcctccttaaagtctgcaaggaatcaagggggagactgaggtctgcctggtcagtctagcgctgtgcttggactgatagggcagctggatccatagagcccatggaaagctaaaatcctgactgagcaggactcatcctgaaccatgggatccctcctcttggcccctgaggtttttcacccccgagaccctgcccaactgctacccattcacccccaccttatcccttcctgatcctaagcctctccagagttggatggaggcagaactgaggccaaaggggaggccacccagtaaatgtgggaccagggaaggatggtgggtagaggcagaattaggaaaggggacttgtagatgggcctgggctccctcactgaggggaagatgtgtgttttacaggtgcttccctccaaggaagagccagtgaacacagtttattccgaagtgcagtttgctgataaggtaacccctttctggctttttatccttgctttcctaactcttccagccattctggtgcacccggtccatccaaccaggggctagctggttcccctgggactccttgtagttctcaggacccactgcctaggtttttggtctatatgtacttccacccatgcacaaagccccactccctaggtcaatggccatccacgagttatcttacttgggatgctgatcccacccttcaaatgcagaagtccctatgcctctgaactacggtatgggaactccatcccgtataatacctggggtcactgctagctcacagtgtgaaaatgagaaaacaggtgcttccctctgagcaaacacaggcccatgccagatgcccagatgggtgcaatggagcagaagctgaatttcagttcatttgctccctcagctgctcttttaccacacgcagcctgcacaaccatttgtagtgccaagtgccttgtgccttatgcctgtgccttatgtccttctctgtcatatgcaaagccctctgacaggactttaaattttggggatctaaggagggattgtcactatctgaaggtcctcactgctgctacaatcaggacagctttagggttgcttaaagaatcatgttttctaagtattcctgtttaatagctgagttaccaagcaggaagctaaactgagtacgaattgagagtgatcctataaggcaatagggaggacatctatgagctcgacaagcagggcagtgctacttccttttaaggaggacttgaagcacagggcagtttgcttgaaaagataagccaaatggactggacaaccagatagagggacatttactttcttagtgatcaggagagggaaggagggaaagaaaaagaaggggaggaatgaggaaagaagaggagaagaaaaggaggacaggcaagaagtgagggtcagggtgcccagcatatttgtgccaggatctcaaggagagttggaggaacaagagtaacttaacttagaaggagataaaattcgagggattaatcatggaatcctggattgtgacatctcaagataaatccttaaagacaagttagataacaattattgggtcagtatttaattgaaaacctaagactcctcaaaccaatgggaagattgtttgcagccctctaaatgcctagagcacaggagatgctggcagtgagtccccactatgtataggtgaaagtggagttattgggatacaaaaaaactaggggtcaactaggaacaaggaatgcaggtagcttgaacctgaatgttgcctcaagtctataatcaaaatccattccaaatatgcccccgcccccattccctcccattgctcttttctgggctaagaagttaattgctcagggcctcccaaatggggggtagctggagcagacatgagggactcagcaaagaacaaggccctgctaccccagatttccccagcatgaggcaaatctaaggcattcccccgtgccatttgcttaactcctctgggaacttgcaggactggagttccccagcagcacctctcagttaacattttctcacgcttctctcctgcacagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagagagagtgagtctccatctcaaaaaaaaaaaaaagatagaagccaataagcatggtgcaatcaaattctggcaagcattaaatatcaggatgcagctgggcacggtggctcacgcctgtaatcccagcactttgggaggccaaggtgggcagatcacttgaggtcaggaatttgagaggagcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagatgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtggcctttggactcaggacaccctactcttgtctctcctctcagtttctctgctatgaatctcctgattcatgaacacgttatctgttcacccttctttctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccggacatggtggcatgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatg

SEQ ID NO: 13199 - DNA, 35676 bp, Human
  misc_feature (1)...(35676): n = A,T,C or G
aatgagagataatagtggaaacctggttcaagatgggagatcaatgaaggcttttctgaggaagtatcattttatctgaaaactgaagaatgatggatgatgtatataggacagggagcagagaatatgtgggaagatttccagttacaaagagaagcttatgtgaagaactgaacaagagaaataatttcccagatggtagacaatgcagcttatttcaatacaaatgtctacattcagaataaggcaaaaaatctgaattcctcgaagttgaacaggctgaagtcaagtgctggcatagtcccatcacctatatgagtaaaatcctctactccccatgtgttgagtggttgctgagctgctggaaatgtcccagagaaagagagatgccatcggtcttggattgtttaatatactgtgtcactttttattaaagagtttaaaaccgcattggtttatgatattgtttagatgttcttgcaatttattatttgatacttggttttcacaagtttatgcatagtttattaacatatacacttttcatttaggatttgttggagttctcatgaacactctttaggctgctgcaaaaccaaaaattaaagtgtgagatgtacacatgtattttcatagctaagcatgtgaacccactcctcttgtactatgctgtaacgaataatggaaatagtcatttttcaaagtgtctgtatatttataaaatttcaaatatcacttagtcttaacatatcatgttctactgtggaaaatcataccagaaagaccaaaaaatcctgctgctttgttttataaatatttattacaatgtatgtatcctggcagtcagttgcactctctctccaaattctgcatagaatcttttggaaattgggcttcatgaaagaaattgtatttaactggtagctcttagttctcaaaaacaggtttattctgccatgagaacaattccaaagaggagacaagaattcctccacctatatggtagttttgaattgcttagcatcttatttacacttgactatctataaggatgatagattagttatgttcctgtttaagtttactctcttcctatttaagactaaaagatatatcacaactcatttgtgtatttccatattttcacttgcgtaaatcagagtaaggagtcaaaaacttcataagtacataaaactgcttacagtcctatatattccccattgctcatgggataatatttagcatctagcatcctcggtactgaatgtgagggtctttacaacacagccacctccatgacaacattatctctgccacttcctccttttctcttcatctcttttacattccagctttgcttgactgattgccgtttccaaaacatgccatgttcttccaagatttatatcattccctcttatctgttttacttgcaaaaccctatttatgttttagttctcacatccatattgttttatatgctaatgttcttggcctaaggcaaaaagtttcactgccttatttatgttttataatacttttataaccactattatatcacatatttgtttttatataatcattcacttatatttatgttttcccaactagattcttaattttctcaagaagttaacagaccaattatatatattgctttagattcatgccttctacaaagcctaccacaatatttggtatacaataagccctcaagaaatgtctactgaattaagttaaacatgattctagaggcctgtgcaatagattgttggcatcatccaggttctcacaatttcattgcatattcttcagatcaacatttagaacgacaattagattacagagcataattttccccaatgggtggggcattttaatcagtcttgcccattttttttttcttgtgatgtcattggggtgccttgaacatgcagtcaaattccacacacagagcagtcctttgttcttatcaacatctcacagcctgtgaagctctcagtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctcgtgagtaggcaatttactacttactatacatttttcggttcttcggtttctcagaatgtaaaacaattgaatactataaacccttgagctctttgtagaattatatgatggttatgagtgctaaggatattacatgtttgtgatgtgacatctggtcttcttctctgtgattaaggtgcttggttggaactttttcctattaaaatatcagaacaagaagctgaaaattaaaataattgatgccttttgtattgcttatctactgctaaatgacctttttccttcagttggtcactagttctgcaaagaaaagtatcacgcttcctttgcattccccactgaaagggccaaaggtaactttggaggagagagagttctaagaatggagttataagaagggaaccctagatttcatgtgaggaccctaaggaataagaaggggtatttaatatgatgtaggaagttaatggagttttaatcaaaaaagtgtactcagagttttacaatattctgaaaggaagtcggtttgttactttgagatgaaaagaaatgtgtgaatacttaacatattttaaaaacaaaatccttccttgggaatgatgattgagcaaagagagaaatttaattcaagtttggaagggtaggctgtaaaatagttaatataacaataactaccatttactgcgtccttattataaaccaacacatccattacctcattagccaggaaggaagacagtagtatgtcactattatatagactatttgcttttcttaagtaaggttcaaataatctaaaaaatttaaaaattatttaaaatggtataatgtttattatacttcatagcatatgtctaagctttttaaaaaacaatttgacacccttttttttattccaacattttttgagggaattaatatgatgggggtattcccatgtagaaataatggcctagagttgctaagtgacataggaaaaatataaaattgaaagctaaggacagagttagggtaataagacagagaaaactagactccaagtctagctgtctttacactgcatagatgtctgagagggttcttgattaaataagttttatagtttgcaagttagagaataaaacagaaaaaattctgttcatctatgtatgcttttgtacatttcattcattcatccatttattcatttagtacatattttattaagcactaagcatgtgctacagcaaatttattaaaaaataaaacaaatatgattcttttattctaagactccactatctgatacacttgtaaacaaagagatgcaatacaatgttaaaaatgccaaaaatatgatctaagattaatatgatttaaataaagttatcttaagactttaagagcttaataattgtatcattcaagctgaactttctaagtcccagcatcaaagcttctaggtaaaatttcaattcacaatttgagatcaacaccaggttgaaggaaagtcactaaacatggtcatttttcagtagcctagctatagatgtataatttttggacatctagtgtgcaacataatgatgatagttaacaataccgtatggatatttgtaatttgctgagcggatattgcttcaatttaatctgatcacccctcgccccacccccccgacacacacaggtatacacaaacacacacacacacacacacacacacacacaggtgtacacacacaataataacaatgtagaggtaatgaatgtgttaactagcttgattgtagtgatcatttcacaaagtatatgcatatcaaaatgtcaagttgtatacctcaaatgtatataattgtatacgtcaattatatctcaataaatctgtttaaaaatatagtttagtagtcacatcgctcttctacactacttgtaaaaacatgaaaatttattgattttatgattcatgaagaaaatatttattaagctaccaattctcgtaagcaatcttcaactctctcaagcttgtaggcactagatagtgaataaaacaaacaaaatgggattccattgtgtatatatgccacatttttttttatctattcatccactgatggatacttaggttgattacgtatcttggctattgtgaatcgtgctgcaataaacataagagtgcagatatctctttctcttcaatatactgatttcattttctttggaaatatccctagtagtgagactgctggttcatgtgatagttatatttttagttttttgagaaacttccatattgtttacattataatttatattcccaccaacagtgtgtaagaatttccttttctctgcatggaggtagagagtagaatgataattactagatattgggaagggtgttggaacagggaaagtgatgaagaaagtgtggttaatggctacaaatatacagttagataaaaggaaaaagttctagtgtttgtcgtacagtaaggtgactgtagttagcaacaacatattgtatattttgagataactagaagagaagatttgaaatgtttcttatacaaagaaatgataaatgttcaaggtgatggatatcctgaataacatgatttgcttattacaattcatatgcatttatcgaaataccatccacatgtatcccataaatgtgtatacatattacgtatcaattttaaacagaaaagaaaatgaaaaaaagacaaaatgggcaaagtccatgtcctcaggaagtttacattccacagggaaaggcagacaaggagatatgtgaccagacacatctgaatgtctaaatgtataccatatatttagatggttaaaaaaaatgccatggctgtaaacgaagcaagattagagacataaatgcatttggacaagagatgttttttcagcctctctccaccagagagagaacaaaatcctaatgactcaaggcatccattgcgtgcaattaattaacttgtctcctatgcacctagaatgccacaaagtgaaattttacatgaaaggtagccatcattcactcaaaatgctgtccataacccagtctattcacaattaaaagttctctcttcaggaaaggtgggtctcaagactcaaaattctggaaaattctcatcttccagttcagttatattattcctgcttaaaattgtttgtagaatagactgagaaagtacatgactgaggtgttatatacatatatatgctatatggatttccctacatttcaaataattgacttacacaaagtttatgtaatggtataagttaatggagaacagatagttaatattcattaatagaaaacaatgttcaagtcaaatgagtaaacattttgggtgcctacctagttccatgcccagtgccagtgcagggattcaagcaaagaaaaggctcggttcctccccaagaagttcacagtacattatgatagttctcaattgtagtgtggtaaaagatttgagtatttcaaaaataaatgaaattgtatattaatctacattttaagtaaactacagaaaatacaaatttattctcatcacttgtattctgtcgtgcttttttaaacagtagagaagggaattaggttacagaacccttgggtttgcacacaaccgtaagcacaatcatgaaactatgttatgtacctgaatatcatgtttcatgccatgaataacccctgagatactcacttgataaactagctatactccatggtttttggcttccatagcacctatcaaagtgctggtcaccctgttgagtcaaataatttaacaagcactgaagtttgactgtgtctgtcagctaatccttgctaacatgtagacggactagagaaaattaaggttaaagagaaggctctctggggactgcttacattttattagagattccacagatgctaggtatttaatatctaggggacattaaaatcatattaatgatttttttatactctgtggcattaaaaatccgttagtttatcctgtactttgattggctcatttactcatgtgtcacactgtaatactgttacattgtccatttgaaaaatattgattcactgacttatacaggtcttccaaatgttgacatatttccatatataacataaaaaagaatattcgttaatatcatcaacagtctctctagaaaagccttgccaagtatcaggaagttgataagcttgtgatagcagacacaaattttctgaaattctaattgtttaaaaactgagaatatatcatagctataaatactgtcagttctttaaattgagatgatagcctcatttcatgcatttttcagaaaatatctgccagacactcaagtctgagaagcaacaatgtatgtgtcagtctttctttcaagcaacaatggaatcttattaaaatggttcttgttcaattagcaactcaatcaatcacagaagtgctttttttctgagataccatcacatttcagtagtgctttacatatatttgtatttcaccaggctgattcatacgtattaaaaagacatgtcatacacaaaaggcaaatacgatcctagaattgtcatgaaaatagttttaacttctcagactccctgaaagtcagtctgcaggacacccagatatctgtggatcacagtttgggaaccactgaagatagaggtgaactggcaaaggatctacacatcactcgaaatcatttcatgactttcaccaaaagattcagcaaatcttcatgttacaaacaaaggtagctgatttctactgtgtaaacaattcctaggaaatggtttgctgctgcattgttacctggaattgtcatgataactgaattaatatactgtctgtaatatatgacctaacaataagatactagtctctagcagaaccgatgtgatgcctttgaattggacagttttgcctacttaaaaggcctgcaagccatgggcacaaatagaactaagaccttggatttgaaatatcattccccactcagggactcattggagaaattgctggttccaggttggggcaaagaaagcacaaggtaacccaagtgcttaaagactaacagggccatgtgaaaaggacacaggatcctgcttgaatggggcatcaacaggccaaattaggaatacatggagtgttaaaataataatgacataatggtaatagaaattcaaataaggaaaaagggattcaataagcccatagaaatattgcataaaagagaaaaagaggagaaggaggaagctcttctttatagaagaatactaattaatataaaggagaatagacatagaaaattacaattttgaaattaccaatgtaataattcatttcagcaatgttcatcatggaagctaaaatcattgggtgaaaagttattggataacatggcattcacatgttctgaaagagtcacccagagattacttgatacttacagggtcaaagttacacttatagtggagaggtctggcaacaccagttttaaccaagtggtcaaacctaccattatcagtaataggaaaaacaaattatgtgcttcctcatgtgatctagtgggaagtacacaatactatctgtataatattcttgccaaaaatatttagtctgattctaatcatggtgaaacaatcaaacaaatccaaattgtagggcattctacataaaaaatgaaataataccagcaatgaaaagcatgtaagagaactgctctaaatcaaaggcgtctaaagacacatgacaaagaaaatgtatgaaacttgagtgaataattaatccagaaattttataaaaagacagtctgggaatagttggagtaatctgaatataattctatgttaggtcatattattataccgatgttggcatttcttggatgtgatgctgatattatggtatttagaattgtatggtattttacttaggagatgtacacacacacacaaacacagaaagcaagtgtgaaaatattaataactgataaatctgagtgaatagtatgtaagtgtttattgtattctcttttctaaatatttgaaatatgtaacaataatatatttagagggaggaaggaagatactgccctaaggatactattctctcaaaaaagatgagtttagaatacaaccccattggttcaaaagattgccaaaaagttatatgtatagcaaactaccttgccagccttgagccactaaaaagctggccctcaccagtaatctatttatttatgaataaatcaggcagttcctaaaaagctacaggtggcagactttctgttgagttctctgagacaagccacctaatgactcctatcttcagacttgcattcactttctcctgcaaaagtgtctaactggcagtgttccatcaagtctatttgaataactgacaaatgagcacacagagcaacaaaacagacaaacaaacgaaataaaacaagagggatatgcacaacatgggtaacactcagagaatgattcttaaaaggtatctagaagattttcaggtaaaggagtattggggctgggctcatacctgtgagaggtgacagcgtgctggcagtcctcacagccctcgctcgctctcggcgcctcctctgcctaggctcccactttggcggcacttgaggagcccttcagcccaccagggcactgtgggaacctctttctgggctggcgaaggcctgagcccactccctcagcttgcagggaggtgtggagggagaggcgcgagcgggaaccggggctgcgtgcggctcttgcgggccagctggagttctgggtgggcatgggcttggcgggccccgcactcggagcagccggctggccctgccggccccgggcaatgagggacttagcaccagggccagcggctgcggagggtgtactgggtcccccagcagtgccagcccacctgcgctgcgctcgatttctcacggggccttagctgccttcccgtggggcagggctcgggacctgcagcccgccatgcctgagccccccaccccctccatgggctcctgtgtgcccgagcctccccgatgaacgccaccccctgctccacggcgcccagtcccatcgaccacccaagggctgaggagtgtgggtgcacaacaccgggactggcaggcagctccacctgcatgcctggtgcgggatccactgggtgaagccggctgagctcctgagtctggtggggccttggagaagctttatgtctagctcagggattgtaaatacaccaaccggcactctgtatctagctcaaggtttgtaaacacaccaatcagcacctgtgtctagctcagggtttgtgagtgcaccaatggacactctgtatctagctgctctggtggggcctttggagaacctttatgtctagctcagggattgtaaatacaccaatcggcactctgtatctagctcaaggtttgtaaacacaccaatgagcaccctgtgtttagctcagggtttgtgagtgcagccatccacactgtgtatctagctgctctggtggggccttggagaacctttgtgtggatactctgtatctaactaatctgatggggatgtggagaacctttgtatctagctcagggattgtaaatgcaccaatcagcaccctgtcaaaacgcaccacttggctctaccaatcattaggatgtgggtggggccagataagagaataaaagcaggctacctgagccagcagtggcaacccactctggtccccttccacaatgtggaagctttgttcttttgctttttgcaataaatcttgctactgctcactctttgggtccacactgcttttatgagctgtaatactcaccgtgaaggtctgcagcttcactcctgaagccagcgagaccacgagcccaccgggaggaacgaacaactcgagacgcgccaccttaagagctgtaacactcaccgcgaaggtctgcagcttcactcctgaagccagcgagaccatgagcccaccaggaggaacgaacaactccagacgcgccaccttaagagctgtaatactcaccgcgaaggtctgcagcttcactcctgagccagggagaccacgaacccaccagaaggaagaaactccgaacgcatcggaacatcagaagaaacaaactccagacccagacgcgccaccttaagagctgtaacactcacctcgagggtccgcggcttcattcttgaagtcagtgagaccaagaacccaccaattccggacacacctgcactttgggaggctgaagcaagaagatcacttgggcccaggagtttgagatcagcatggaaaacatagtgagaccctgtcgctacaaaacagaaaataaaaaattagctgagtgtggtagtgtgcacctgtaatcccagctactcaggaggcggaggcaggaggaggtcaaggctgtagtgagttatgttcatgccactgcactccagcctgggcaacagagcaagaccctgtctctctctctctctctgtgtgtgtgtgtgtgtgtgtgtgtctcacacacacaaagtgttgggtgtgagatggagcggacatcattccaagtagctggcatatatacatatctatataggaaatagaggaaaaggagagttttgtttcattttgtttcttttgggtggtagagagtgttagaataatcagttacattttaacatgttgagttattaagtgatatggtttggctgtgtgtccccaaccaaatctcatcttgaattgtagttcccataatttccacatgtcgtgggagggacccagtggaaggtaattgaatcatgagggcaagtctttcctgtgctgttcttgtgataggaagtctcacaagatctgatggttttataaaggggagttctcctgcaccagctctctcacctgccactatgtaagacatgagtttgctcctcattcgccttccaccacgattgtgaggcctccccagccatgtggaactgtgagtcaattaaacctttcctttatgaattacgcagtctcaggtatgttttcattagcagtgtgagaacagattaatgcagtaaattggtacaggtagagttggatgctgctgtaaagatacccgaaaatgtgaaagcaactttggaaatgggtaacaagcagaggttgaaacagtttggagggctcagaggaagacacgaaggtgtgggaaagtttggaagttccttgagacttgttaaatggcttagaccaaaatggtgatagtgagatggggaacttgttggaaactggagtaaaggtcactcttgctatacaaagaggctggcatagttttgcccctcccctgaagatctgcagaactttgaacttgagagagatgatttagggtatctagtggaagaaatttcttagcagcaaagcattcgagaggtgacagagcataaaagtttagaaaattttcggcctgatgatgcagtagaaaacaaaaacccatttcttggggagaaatttaagacagctgcagaaatttacataagtaaccaggagccaaatgttccctcatcaccaagacaatgtggaaaatgtcaccagggcatgtcagagaccctcatggccatccctcccattacaggccaggaggcctaagagggaaaaatggcttcatgggccaggcccagggcttccctgctctatgcaacctcacgacatggtgctctgtatcccagctgcttcagctccagtcatggctaaaaggggtcaatgtacagctccggctgtttcttcagcgggtgcaagccccaagtcctggcagtttacatgtggtattgggactgtgggagcacagaagtcaagaattgaagtttgggaacttctgcctacatttcacaggatgtatggaagtgcctggatatccagatagaaacttgctgcaggggaagagctgtcatggagaacctctgctagggcagtgcagaagggaaatgtggggtgcaagcccaaacacagagtcactactaaagcactgtgtagtggagctgagaagagggccaccatcctccagaccccagaatggtagatccactgacagcttgcaccgtgcccctggaaaagccacagacactcaactctagctgtgaaagtagcctggaaagggggctgtaccctgaaaagccacagaggcagagctgcccaaggccatgggagcccacctcttgcatcagtgtgacctggatgtgagacatggaagcaaaggagttcattttggaaatttaagatttaaggactgcccattggatttcaggcttgcatggggcctgtagccactttgtttttgccaatttctcccatttggaatgggagtatttacccaatgcctataaccccactgtgtctaggaagtaactaatttgtatttcattttacagactcacaggtggaagggacttgccttgtctcagatgaaactgtggacttttgagttaattctgtaatgagttaagactttgggggacggttgggaaggcatgattggttttgaaatgcaagaacatgagattttggaggggctggagcgaaatgagatggtttgtctgtgttcccactcaaatctcatcttgaattgtagttctcataattcccatgtgttgtgggagggaaccagtgggaggtaattgaaacacgggggccactctttcctgcgctgttcccatgatagtgaatacgtctcttgagagctgatggttttataaaggggagttgtcctacacaagctctcttgcctgccgccatgtaagacatgactttgctcctcctttgcctttcaccatgattgtgaggcctccccagccttgtggaactgtgagtcaattaaacctttttcctctacagactacccagtcctgggtatgtctttattagaactgggagaacagagtaacacattagggcttgcaagatatcctattgcaagatataaaagtagaatagaacaaaattaacaacataaattaaactctactaatgaatgagatgacgttgaggatgctgctgctgctgatggtggtggtgatggtgatgatgatggtgaaattgtatcctgtcaggttctggttaccaacctcaaatccaaatttatttttagcagaaaagtagaacaaattttaaattataataaaaccactgattataatgatgcttaatttgtcataggcactgtgtgaacttatcgtgtatttattttctaatcctcaaaactacccttggaatacacatgttaagaagaaatacctatggtaaagttgaggtttaaaaagattaagcaatttgcccaaggtcaaatgtttggtaaatgaaagagcttagtcagattccaacccagattgtctgcctccaaaacctgtgttttaaccactacattctataggcagcattgtttatcaggtaggaatttaggccacatttgtctacatggattgattgtctccaacagatttgccaaaatatttcttggtcttcactaacatcagtcaacttttaaagggtgagaatgtattctttgtgggaaaatgagttcactcagtgaaaacatcaggtgagtgatcttatatccctgtattctaaacaaaaattgtagaattcaaagcaattgctgatgttttccaagataaggcactgtgagcttaaaatatataaagatatatacagacaaacacatatttacacatagagataaaattgatttttacacagctgataatatggggggttttatgcatgtcatcaactaatagcaaagaaacaggtttggctatttgaaaacggctaaatattgtggtctccctgaagattgatcctacatgtgatagtccttaatatacacgaatatcaaaacataaaagtgtgttagatgttagatgtacaccacagtttacatgtttattctggatatatttcacatgcactctgtaccagatactggagacatgaggaggtaaataaaacacatgccctcatggagccttatgaagtattagtcccattttacagatgaggaaatcactggttatccaaagacacacagctagtaaacaattagaatggaatataaactactagctagcatagagctaatacagtgtctttgatcagtgtgatgcctctctaaatgtgaaagatgccaggcacagtggctcatgcctgtaatcccagcactttgggaggccgaggctggtggatcacctgaggtcaggagttcgagaccaacctggccaacatggtgaaaccctgtctgtactgaaaatacaaaattaaccaggtgtggtggcacacgcctgtagtcccagctactcgggaggctgagacaggagaatcacttgaacccaggaggcagaggctgcagtgagccgagattgcgccactgcactccagcctaggcaagacagagtgagactccatctcaaaataaattaattaattaataaaaataataagtaataaataaatgtgaaagacacaacttatcacagccaggaggatgggaacgctaagaacagtgtaggattctaatgccttgagatttcttcgcttttatacttttcactattctcttttattttctgttaacaactttcaggaaaatgcttgaaataaaaacactgagttgctatgatctcagggggcagcaaggaatgggagaagggagcaaggaaaatgtaggcacctggttccctcccccctgctatcttggcccaaaacagagtgcaaaatttgctgtgctgctgggcagaaatttttaagtaaatcaagccagcattttctgttttggtctaaaatgtttaaagaaaattaaagttttacaccgcttactatgaatccttaaaagcatagttgatttagatgagggtttctccacagcagcacccttaacactttgagcccaatacttccttgtgggaagctgtcctattcaccacagcaagtttggcagcatccctagtctgtaccctcaggacatcagcggcaccactctacttcctcaagttgcaacaaccacaaatgtctccagacattgtcaaatgtagtctgggggttaatattacctcttgttgagaatcactgatttagacaagacttgacaatccttaaaacctgttggaagatttctccaaagtgcgaacccctaaagaaattccttttcttctataaaatggacactgtattcctttagtggcagagccttgcaccacacaactatagttgtggccctctccctggtccccacccacaaactcttaaagcaggataaatgataatgcaataatcctagttgtttataaacctttttattcgtatatttcacacggaatcattatctgtcaagagcctccacaacttttaagctctcattaatttaaataataaatgaggttcttaagcccccttgtggcgaaaagcagtaacaagaattacatcagaagagggaaaaacagtgaagcacagttaatatatgaaatttctttaccccaatataaaatgtctcaatggccgggcgcggtggctcacgcctgtagtcccagcactttgggaggccgaggtgggcggatcacgaggtcaggagatcgagaccatcctggctaacacggtgaaaaccccgtctctactaaaaatacaaaaaaaattagccaggcgtagtggcggacgcctgtagtcccagctactcgggaggctgaggcaggagaatggcgtgaacccgggaggcggagcttgcagtgagccgagatagcgccactgcagtccggcctgggcgacagagcgagactccgtctcaaaacaaaaaaaaaaaaaaaaaagtctggttttccatcaaaggggaaggggggtgaaatctgcagaataattgttccactaacagaaattatgaaattagataaaacaatttcttgaattagttggtgtattagttcgttttcacactgctggtaaaaacatacccgagactggcaatttacgaacgaaagaagtttatttgacttacagttccacatggctggggaggcctcacagtcatggtggaaggcaaggaggagcaagtcacctcttgggtgtcatggtgtgtcaggaggcaaagagagagcttgtgcagagaaactcctgtttttaaaaccatcagattgccaggcgcggtggcttacgcctgtaatccagcactttaggaagccaaggagggtggatcacaaggtcaggagttcgagaccagcctgaccaacatggtgaaaccctgtccccactaaaagtaccaagtccggcatggtggcccatacctgtaaccccagctacttgggaggctgagacaggagaatcacttgagcccgggaggtggagcttgcagtgagccaagatcgcaccactgcactccagcctgagggacaagaatgagactctgtctaaaaaaaaaaaaaaaaaaccatcagatcttgtgacacccactcactgtcagagaacagcacgggaaggacctgcctccattattcagtcatctcctaccaggtccctcccacaacacatgggaattatgggagctacaagatgagatttgggtggagacgcagagccaaaccatatcatttggtaactgcacagtttaaaaccaataaattacaggcagaaccagagtgctctaagaaaaaaaaaaaaagaatgttaggaaaaactttgtgtaattaaaaaaaatgaacaaaatgaaaaaaactgagtccttatttttattctagtttgtgactataaacaagtaacctaacttctctgtgtctcagtgtcctgacctaaatgcaaaataaaataaattgtagagctaagacactttagacatcatgtaatccaagtattccttaaaagataactgagtcccataaaggtttactaaaaccatactaagaatcatgcatatcccctaagttcctgtccaatttattctatgatctagatcaaatttttacatacaaaaattaaatggtgggtgacaaatcaatgtgtaaagaaaaatgaatatatgtgattatctctacttcaaaaagcaaaaagggaaacaggttgatattaattgacaaatgcccatcagcgagtcaggtaaaatctcagttctagggtaccctgggtaggtatgggatgggaatcaacaccttaaggatcaacacctgagggaaagaatttgggcagagaaggagaaggcctcagctgacccttcaggaggctctgaagctaggattatccagttttaggtggtccttttctgagacaagcggttgctcatgtgaatcagttattgtgtccagactacccgaaggaagagctatgatcttgagcaaaagaagagcattttccagagagaattgagagcttagggtttcatctggcggcactcctgaccgccagggaaaatgagaggaataagtcttttgatctgaagggggcatctgggcagcgcatctcagcatccactgcagtagacaagcctgagtagtgtaccacagtctcttaccctcaacacactagcccctgagcctgatggcagaacagaagtagagaggagccaagaagcagtaacgtctctgtgtgcctcggaagccagagctctgcttcggttattttatacccctacagtgctcaatgaatggagaaatcaggaaagtcaggttggagttcaaatcctgacttcatcctttgggcaaattaatggacttttaatgttggtttcttctgggacatattttccaggcacatcctccctcatacctatttccacttaaacctctggccacaatggtgatgtttaatttaaaagagactatggggccgggcatggtgggtcacacctgtaatcccagcaatttgggaggccgaggtgggcagatcacctgaggtcaggagtttgagaccagcctggccaacatggtgaaatctcatctctacaaaaatacaaagattatctgggcatggtggcatgcgcccgtaatcccagctacttgggaggctgaggcaggagaattgcttgaacttgggaggcggaggttgcagtgagccgagttcatgccactgcactccatcctgggagacagagtctcgctctgtctccccccccaaaaaaagagagagagagaaactatggtgccccattcaggtttgtccactgtagtggatgctgttatgtgtactgcccagatccttccttcagatcgaaggactatttccaatgcaaaaatgtcaatctcatatatggtttatccatatatatgtcttaccaacttaactgtcagtttcttgaaggaagagctcatgttttcactatcttgcatttgatcatatgttttattggcataatactttaccgtatgcaaatcctcctacacaggtgatcccacttggattattctgtgaaatagggcctttacaatgttgcagatgaaaacactgaagctcatagagagtaagtgacttgcccagggtcacacagtcatgtgattgaactcaggtacctgagcccatatccccagacaccaagttgaatatttgttactcaagaggatacagcctttatgtttattaatgcttcatggttcataaagtgctaacaaagaaattatcccatttgacccaaataatgatctggtaagattttcgtggctggtgctattatacatatttgataaatggagactcatccatcaaagaaacgtactacttcttctctgatatgcaagctattatgccaagttaaagagagccaggtatgaatggttccaaaccccttcaatcaagaagttcacaatctagtgcaggagatggacaccttattgactattacagtgtgacaaatgctaaataaatgctattatagcatgacaatgataaagctaaagtatatacacaaagctatgtaaatgaaaacagaaaataattctgtttcctgagagtattgggaaagtcttcaagaaggggtgatgcttgctctgtgctttgtaagtctgtcctcaggtggaaaacaatgtagaatttctcagggacaggatgaaagacacactgttgtaatagtgcatagtcttcccaataaaaagctccaacactgaataacttgccaaagtctcttggttagtaagtagtcaagctggcattggaacaagacttttgcttcccagttaaatgctctcttttcctagtgtgttatacaaaggtggtagcacttaataagtggggtatactatgatgcagtactttcttcatgctctcataatgcagatattttttcctttcctcttttccagtgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaagtgagcatccttactgtgggctgaatgtttgcatcctccagaattcatatattacactcttaacctccaacatgatgatattaagaggtgggggactggggaggtgaccaggtcatgaaggcagagtgtttatgaatgggatcagtgtccttgtgaaagaggtccacaggagactcctgaccccttccactgtgtgagaacacagctggaaggcaccatctaccaaccagaaagggagccctcatcagacaccaagtctgtcagcatcttgatcttgggcttcccagcctccagaaccataagaaatagatttctgttatttataaacaacccagtttatggtattttgttatagcagtccaagcagactaagacaattctttatttatcagccatttcattttcaaatcaatcgtttctctggtagtcccctgtcatttactgtactggctggcaaattgcctcccttatgcaacagaaaattgtttaaattcaaaaatctgaatcaatgccttcctctactgagctggataatacattcatgtctgtaacctctctggtttgactttgaggatatgagaaaccctcttccataaaagtattattccttccatctcagctacagggagcaaaaatttcccattagttatttttcagattgtttctaaaatgtaaacatgtattcttgttgtgcaatagtaaacacacaccccaggaaataattcacttattagatcaaagaatataaaggaaaaccctaaatgagataaaaggtgagttaaaatatatacattagagcaattaaagagtgtctggtcaaaaagaggaggaataaggaagtgggagatgatgagtaagcctgggaagcactggatgtgcctggtgggagatgggattgcactttggtcagttttatgttgggtgtgcattactcttcaatttattcttgtttcccttcagcatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggtaagagttagaaaatttatactttcctagctttgggcatcagttctggctacaaaaaaacaatgggtgtctacggtatatgggagcaaatcttggtgagagtgataccgtagcaaatagtaacaataaccatcatttactgagtgcctactgtaaactaggagttttgtaaacattatcttatttcatcttcacaacaacactgcattgtacgtattatttttattatcatgtatacaccataaaaactgattatcacagatgctgaatggcttgcgagagtctgaattcacctccagatttttctaattcctcaactcttcttttgcctatcaatgatgaattccttttttatatttttactactaggtgaatagccccatataaaacattgtagtggtttttgttaaggcctcagtcaaacttttttctccacaaatatttcattgattccccccaggaataataaataaataaagaacatttaggggcattctagtactttgttactttgtttgtatttctattaacattaattcaactgcaaatatttttgataactttctagatgttgggactcaatgacaaacaaaatatgaaagttcctgtttttatagagcttacactctagtgggagagacagaaaccaaataaagaattacacattcatccacccacccaaagacacaaacacacaaatgttattataaattgcaatacatgctatgaaaaatatgtagggtaggtctatgagaaagtgtaactggaagattagattgtagaatcaaggaggggttccctgagtaagtgacagttacgctggacctaaaagatacctagaagttttccagtaactaatggggagaaaagttctttaagccaaggtaacaacaaccagtcttgaattggtgatgaggaactaaaagaaaacttctagagtaaggtgaaaggacttgagcgataccagatgaaaccaccaaagtaagtgggtcagattaataaagactctgtaaactctgtgtgctagctgaatgaagacttatttgatggtcccaaagggaaaaacagagaaggttattttgcctgcaaatatgtgagcatttcaagataggcacagactcacatggtatttggaaagtccaagcatgattaatagccacctcccatcttcctgaagccacctggtgaagcaaggcaaggtttcccagctgggaagggactaagtgttgctgggaggctaaaggttgctagatagatcatatatgctgggaagatatttgactcattacaaccaagtgtggatcttcaaggggactgggtctgtctatgtctagtaaacaaaggaacaacaactaggagaccctttttacttaaatttgaaaatctttcataaatagatgtgtgtcatcttactgtctataagtacaatttgaccctttgagtattccctctagaggaaagaaatgtagaaaactgggtcaaaaccacatcatatcctaaagaggaatctaaatctcttgaagtgaatctgggacctcagctggttttcatgtcatcatagagcagaattaaaaaaatatgggtaaaaactctggttttttgaagtttcaagtcttgagttacaattaagtgagctttaactgcaatttcaagtgaacatatcatcttcattttgtatcgcaagcagtatctttttttttttttttttttttggtttgagattagttcttgctttgtcacctaggctggaatgcaatgtgacaatcatagctcactgtaacctcaaactcctaggctcaagtcattctcctgcctcagcctccccagtagctgggactacaaggcgtgcaccaccaggccaggctgagcaatacatatttcactcaaaatctccatcacctagagaagcaaccttgcatgtcttgtgtgcccaccagggaactagcactttagaaatatgttcttatctaagtctcaccacaaactctgttgagagtgggtaatatttccccattttacagaatccttagatcagagatgtttaataatttgtctaaagtcacattgcaaggaagtaactgacctaggattgaaagtcagttctgtatggctccaaattctgtactatttctgttttactccctgttttacccccctttctctgacacaatctttctgtccctctttaatttttttaagttgtttaaccaacaatgcaattctttcattgactttcctcccataaatgagtctcaggttcacctctatttatgtgaatgctattttgtccctcaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattggtgagtgtggataaacttgcttgaatcttatctatttgaaaaggcaccagagaaggttaacttcaacaagggtgtgagatgctcaaaaagaacatccaagccaggcatggtagtgaacgactgtatcctcagctactcaggaggctgaggtgggattacttgagcccaggagtttgagtccagcctgggtaacataatgagactccatctctaaaaaataataataataataataaattcaattaaactttgaaaaaatgagcatcttttgcatactactttatgctggctcaattctcctcttttctcttaactgtagataatcaagactaaacagagacattgtcagtggccaaaggaaactacatcctccaggctgggcgtggtggctcacgcctgtaatcccagcactttgggaggccgaggcgggtggatcacgaggtcaggagttcgagaccagcctgaccaacatgctgaaaccccgtctctactaaaaatacaaaaaaaagttaggtggacatggtagcccgcacctgtaatcccagctactcaggaggctgaagcagaagaattgcttgaacctgagaggtggaagttgcagttagcagagatcaagccactgcactccagcctgggtgacagagggacactccatctcaaaaataaataaataaacaaataaataagtaaataaataaataaagcaaactgcatcctctggactgtcttccatattcagaactaatatcccctcttttggttcactacagggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggtaagtgccgccttagccctcatggaaattttgcttcacaacactgacagttgctcagataagtagtaggtaatttctgcatcactgctgaactctcaagacaaatcagaagcagaccttgtagaatgttctaaaaacaacaacatttattcattaattcacttattcatcaaatctgtaccctgggctgggcgcagtggctaatgcctgtaatcccagcactttgggaggcctagacagggggattacctgaggtcaagagttcaagacaagcctggccaacatggagaaaccctgtgactactaaaaatacaaaaaaaaaaaaaattagccaggcgtggaggcagacacctgtcatcccagctactcgggaggctgaggcaggagaatcacttgaacctgggaggtggaggttgcagtgagccgagattatgccattgcactccagactaggcaacaagagcgaaactccatctcacaaagaaaaaaaaaaagaaaaaaaaaatttttgtcctggaagattaaaaaatgttctcaaggaatttacagtctagtagagaatgaaggtagtcttgtaaaaatctttgatttgaggtatatttctttaataatagagttaactgctcccaagttctgagaaaagatttcttagaaacaagatttatcaaacagcagaaaaagagagtgggatgatgcacactgattctattctcccaactgcaaacattcctctcaaagaaataacaactaaatgcaatgtgggatcttcaataggatactagaaaaaatttcagtaggaataatggtgaaattcaaatgtctttaatagtattttatcaatgctaatttcgattccatggttatgtaagattaacatcttatttgagaaactggatgagggacatatggaaacattctgtagcatttttacaacttttatgtgtctgcaattagttcaaaataaaatattttttaaattcccccaaattggtctcttgagtttcttgcctatgagctagagaaacaccagtaaaggagtaaccctcagatcagccagtctacccttctagctgggtggggcaggtggggtggagtggggaggaaaatgctattgtaatttattttttaagcattgctgaggacatatatcttatttctccacaaattgtctcatgagaggtcattaaaaacaatgaaaaggaaaaatcgcacagttcagtgtttctcttttaaaagtactgatgacctctgcttctcagacagaatagccagactgcaacttttctgagaaattctgctaaacaaaaattgattcctgtccgggcacagtggttcatgcctgtaatcccagtgctttgggaggccaaggtgggtggatcacctgaggtcaggcattccagaacagcctggccaacatggcgaaaccccatctctactaaaaatacaaaaattagctggacatggtggcgtgcacctgtaatcccagctactagagaggctgaggcaggagaatcacttgaacccaggaggtggaggttgcagtgagccaagatcgcgctgctgcactccagcctgggagacagagcaagactccatctcgaaaaaaaaaaaaaaaaatcagttcctctttccttcatcctcaaatgtcctcaatccagtgacatttgcaaaaactattgtctttcatatgtaatgtgtacatttcaatgtctctacatttcctctttgaatattagaatatcatagactacaaaacacacggtggccatagtcatcttttggttcatgataaccacaaatgtgttccgaaaactgcataaatagaaaaaacattgcgagaatatttgctctaaacactcctaccctcccactacaacatcttttgattttctcaaatgtcttccaccactggccttaaagagttaagctgattactcattcactaccaagggaccggcaagaaagataccaaatgtcaacttcttgaaagaaaggccttctataaatccaaacaaacctctttttaaaaaagaaccaatagccctttcaactgaagaatgtgatgtgggtctcttgaactctagaatcctctgatccttctgaattctccatcatccagctcacctcatttatgtttctgccgctcacacaggttcacattcagaatgccacccttgctggaggagttgctgtgggcacttgtgcggatatggcaattcacccatttggttctatgattattgggagcattgcaggaatggtctctgtgcttggatacaagttcctgactgtaagtacagcagatgttctgagtcaaactctgaatctgcaccttttttctcacatgtcccaccagcagaaaaaaagctactaagttttattttataaacatttttatttggagaccatttgccttctttttggaaataccactcccatttcagtggttcagtggttctactctgccctgacttctgtgtaacaggaaagaatccagtatcaattatttataatttagtttgaattaaatgttaagtacatggccattactttcctttgggactgctccattgaagttgttgttgttatttgtcttatgtaattaaggactctgctcttttaagagatttaggatgtcggccaagcatggtggctcacagctataatcccagcactttgggaggctgaggcaggcagatcacctgaggtcaggagttcaagaccagcctggacaacatggtgaaacccccgtctctactaaaaaaaaaaatacaaaaattagccgggcatggtggcgggtacctgtaatcctagctactggggaggctaaggcaggagaatcacttgaacccgggaggtggaggttgcagtgagccgagatggcaccattaccctccagcctgggcaatggagtgagactctgtctcaaaagaaaaaaaaaaaaaagagagatttaggatgtcatcagtaggtgagaaggagtagaatgtgaaatgattcctttcaaacccatccactaaagactgaaatgggcagttttgccacaactatatattcaaatcctttaactttaagtggacttcagatatggatggagaactgtgctctacgtaaaatttcttctgggtggagaaggaaatggggagatgtagttcagagaatgcaaagtagcaggaatacaggaggaatatgcctagagcgctaatgcacagcatgaggattataggtagtaaaattgtactatatatctgtacatagaatttattctaaatgaggagatttttagctactcttaacacaaaaaaacaacaataaaagtaactatgtaagatgttggagacgttaatattcttcactatatgacctttttctctctatatgtatctcataacatcatgttgtataccttaaatatacataaaaattatttataaaatactttttctccatggaagaatagagcccagctatagctctgtttcagttctagagttctatatgtttaactaaataataaaccttcttccttttataattttagccactttttactactaaactgaggatccatgatacatgtggggtccataacctccacggcttacctggtgtagtgggaggccttgcaggcattgtggcagtagcaatgggcgcctccaacacgtgagtaaaagaatgggtttttcagcccctgtggtcccatgatgttttctctcactctgagaaatgggagagttttcattttagctgttctggccatggtttgtattgtctttactggagccaaagagacgcgcctgagagaagatcattagaataaaattatattggaagaggcattttaactgaaattgttaatttaaaaaaattaacagtgttattttaaatgtctttaccagaaacaactgtctcctagcagacagggaaatttgataatcacagtcagattatagaaggattagtctttttcttgatctctccaaaatggaggaggaggcacatatgatgagctgaacagtcagttccatccaatccacacaaagaaggatgagttggaataatacagaaagcagttggttctgcagaatcaacaacactggtatatggccccaactctgctactaactagttatgtgacctctgaggtatcactcagcatttctggttttcagtcttctcctctgtaaaataagaagattggagtatttattctccaaaatcccttctagctctatcagatgtagattcttccctaagttgggtataaatgtttacttaaatgaccagaggaaaaacaactatcaagcaaaccccagagaatggaagggatgccacaatattggaacaatttggtatgaatgtcatccatgtgaaaaagctgagaagatcatagagtccagatcacacagagtaaattaagaaaaatcagaatgctcaatttttttaaattgtgtgtactttaagttctggatacatgtgcagaatgtgcaggtttattacataggtatacatgtatcttggtggtttgctgcacccatcagccagtcatctaggttttaagccccgtgtgcattaggtatttgtcctaatgctctccctccccttgtaccccaccccccatcaggtccggctgtgtgatgttctcctccctgtgtccatgtgttctcactgttcaactcccacttataagtgagaacatgcggtgtttggttttctgttcccgtgttagtgtgctgagaatgatggtttccagcttcatccatgtccctgcaaaggacattaactcatttttttttatggctgcatagcagaatgctcaatttttaaatccaattgaaagcatgaagaagagggaaatgtgtgtctagaaatgtctgaatgatcactaactagaggtgcataatttaaaaagaaaaatcttatcttcagttttagcagattaaaatttaaccctgttgagatcaataataataaatacttgaaaaacgcatttaatcatatttcctactaagtagtttgcttccttcttcatgtgtacagttgacacatttcttctgtattttttaaccctttttgcaaatttagaagacagctccagaatatgcacatctttttcagttcctgagactgtagagatcaaacactaaaatattttaatgcaaattaagcatgataaaagcctgtgtgaatgagctcaactcctcagtgttggagtgtgcatacactgtgcaaacaccctaagaggtgcctatgattaagaattcttgagcatcatgcctagaacagtttcacagatgcaataaaacacgtctatctggctctcaaaagggaggcctcactgggaggtcagacattggttaagtctcatggttgagggtctggtccttgggaatgcaggtttagaaacatctcaatttattcgttggtgggggtaggaggcagaggaatatcagaagaggggaaggggggcaagccttgaaggtgcattcacttcggtaaaatttacatatctcacaccaaataaaatactgcctgagaaccaaactacttacatgtgtctattcagaatattaaaatgcaaattaggtttttggtaagcatagaacaagggaaagttaatattcttaagggatgtttttgcaaattatagcagcataactctagtaatgctgttaattttgtataaatcagtgttttccaagtttatttgatcacagaacacttgttatcaaaaatatcttttaagaccttgtaaaagatcttggcaaattcctataaaattaacaggaaatttacaaaagaagaaaatcaaataagtatatataaaatactcaacttcactcataatcaaagaaatgcaaattaaaacaagctaccagtttttcacttatcaaagcgataaagcatgaatgaattaataataataataatactgaataatggctaaagtaaaaaattggaatataaattgtacaattttctatttggaaaagttcttaagaagtatatagaccggacacggtggctcaagcctgtaatcctagcactttgggaggccgaggcaggtggatcatctgaggtcaggagtttgagaccagcctggccaatatggtgaaaccccatctctactaaaaacacaaaaagtacccggcatggtggtgggtgcctataatcccagctacttgcgaggctgagtcaggagaattgcttgaacgcggggaggagacagcagtgagctgagatcacctcacttcactctagcctggcaacagagcgagactccgtctcaaaaaaaagaggtatatgtagccttttactaatattctcatttctagataggttttatattaggaaaataatcagacaagttcataagcatgttcagaggagatgttctcacagcatttttaaaaatatgaaacactggaagcaaccaatactttgcacaattcaaactatggtccagatctacactgactcacataaacggatccctaaaacatatttaatgtgaaaataagtaatatagtaagattgcattttaataaaaatacatgtttttattttacatttttattctgatacaatctgagggatattaaacttttctgcttctttttgttatctgcagtttctaatgttttcacaatgatatgttacttgtgcagtttttttatatattaaaatatgtaaacccttcagataaggagaaaaaaaaaggaatctgagtttagtgcatcctttcccttggatgatgagactggaagaccaaaaaaactcttattttccaattgttttattcattggagtcactcattcagtctttcaacaactctttattgtctgctatgagtaagctgctgtgctaagaagatccccacattcccaggtcatttgtcattcatataacacctttatgcacttcaatggccttttatcacattctttcattctcaaaattacaaagtattttttactaatttcagtttaaggcaatgacttctaagatgacatatagagatatacttgaatatcttcaatgagctatctctacaatatatgctgaaattagctttagtagctcatgttgttttatgtattactctatcctctgttcctagaaaagaaactgacagagagtggatactcaatatttattaaatgaatcagatcaggtatcaattttttgagagtgctaaaccctccctaaggaaagtcttatttccaaagtttacatgaaaagatgattctcttctttaaggtgtatctcagaattttctaacactgctcaagagtttcaaagaaaataagaatatgaaagaaaaattgtaacaaatgcttaatttgctgctgtgtaatgttacactctggcctgaagatggcagtcatccacaccctcagtgagtgagactttctttggctgagatccaggaaagacactgattcttttttgtttgcttccttaggtctatggccatgcaggcagctgcactgggttcctctatcggaacagcagttgttggaggtctgatgacaggtcagcataaaaagtgaacacttccctgtatcttatgctctcagattatttacaatagataattaatgagcaagtcaattgctaaattcaaaaatgttctaaacttctggcagtaaagtaattatgtcatttaaaggggatgattttataatagtatataagctactatgcaagtagattttcctcttcagcgtcacaacatgactcattttccctctaccgtcacaggtttaattctaaagttgcctctctggggacagccatctgaccagaactgctatgatgattctgtttattggaaggtactgtacagtattctaaacaagaatgtgaacgatgactccattagtgaaagctttacacacttcaagcctagatatctgtgtgcataggtgtgatgaaattgagttagcctggcatggtaggtagctcacacatgtaatctcagcacgttgggcggctgaggctggaggattgtttgatgccaggagtttgggtccagcctgggaaactctctacaaaaattataaataataaatttaaaatttttctttcaatgggatgtcaagtgtaaaagaaaaataaataaatgaaaagaaactgaatgaactacctatttatagaaagaaattgagatgatgtgcccagccagataaaatcagaagttatggtattttctaaagcagaaggaaagagaaagaaagacagacagaaagacagaaagacagaaagaaaagaatttagttagtaaatgttgtttcactcctctgagagccataaaaagctattcgtaaaaataatatgaattctcagaaatagtgtgagattttataccatatatagtccacaggtttatttggttaaaaacaaaaaacaaaagaaatttaacataattttaaactatgctatacataaaagtagtcaaaagcaagtgaaatatataaggttgaagaatttgagtgagtacacatcaagaggtcctatgaataacgaaacatcagcctctttctatcctccagtttctctttactctattgatactttttcccaaattatttcccgcaaagcttgagagggatagatgtttgggtgttttcagcaaaatttcagagagaatgagtttggaaaagcgggaatgtagtcagggtgggtgagataaatgttttattcttttatttttcttcaactcaaacaatttttattcccagttctttccaagcttgaataataattaccaaaaatatttttgtttcaatactaatttctgacaagaacagtgaaataaactattaagtgccctcaaacttgtttttttaaaggtccctaagacgagataacttgacaatcagttccatggacatggtgaccacagccagctggaacctgaagtctaaacaccattcctgctctccagcttcctttcccattatccagaatcaagtccaaataaacaaaaagggagtaaccaaagagagtatggaccagagtgaatagatcctaagtcccaaatggccagtgtaaaaatgtccttatgtctgatgctgtctcttgctcttcaatgattaattgaggggatgttactcataaaacagataatcaaatagatcttctccaggattcccaaaaagcttttggcagtgagtaaatacagagtaaacatgtcagtttcttaatgtagacactatgtcttcaatcccaaaaattataaaactgaaacccatgaagcaagaatagatgtgagaaatctatgtaaaaaaataattaaagaaatgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgttataaaataaaacatcagtctttgactctcctttctttggtagttggaattcatgtcagtaacaagcacacaggtgcacacacacacacttcatatttagtccacactcaatttaaatatttatcatgtatttgctatttttaaaaaatcaagttaatgtctcattatagaatgttgtaaaaagttaaattttagaaaagataactgacatcgtcaaaaaatcatttttaagaaaatcaaataacttattttttctatctggaagcttttaaagatttttcttctagccttggagtcctgaaatgttcccaagatgtatctaggtatcaacaaggaaatcagccctaccataattaacagaacaccagcttcagaatgaacttaaaaattataactaagagtggattatttaatattttattccttgaaaaaaattatataatttatattttattcatgtatattacttgacatagttgacttcttttcttttattttattttatatatataatttttattatactttaagttctagggtacatgtgcacaacgtgcaggtttgttacatatgtacacaggtgacttgttggtgtgctgcacccattaactcatcatttacattaggtatatctcctaatgctgtccctccccactccccccaccacacaacaggccccagtgtgtgatgttccccttcctgtgtccaagtgttctcattgttcaattcccacctatgagtgagaacatgcgatgtttggtgttttgtccttgcgatagtttgctgagaatgatggtttccagcttcatccatgtccctacaaaggacatgaactcatccttttttatggctgcatagtattccatggtgtatatatgccacattttcttaatccagtctatcattgatggacatttgggttggttccaagtctttgctattgtgaatagtggtgcaataaacatacatgtgcatgtgtctttatagcagcatgatttacaatcctttggcatatacccagtaataggatggctgggtcaaatggtatttctagttctagatccctgaggaatcgccacactgtcttccacaatggttgaactagtttacagtcccaccaacagtgtaaaagtgttcctatttctccacatcctctctagcacctgttctttcctgactttttaatgatcaccattctaactggtgtgagatggcatctcattgtggttttgatttgcatttctctgatgaccagtgatgatgagcattttttcatgggtctgttggctgcataaatgtcttcttttgagaagtgtctgttcatatcctttgcccacttgttgatggggttatttgtttttttcttgtaaatttgtttaagttctttgtagattctggatattagccctttgtcagatgagtagattgcaaaaattttctcccattctgtaggttgcctgttcattctgatggtagtttcttttgctgtgcaggagctctttagtttaattagatcccatttgtcaattttgtcttttgttgccattgcttttggtgttttagacatgaagtgcttgcccatgcctatgtcctgaatggtattgcctaggtattcttctggggtttttaaggttttaggtctaacatttaagtctttaatccatcttgaattaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13200 - DNA, 28494 bp, Human
cctggagaatctgaacttccaagtctataatatttatctttcagattattgatctggcactgattttagttctagaagtcagggggtgtggaacccgtttcaagtcccaccacacaataagattaagaaaaatcccttctcatctcctaactagctctggaagcaaagaagaaaatctttgctgatgctcctagtgaaaaatctgtatagattgtgtatgatttaaggttaacatttaaaggggaagaaaggaatggagagagaaaggaaggaacgaaaagggaaatgaaggaaagaaaaaaggaaaacaaaaaggaggaagaggagaaaaggaaagacgaaacataaaaaattcaaccggaaataaggggtttatttctgaagttccttctgaagcaccttctttgtgttcttttcctttgacttatctttaaaaattaaattaaaaatctgcagaattgtttattctgcagttcatgaagcttctccttggttttgattgaatcgacgtccaacaaggttgtccggagccctgtactcaaacagcgtccatccctgttcgcgcagagctgcacacagcagtcctggatttaaagacaatcaccctttgcagattcactctcaccaggcttaataacttccaccccaaattgccccatccctcctcggtccctcctggcatttcttttctgtcccaggcgcagagatcctcttctgggcgtctgttccggctatgagaagctctccgcaccctgaaagggagtagaaaaacagaggggatgggaaagggggaacaggggaacagatgagtattcatttcatgataaaattcagaatccctgcgccttaaatggtgcccattttctaagtctggttaatattgttcttgttgctgatgatgttttcctttttaaaaactatatgaatcatcttattaagaaaaattatacaaaaaaaagaagaaactccacatgcactaaaatatttttcactatctctttgaagacattctgcttaaaccttttcaaagattcgggtggccctttcttgactctccatgattaaaaccacttacaagtcatacacaacagatgcaaatataaaatgtccttggcctctgcaaaaaaggctcaaaattaaccttgtctgaacgtgtgcgtacgttgcttccaacatctgaaaaaaacttgataaaatggagactccagccaagaggaatggtgcatggaatccgttgaaaatgcatacaaacaacacctaaaataacaagcagcacaaactgaggtgtatttaagtttccaaaggttttaggtaaaatgaccagaaaatattagaaatggtcatcaacggtggctagcttttttgttctatggtgacagagataaagttaaaaaaaaaaaagttgtgtagccatcaacacagagatagtccttaaaatcccccatatccagcctttcaaaatactctcttccggaacatacatgaataggagggagcttttgtgtttaaaaatcttggtaagtgtccccctttaaaatctacatagaaaataggggactgatggcccctggtttctcattatgaattgcaaagacttcagttagtggctacaatgatgtgtcattttcgatatagaagttataaaatgtatatattatattaatcaccctgaacaactctttgttaaatgcacatttggagtctgcagactgtgtgacccagaggtgcttatataactatatgtgggtgtctgggtgtaaatacgggtttatgatttttatagtatatatgtctgtgggttgcatctaactcctgtgtgtgcaataatgttttttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgaggtgagtcgacacccccagatgcaccttagagctttgcagatagagaatttgagcttcttgataccccaaatgatatatatttttaagctatttactcgtagatttccggtcggttttctcagctttttttaacttttagaaaagctggctagggaagacttcgctgctctgaaaagggactttaaggctgaaatctgacaactttaatttaggaatgtttttatttattttatttttctttcccttttcctcgcctccccccaccccaccccacccttttaagctctgatggggaatgtggtgctactgaatgtgggcacgctctcagagaaaatcgagattctgataaagtcaggggcttttctcgttttaagtgtggaagagaattgggttttcaagcctcatttgtaacagactcgggcttttaatttttattttcaataaaatttctgaaattgataacaaatggttccaagtagaggacagagaattagcgggaaagaagtagatggctggagatatggatggatagagcaaaatagaagtcgtagcagtttattagtttctgttttcttgtgttttgcttccttgagggtcactgcgtccgaacagaaatcgcagccgcctcctgtgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaactcgaggcgggcgaagcgggccatggagattgctaagaggaaaagttggagagaaaaggaaggaagagaagcagactcccgggtggcgggcgcgggccgctaggtcagacgaaaggtggagggatgcagaggctccccaaagagccgagaaagacacgcgacccctccggatcgggacagctcctgaaagcccggcgcagagccgcctcgaagatcctaagagtgggcgactcacaggcgcggccggcaagctcctgggggactcgggctcggacgagcgcccacagtcagcgcctggcgcccacacctccttcccccccccgaatcctaatgttggggtgtgtgtatgtgtggaggtatgtaggagagaggaggaggagataagagaggagagggagaaaagcaggagagagcgcgagagagcagagaggagagagattggtcttgttgctgaatgatgcttggggttttccttttctctttgtggttgtgtatcgactgtaacgaagagccgcgcctacgcgcctggtggggattgtttcggttcggcctccttttctttccttaacaggcgggataatggtaaagtcgaaggcgctagaactgtcctaaagaatattagcgcccaaagtgggcatgacattagcaagcacggggccatggtgaaaacagctcaagctatatgcatgcagaggcatttcagtgggttctaaaaagtaaccagggtaacattcgttctttacagaaagtaaagtagctaaatggaaaaggaaggagggagagaagaaaggagggagggagagaggaagagggaggggtggagtggaagggagggaagagagaagagaaaagaggggagggagagagagaaagagaaataaacagggagagagagggaatattacaggtggtcctatctgcctaaattttctgctcaaaaaacagaatccgcagctcggtggaaggagcctatttaagtctggactaaggttgaactttaacagaaatggcagtcaggccagttgaacgggttcctgaaacatccaaaaaggttttctgttgcccctggctttgcctggaaaggataagtttagtgtatttgaagattgatggcgtatgttttaaattgaggtaaaaatcgcaaactatgtgagcactaaacaggaaaaggctgcacaggaatgaaaagcctccatctcgcttctgtcctttaacaaatgagcataatcttccacatttagcaaaagtctgcaaaagtcactgtaaataaccaggcccaccaatttgcctttctctcgcctccaaatgatgaagcaaccctttttattttgtttttgtaatcctcacacaaagcacccaaggcgaccaagtcctccggattagggaagtctctctccaggtaggaggacacctccattctatacaacctcccagcactgttctccctcactgccttatccaaaggagcaggggctgctttactcgtgtccccggcacagttaattgaagttctgcctctttcctgctaaactttttccccagtctgcctttgccagccccctcgtctgattacatctagtaattctccactgaatgaacgtcatttacaatagtaggggagctctgcgctcgctgctgcttcacgctccatttgtcctctattctccctttaaagtactcgtgtaatattaatagtcatgaatatcaattattatgaggcggtgtaggcaagcggagggaggaaggggcggccgagcagtctgagcccagcttcgggtgaaagaggactgcatctggagccccgaagaacggcagaagaaaagaggccaaaaagacagcaaagagacagatgaatagttctgtctgtgtgtgacaggcatcgccaatcttgttggggtggggggcgggtgtaattttttttttttttttttgatggcttgtcctggaaacacatcaagctcagctcctgtgtccagctcgcttctctgctggactccttgattttttttttaatcattgtttgattttgagcagtaaccaggcttttttttccagatgttagtccacacctattcatccatggtgagtttggattcacgtgttaccagaattgcatgctccctcctctcactgtctctctgtctctgcgtctctgtgtgtgtgtgtgtctcacactctctgtctctctctgtcttcctttgagcgcctttggcttggtaatttagcaccataattggacgaggctgcagctgcttctctctgcattgtgtgttctccgtctgagctccatgagtcagctgggaggggagaggccgaaaagaaaaactttttatttgccattgctgtttggaaatttaggtgactatttctgcaaaaagaaccatggggagtttaccatgatgtttccagagaagagagggagaaacaaagtccacctccctcatatacacacctcccccttcttctttcacttagttcacactccagataggaccaggaataagttgtctgggcttttatttccccccaccccaactttagttccttcattttcacatcctgagtataacagcattagatatagaaaaacagtcttagaaataactcctatgaaccacaactcaacttaattcatcattggcttaggatatgatttcgaatgagatccatttcaatgaaacactatttaagttatttaatttctcctggagagggaggagtgactgggaactcagaccaggtggattccttggagctcttggaatgatcaggttgtgtggaaagctcctcctaatcagccagctgcatttccagcgaaggcagaagttggtttttaatcagggggagcagcacagcaaatactatgaagttttatttgttgtgatttgtacctctggaagagttagaaaaaagtagttaaaaacacccagaggagcaaacaccatatgtaagactcctacaattttaattaaggcatttagaatctccctccatacacactgttcctgtacccctgccttttgcctgctttgcactccccaaaaagcggctaaaatgttatagttaagtgggtgattcctttcccattttctccccaagcctggggtttgaaattgctgaaatcatgtggccctctgagtcaacttgggggtctaagtttcagatccttgcttcccttgtcccgggaagagcgtacaaaagccgggcttctccatttgtcacttgtattttttttcttcctctctgtactctctgtctctctctgcctctatctctctttctctgtctccttctctggctctcttccccttcctctctccgctcccaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccaggtaaccacaaacaaacaaacaaacaaacaaaaaagaccacgaataaggaatgcttctggagggggggaggtcaggagagggcagctctgtctctttttggggagtttgttcccatgtttagaacaggactagacagtcatatagaactgtttatgtgtgtctgtatgtatggctctatagtggcgatttccagaggtctaattatgatcatccaaaccacgagaaattaaatcttgaagaagaaaaatatgtatttgctttgataccttaagattattagaataaaggcgaatgcttttgtcctgcctcagctaccatctcctgcatattctctagtgctttgtggaagccagcttggtaccccttctttaccaacacacacaccccatagtggggctgtcctgctgacttggcaggtgaagacctggctgcctagaggctagagcttcagaatgaagttccaggggcctctgtatgctccagaggttgctgctgaatttgcaaagattttgctaagcatgacaatgagctctgatcatctaagccaggtcttgctttgaatgtctcataagccacagagcttttttccaagagatagttgcagtcctcatctgagaaatagaatatatgtgaaggagaaactcagaacgccataattcaggagtccatgatggtagataccattttggaaattcttttcactttttggttcattaagtgactgtagtgtaatattctccacctccctctcctggcctccgcctatattaacactcttctctccccactgccatcatcccagttgagaggcatcacgtgtttatttcttaaaacaaaaggctcaaaacactccccctacccacccactatcccatctgcagtctacacaatggagcctgatttggttgagaatacttggttaaactaaacaaagaaacatcaaagaaatgattcctaaaaactgtttgggtgattctgagcaggtctgctttttcaccctaagttaaatagttggcagaaaagataaatatagtttacaggtatgtaattgacacttcagtttcattggcatagttgtatttattatgcatcctttgacatacctctgaagcaaaggaaaataaaatgggaaagagaagagggtgcaagagtcattcttctgtaccttgctgaaaaaaaatagttttaaacagttaaaatgtggtgacagcatcaaatgctgtctgtgtgtggtctatgattgtttattgttttaaaagaaattcagttatttatttttttaaaaaagacggaattacctgatttgtgcctggatttactgatagtaataagagtgatgatggttttgttgatttaactgagcttgactgttcctggctagagatattgctcatttctgaatatcatatgaaaaaggaagtatttaatagttttttttttaatgcattggggtaatatgtgtctcgaggggaaaagtttttaaattaacctttctgagtatggttcaaagtgctggataatgaaagtggatcaactcatcaccattactgttgatgatgctaatgccggccctgttaccaccaccctacaggccaagtgactctagcgaaggaactcagaaatttttcccccaaaagaaggagcagttttctttagttaaatgtttttaaagaaataattgagagaggtctttttgtgtttggtgaaattcaaagtctgagagaaaaacagggccagatcagtgcacatttgggagaatagtcttgtcaaagcgtcggaaaggatttagtgtttatgtgaacggagcacctcggggccaagttgttgctgtcgggaatacagaccacagaggtagagagctgaaaggagaaaagcagcaggcagcacaccggagccacttgcaggctctccactcacccaacccccaccctgttcctcccctgctttatctcatttcgtcacctgccgggaggcccacgggaccttcttgggacgacccctatagtgcaagggacacaccctgctcctgtccctagagggaaacagcaaagacagggacggtctctgcctccgcggtgatgacagacctcccgaggccagggtgaagttgactgatgcagggcaggtgacaaagaccaggggttatgtttccaggaccacagcctcgaatccgaaggcttccaatcatctgctcaacacagaaggatccacttccgagttaggaagctggggtgcgggggctaaagttacacaagcaggttgggatttcaacgctctccctacagctatcgaatgggtggcctgcactggtccagtctttaaaagggcctgcactggtccagtctttaaaaggaccagagagtgcctaggcctggaccttaaagtcacttgttccgatctcaaggacctcgtgtgtgttccagatccccttgagccagggagctggcagacactgagggtgctgccctgcctatgggtcgagggttttgttgtgtgacccagatgcaccacactcagggccacagcccccaccatgagagaagagaaagaggagagctaattcaccaaatgcttctaatatttttttaaatgaaactataaaaccctgtcaatttctatttcaatttactcacaggggctattaaactagcaaatcgctgtttgggttctgggtatgctacatttcacccattgtgcatgagcgcgcgcgcgcgcgcgcgcgtgtgtgtgtgtgtgtctagttggggagggggctacaagtgttaaaaactcaggaaaacacctacagagagagagacagagggagtgaaaggacacctagtttgggatttgtttagttgtcatgtacacctcttttcttcttcccacctttgctctcttacctcccatcacctctaccacccatgaatataaacatataaggatgttaagccaactccccccaaacacatacacacactcaaacacacccgagtgtcttaaagcaacccctggtatcacttttaactaaagaagtctagtaattacgagtctgagttgtttttctgcgcttccgcatgcagtcctaattaaatctttacgatcctccctgtgacgattaagcgccagcatgctgcgtgaatatcctgtacaaaaacccagcaggcggccgtaattagataggaaatcagacaagagccttctcattaactaccacaactaccccacgtcgctgatgaggcgtttatacatatttacgtacaagagtgagggtaaggtgtgagggctcccgggtccaggccagtgtaagtcagggtctggctgcccaaggcacaggagaatatttctgtcctgcctggacacattgtcactgtatacacatgatcatagaaaggtgtgaatcgtgtgtgtttgtgtgtggcagggtcccctgaggagttatgaacaagttacatgaaatatttttaaaacacctttttactatttcctaagatgtgcatggcatgttgcagcaaggataacaattcctatggagaataacaattttgctcacttttctgagaacaaaagagtgactattaaaaatgaaaagaaacaaattaacatgccccctgtacgattagatcatctcatttctaaagttttgcttgtttggggtagacagtctttttcttgtgatgaactcacactgtgaggatgcagcatgagtcggtgtgagtgctgtgaaaacagctcctcactctcaagccctttgctttttacttctctataaagtgggtaacaatttggtcccaacttaggttttgaagggtcaagaaagtagttgtagattttagaaagacctagcatttattttcttggtagggagagaaagggaatctactgcttttggacgccctgggatgcacagccagaactgttcatgtgtattctgacagtaagaaacttgctccaacagctatttcctctcagaagtgctaccagtgctcagagttgaaactttccttctctggaatgaaactgtggcacagaagatgaacattccttgcgattacctaggtgctgactgggaggatctagacctttgtgtgtgtctgcttgtctgtagttactgccttcctaacaggtgtgctccttgctgggaagcagcatcagcaggactgggagggagggtaaattgtgaaggttcctccaagagactgtcattgtgcagcaagaagctcatagtttacaggaacgtgtatgggctgtaatgggtgtgcagtcctagaggcttgcaaacatgttcctatgtgttgctgtttgcattccattccaaattgctcagactttaattaaaatcccataatgtaaactattatgtatttgtaaaatggctctggggttaagatgcactgggatagaatggaaaacacaaattgctcttactaatattggtgaaaatctgtcagctgttgccaaatttttacaattcataagagcaaataatataaaggtttatctgtctaatatctatgttttatataataactaaaccaatgttgcatcccagatgtctctcaaagttttctttctccacttcttccattggaaaaatttataatttgagtaaatttcatttctatgtctatttggaggtaataataataataaaacagccctttgtgaattaatataaatggaaataacagaaactccagtttggaataacatgatttatgtgtgcaattctttaatatcctgtcaatttgaatagtgatgtttttatattcacagtcagttgaagatgccaataacagcggcatgaatctattggaccagtctgtcattaaaaaaggtatggataattccccccaaaaagtaagcaaagttctctcatgcattaacgtctttatgatgaattttcactttgggggaattcattatttgacaagacataaatgtttgttcacaattataggacaatggctgtcagattaggggaaagggcatgttgggaagatggaagttgggcaagggagaatgaaaacatcagacacaaattcagatgagtgagacagactgttgcaatttttctcatggcatatttggtagccattcttgatacatcttaaataattgagctatcatcatgtgtggaattggctggtaaacactggtttcaagaaggtgctacaattatttcaatgataactggagtttgctgagttaaagcttatgttattgagatagctctttcttcgttttgtatttgatttttttggtgataattttgttcccagttctctatgttttatgagttgtttttatttatttattttttcattgtgccaaatttgttgctaaatatgcgcatcctgagaagctgagacagcctatgcacatttctaaatcttcctacatatgcattcatgatttagtgtgactgtggaatcaccccatactgttaaagggcatgtgatattaacaaatgtttgcagtctcttgtacagctgtaagcaaaataattaactaattaaactaattaaatgtaattacaataactcattttgggtgtattgcagctgcttaattttttctgcttttctctgacagtcactgagagaatgcctggcgattagtgtagctgctaaaaggcctgaatgtcactcaaatgccacaaatttaggagtttaaatgtgtaaacagtgcaatctttaattatcacaggaactggcatttgacgatacagttttaatactgtaaccctttcttatggatgtcgaagaaattctgtctctatatttagtgtcaacaatcctcagctttcaatcatttatgattcacttgagccacttgacattcaacaaaaacaattaaaagaaaaaattctttgggaagtaattcatccagactcaaatgggatagtaggagggttgtggaataaggattccaaacagggtgaggtattctaaattgtcttcttttacaaagtcaggaagagtagctttgaaaggtgggtgggggaagctgtacttgcaatgatgccatttggccttggaatgaatatcctaaagtatagtaaggtttggggcataactatttattttagtggttgcttcaaacatctctctctctctctctctcatcttcaaataatattgttttggcttttaatgccagcttttgggtttgctaggatacccaggctcggtgcttaaatttgcaactgtgctgactgacagctcacttttcctgttttctcttgggtctcctctttcggttaattgctggttgattagggtggggtcggggaggagcttctccattggcttttttcagtttgttttagttcctcctcccttttcatggaaagctagaaccacttagctcagggttctgtatcctagcaacatcatttgggctggcaggggaacatgcccaacagatgaccaatcagaaatgttattaatagccagtccaataaaaatatttgtaacttagcttgcctagcaaaacagagctgaagattttcttagatgtgggatgctttggtttcagagcttgtatatgtttgtcagtgaaatgtgaatatttatgtgcaaggttgtctccaggaataagaaaaagagaataatgactaaagttgatggttctgtttttggaaacagaagagtacattttatgtccccccaaatgtacagctttttaaaaaatgtgcagcttaaaatatttaagtagcatcccagttactttaattgattcagagggtgtggtatgaatatgatgaaatggtaggtcagttgcattatttaatatttgacatatttgctttattacatgaagaaaagatcctatgtcttttttctttagagagccataggcaaaataagaatacgaggttgatttacttttctaactcagtataagccacttaaagttgtggtgagttcattagccccttcccctgcaccctagtctctttgctcaccatctccccaattatgagagatgtttccaagagatgaattttgtaaaagaggtgagaaagtcttgtgaactaaatattctaaatttcaacacctagaagaaggcttagtttcttaatatattttctaatgggcttttaggcagataaaaaaaaattctacctcattagtaacagattggcaagtggtctaggtttgggggtctctgagtctgtgtttatgaagctagaagacttaggcataaatgatgcatgtctctatctctatgtctctttctccagttatggtaaggccccttctaaaatttaaccaatctaatttttcacctgtgtttatgtcaccccatagattatgggctccctctcttgttatgtttgctatctgggcttagctgacatttctgaagtaatttagttaagaggaaatgagttgttcccagtagagagagcaaacgagtggagtgaaggtagccagcgtgataaatggctctttcatttgaagatctccagagctcgtttacggctaattttctgtattggccccctttgagctattaatgcaatctgcagggaccgtggcccctctcctcttagctgccccattagagctcccattaagctgcctagtctcaactccatggcgggagtgggcggggggagtaatgaaaggtgctttttaaactctcctaatctaaaccggcagagggtggttaatacgatttgaagggggctggtcaatgagcaatcaataaagtaataatgagaaggattcggtacattaacagtctaaaaatccaacgagacattaaaaaatcattcttaactctcagttccattaagattagaaatctgggggggaggaagagggtgtacccagctaataaaaatgatcactgccaccatcatgttgcttaactcaaaaaaaggctcacctaaactttaagaaaaagtttttggtgcaataagaagccaatatgcaatctgtttaacaccttagacagcagaaaatattctgggatttcttggaaaggctagcgtggctggaatccaaggttcaaatgttgtgactgtggggcattttcattggtcttagggatatcctgtttggttagtttcagttcatcctccattctctcccactttctttcccgttagttctggccccttccccacataaacactttgactggtgtggattttctttcatgggaaataaagaaattgccaaatttctattacaattgattctgttgggattcttctgacctagaaggtaaaatgctctgagagtctgtcagagtctctgaacggtatgagtttcctctcaaaaggaagaagttcccatttccaggttggacttggatcccaatagctatttatcaactagagaccctgagaaacactgcagccactctttcaaagtcaggtaggttagacattcttcttcaacactccaagtgctgaaactgagagagacaataaatgactttctcaaggtcctatacaccatgtaagtgatgagactcaactcagtttccagccttttagccttctagactctgtccctataagatgccaatactggatgtttgagttttttaatatccctgctttatttgtggaaattatttttttccccacaatttcagtccccacacttatacatgcactatagttgtggaataaaattttacactcaggtacatgaggaagtgtttagatctgaggaaagggtgctttgctggtgagaaaaagagtgctaacttttaggggccactttgagtcagtgctaagcctcctggttgtttcccaatgtcatttacatctttaggtcaagagtgcctttcgaaggtacttaccttatgaatctataagataggttcatttcttcccttctcctcaccagcagatagaatcaaatacaaagttctcaaaactataatttcacacttaagtttaaagagtagagattaaaaactagcctattaacactttagctcttctatagtcaactaatgaatagtattttctctaatcatttttctttcctctcttttaaataaaactccagccatgttaatgaaatattgatctgtttttagcctttttttacttctccccagcataatgcagcaaaaaagggaggggaatgagttttgtgggtgttacatccagaacttggccttgacacccaactgggaactgaagaggaaaaaaatacttctaatgtatgcacagaaaattgtaaacatgtaaagaactgaaagcttcatgctgagttttgccatgccccatttccttactatttcctgctgtcgctttaaacctatctcagtcatctctgggttccatgagcaggaacagtgtgctcataattactaacaaatcaaccaggccctgttgagctctgggtttattgataaactggaagaaagcagaagggaaaagacaaagaaagtaaaatatggggttaatcaggtgaactaagcaggtgtgaaagtggaagggaaagtagattatgatggagttatggatctaaaggaaagttgggacaagaaatgtgtcagatctggtctaggggaccaatactaaggagagaggtttagaacatgaggataggaggctgggaacacaattgtgatacttaaattagaaaatggaaatatagtccaaagcacatcttctgacattgtccttgctttgactggaaggggaaaaaacaaaaacaaaaacaaaaacaaaaaccttcccagagagggcagtgtactgacagaagctgattggattgggggtatgcaggtgataatgtatatgcagaaaggtactcaacccatggcagggagcaatatacattccccaaaggaaatagctcttgtcgggtgaatcaggcaattaacaatagtgaaattacagggtggtttataacatttctttaaaggcccggcttttccagaggtttagcttctgggacagggagaagcaggtaagattccaatactcagtgggtatttggttatccactgtgggaagcaggaagtgaatttagtactttcagcttagtggagttggttgttatttaaaaaaatattctaaatagtatttagagataaatatgttgctaagtatagaggtgagatttttatctaatttatttctataattcatatcatgttaaaattacaaagggccatctatattttggaaaataagtttttccaagttttcataatgccaactcccatgattgtcaattatttgtttttaatgccttcactatgagtctgaattatggaaatcagcactgttgtgaagagtaagatagactgaaatagatgcccccaccaatcacctgtctattaagtgactttaacttcacatctcactcaaatctgattaacattcacacttcaacttttcattgattcattcttaaatgggaagcagattcactgatgagaaaatgagggaaatcaaaaagaaggaacacctctctatatcccctgtccccgccccatgacagggcagaatatttactctgttgccaacatcaattcatccatctgggacaaggtcttgggctctgtggacagatccatagatcctaaaatgcctactgggtagtagcagaagggaatgttttagtctcctcatccactcttgtaataaagctcttttccacaaggtgtttgtaaaggatctaatgaaattcatagtaaataaaagatttgggagcaacctggcttctaggagtctctaaacaactatggaggtttgtatactggaatctgtggtagagagaataaactgttagagaaatacacagtattggttagtctgttccatagaagggatgttatgcatcttgtttgatatatagggttctaggctccagacgacagaaacagcctatcttttccccacacaattacaaagtgagatagactttatcaaataggtagggttggaaacctcttttttcacaccagatgcatgtttccatagattttttggactggtgatcgacaaataccatgaagatttggaggcctcatatcccagtggaagaagcaaagttacagggaaagtcaggaggtatagccacctgtttaggggcctgtaaaacctacataaagaaaatgggcttaagcagtgaagtccaagggaaaatactgccagggaactgggagattgactgttcctcattcccagccttctggttccactgagcctagcctctttctgacatgcagatgacactgaaacacaattaagcagaaatacaggctggagaggctgaatgcaccagggtagcagtggcaaccagctgtcaactcttattaacttctgcataaaacataccttgagtgcggtttgttatcaattacttgccgaaaagaaacaactggggcaaggcaagaccgccgctcatatgaattagagtgattggttgattgatcagggcacctgttgtaaatcataactgttccaaacaatcactagccggtgctttaatttgtaaacaaaattcatgtcactgcagaattgctttcactgaagatgagcatttgggttcctttctaaatgaatctgttgttattatgtagggaagaatggggcccactttaaagagatgagcagctgttttgggcccagctccccagctcaatggtattatttgtctgttcttgggcatagtatctgatggggtccaccctccttatcctttctagtgatgaccatagatctgggtccaataggaaaggaggaaggggtttccattggaattaccattttatatcaccgcatggtgataatcaccgtcaggcttcagcaccaaatgagataggcattattatcctcaggagacagataaggaaactgaggaggttcagacagagtcagtcaggtgtctaaggtcacagagttagcacacgatggaataagatttgcctggttcccagcacagtccaaactctgggttgtttgatttcttgatttgggtagtgagcaggactgtagcaaatgacactcatatgtctacacacgaagtaagtttccagaggaggtatggctttgccatctgtttgtttacagctctctgaacgcactgcagccccactggaataaacacttcctccctcagctttccacttggtgtctgtcctgtggcctcacacagagacacattctatcagccggtcatcaggatcgaaacttggtcacctttatggcaattttttctctctttctagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaaggtaaccccaccacgaaaaacaaaaacaaaaacaaaaaaacaaacaaaaacccaccagtttttatttattggacagtgaggagaaggttccagcaaaacccaatctgcagtctgacgcagttgcctagcaaccgggtggccggagcattgctttcgcgcagcgcttgggaggatccgcggccgccacctgctcgcccacaaactctagtgtccttgcatccaggcctgcccgcgccgcgcaagtcctaccgcagattttgccgccctgggaacctttcactttcctggccctgcgcctggcgcctctcttcctgtcacccctaggacatctcagggggcattctccagcctgagtacaacgcggaactaacagccccccagcccccccacaaaaaaccccataagtttcatgaagcaactctcttcataccttcagtgtactctttctcttttattgcatgttttaaatgcagttggcacccagtgaaattggtctttcaacctgctgatgcactgtaacccagtttgataaactctttttctaaatttgtgacatccctctttcaataacaccaccaccaataatagcaataatatcactttagaagtatttataggtattcctgggagccattcaggtgcttcacagtattccacagcccagagactgactcctcctcgtggaaatgtgagagaatgtggattttatcttaagatgtaatgcctcccttgaagtccctgccaatgcctgaacactttggcagtgtccctgatatgaaagtgactttgtctgagacaaaactttccaagatgaccccttctgggggttgacagtccttttctttcctaaaagtgactgtatgaatagtacagcaaaagagattacagtaactgaggatttttacttgtacttttgtccatactttagcacatacaaggagaatcttgggagaaattaagggtgtgacccaggaactttctcattttgaatcctcttcctctgccctcctttgattcagttttcaagtgagtgctttgagcctcagagtgtggaagttttcaatcaccccctgaacattaagcctgtatatataaatttgcagagatgaagtaaaataatcaatataaagtgcttatcacataactacacttccaaaagtgttagttttactgttattatgatcatcaccatttcgatttcagtctgccctctccttttaacataacaccatatacagcaactcttgaccccttcctcacaaagcccacctgttgcagcaagtgcgctctcctctctaagccacctggctcttatcctcttttcagcaaggttgtgcttgcccagtttctgctcacctcactaactccatgacaaggaaggaacatgcacgtgcatgtgcagcttctaccttctctagacccataacctacacctaattattcccatctggtatcctttttttttcttttctcacaagataaaaaaagaacactcagttaaaaaaaattctctgtattgcagaaattaagcaaacctcagcaaactatcagcaaataaccaaaaggaagggggaaaaatgtgctaacctcaagttaaaacctcttcaagctccactgggctttagattgctaagtctaaactttgtttcaggaacactctaaggttaatcagaatgttaattcttgcaatttcagagccaaatcgaaaaatggggggagatctttgcgagaaaggctagaaaaaatcggtttgaatttacccgcgggcaggcgcaaagcagcaaatgtcacgttactcacctccctggtggaaggtaagcaagacgtgtggccatttcacgaagtggctgagcttaactgtcggctggaggctgacattttacacatttcatgattaactggaaatcgttgtgattgttgtgctcttatgagctggatgtcaagcggctgcttgagagaggttcaaaggtccttttacttagaggaagccagcagttgtagacagggcaagggaagtatttgagagttcctgtgctctgaaaagtgctcaggtccagcctccaagacaaagcaggggtcactcctgctgtcacgtgcaggacatcctctatgtgaactcttgcaagagtaactctttaagcaataattcattctataccccttcaccttgccagatttgaattgtcagtagtagaaaacacattgcattcatgacccctaatggttattttaaaacttttgtcactcctagggccaaatctgcagattacctgggacatgttgttattgaaatattgatagcttagtaaggccaatgatagctaggggaagattggggaggaggggtgaagaaatatgtaggggagtcaggtattatcttcaatgtagattcatcaattgtgaattatagggtgataattgcaataagcaccttataatttgctcatcagtttgggtttggggatgatatttatggtatgtaataaacaaaatcatctacacagtccagaacaagaggatctgcagttgaatttgtgggaaataatatgaaatacagtcagatggtcctaatggaggaagatgcagaattttctctagcatctagcttgtaggtcttgtgttttaattccatttgtatgggtgtaatattatgatgctcctgtagagagttggttttagaagatggaatattaaaatatttaggcagcaaccattaatcatcacagttacaggccttatacttggccatttttaaggcaaagttgcttggcctgaacaccctccagaggcaggaatcactgaaatttccagaccacacttactagtggttgactcttagcctggaagtttcacattttacccttcagggaattgctaatatcatagtcctcattttggaaagcaatcaaggtaaccttagctcaagacagggatttcaggggagaagggaggaaactggaaaccccactaaaattccaatatttgtttggcagtttttggttttgtgactccttgtaagcaccatgcctgaagtcttttgttgttatgataataatgattaaaagtaagtcatcctccttaaaaataatgtagctatggggtatttcaacatatctgtttttcatgtatgggatctgtccttgaaccccaaaaggctgtgtttaaagggtaataatgctttacttgaaaggggctttcacataagctgagtaataccttagataccccagttttctgtagctgctgtgtcatctttgtgcagtgaaaagtcctgaagtaggaggatgatgacaggaacctctgaaggggagaaacctgaaacttgactagcaggaaaagtgacaaggagaattattatttcattgcagatagaaatactctttccatatacattttacatatagtgtttaatatatgtggacatatatacacatgggcttgtttttatatatttgttggaatacagttgtagcaagatgatggtcacttttaaattttatttaaagcaagtgtgacagatgctttaaaaagaaagaggaatctggcttaaatgtccagccaaatgtccaaattcaattataaggtggctcttgacaaaaagattagggtgtaggagaccccgtagctattcaggggatgtctagctaggagttggctcagggagaggcaggaaaaagagacaggagcaaagttggtcccaccaattttaattatagcttgagaatcatttttcctttaggcatctctcacctttgcttttggctccaacagctggccttctctggaaatactaacaaagctgacaagggaatgtctccgccctgggatatttagggcctgggtgctgattattacctttactgctgtctttttcaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagtgagtttattagactctgggccctcatctcactcccagctggctaggccacccgactttggagtaggtggtggggaggggcagagaaagaagccagagggttgtctagaagtagcatttgcagcctctggcaagcaaggtaggcagagttgatgggctacaggtttgtctcaggtgtcctctctggggaaaatggctttgttaatccgaatccagccttcttacaattctcttctatcactctggggatgtcaggcagatcttttctgagggagttcttgttccagctcttccctggatccgaaggtgcatatttctgcttgggtttcacatctatctctctgtcgtagccacatagccatgtgtgctcgctcagggagtctataaaacccacgtgtacccatctctacccacagctctaattactccgtttccaacgttgctgtttgtcatcttccacagacttgtaaaatttactacaactccagaggggaaaatagtaaatctctggctaaatttaggtctagagctcatttgaacttttacagtgggttttctatttatttgatttactcctgtctttggcttcggtgtcatattgttggtgttttatggccggctcaggcctgcagtgggcggcgctgcgtgcgcccgcacgtttctcttgcaggcgcggcccaaacagccgcgctcatttatttagtgttggaggacgcggtttgtcccgttgacagcgtaatttaaagaaatatatggaaggctgaaaaatcatttgctcaaatttgtccagatgtttttgagacgtgattggaatttgattgcccctttccgcagggtcaaaaaatattaatgtcccagaactttaattgcttacagaccctggtttgggctttgaagatttaaaatgtttgactctaagcatttgttctccccagttcagaatgtcttttttggcactttggtaatgagtacaaacttaaggaaagactttacccatctctcccaatgatcaaaacctggcatccaccctctttcttgaaggttttcatctgctgtatcaaccagcagtaaaatagatatttgtcagtagattgccctcctgccccttgcgctggtgtctggtgaggcacggggtgtgtgtgtgggggggatcagttgtgctttataaaagaggaagggtactttagggaaaaaaataaaaccaaactgtataaatcagataggacccacaaatgactctcatttctctaaggtatgcatctaactacccactgtccaagcactgtggcttctcttaggccagcacttctgaacctagggtatcagaatcagctggtgagctttttcaagatatttctgtatggggctatcctcaaatcttctaaattggaattactggaggtgggggcctgggagtgtgtgtttgaaccccacaggtgtttctaaggtgtacctcttaagagcttaaaaactgccccactttggtcagaacccttatctatttcttcctggttgtgaggatgtatgtgtgtacttcaaagggagaatcgagggtgcctgttagtgttctctatccacccatcttaaaaccagcaacagtttagcttctgtgactgggtggtattcctcatcagatttagccactatcccaaagtggcagcaccctaggaaaggatgccccaggattctttgagtccaatcacctgccccgtttacctgttggctaggccaggtgtggccaggtatctgtgagtcgggccaacccattgtgggtctaggactggagtgctgtaggtttatttttttcctaaaccccacagacccataggctgggtacaggcaggtggacatgagaaatctgcccatctgtgaaaagctgtggcctttgggatgctgtgtgtctgcctgccagccatttgaccttcagggctagaaccatcccatccagctcctatattaaaatttctcaaataagctcaatccataggtaggcacgcaggatttctaaggctgggagattcctctaaattgtaggtggcttgaggaaataaaaaccttcaacaaataaaaatctatcctccctagtgtcttaacagcctacctttaggttttatttaaactatatgggaatccttttatattgacaacagtctggttatacaaagattttcagtgccctacacttggaagaaagaaaggagggaaaggcagaaactagctccctcccccaatactgcaggtaaacaggtttttgctttgaatggaatcagcattctctagaataaacagtttcttgccctgggccatggaaggctccagcaatctgcttcagtgccagggacaggcttgtggccgaggggcctaaatctttcagggctttttgcgcctgatcaccaagaggttggagaggtgggaggggcgcgggggaaacagctcaaaagaaatgccaggtaagagctcaatattatgaagtattaaaaatcaaccgctaaagcctagcgaatgtcccaaagcgagtccaggcggtcccggaatggaggggagaaaggctgaagtcgggggaaggcaaggctttggggtggaaggggtgcattacctccccacccccgctttcctttcagtcccagctgctcgagaagggagggcgctgggaaaggaaacagagcggaatcgcccacattagcctcgctcttcggtgacccggcgcctctgggcttgtgtgagcgtctcctttctaatgccaatgacaacgacactgagggtgattttctgtgcctcgcccacccctttgcaggcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaatttaaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggcccttttgcgttgtttcagtcctctcggtacctccccgcccagccctgcgatcttaactcaccgggcccggctccccggccgcttgcataattagggagggcgagggcggggcgggaggcctgtggagaccaggcggaggctgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaatcaaagcctgtgtgtcagaattctgcaggtgcacttctttaaagaagctcaaagggaataatttagaaagtggccaatatgatggaagcagctttgaatctacatgctaacattcctcaacactccaattccggtggaggtggcaggggagggggtctgcaaaatgaattttaagggaaaagagtaaggattcttagagccctatattctaatagtattgccctgcatttaaaattgatttgatttccctgggttctttggtgattgctgtttaagcaaggaaagaagcagctttacgagtggacgtggggaggagggcggcacaagcacccacatttctgtaacaattgctttcttacaagatgctttatgaatgaggcatttttccctcccagacgtgcacttgttttggcatataatggcaaaataatgcaaagtgaagggagatgtatttcagctttgatttttaccgtctggatacatcgggactattcccagtggataaagtttcatgcatttaatatttctcacttctggcagcccagctcctttcttgggctccatcttagcattatcatgaaataagatctggaatccattgtctgcacctccgcaaaagcagtgagaaattatcccgggataagggtgaatgagagaggtctctaaatatagtgttgatacactcacctatttaacaaagtagacaagatctttgcaataccccttaaagataacgacatagatgttgttctgcaggatttatagttaggacccactcaattctccaggactcccggttttgcccccctcccgctttgccttggtgggggtggggattgggggagtggggattgcgttggggttttaggaatctgctgagagctttgcccatttttattaaaagaggaaaggga

SEQ ID NO: 13201 - DNA, 8252 bp, Human
agggcatttcagaaacaataccttaacaaagggtgggtaagctttgaaagaaggcctggagaaaaatcaggaccccatcatcccaggtcctggagcatggtggggggtaaggctagaaaggaagttgtacgaactcaaatattaattcaaatgctaagaggcttacccttcattctgtatgcaagctaatggcagaagaaaaggcacaattagagccatgctttgagaatcattattgaaagcatgtcgaagatggtctgaaggaagcaattgggaaaagcaagcatagctcatccaagtgggtgagagtgtgagttagaggaagcttggaaattggtgatgtgagagatgctgcagcttctgggattgctgcctggtcgtgtgtagaggaggggcagtagggctcattctgaatcttgtcttgaaaagcacatagatagtgatgccaaaaccaggactacggaaatcacttgaagctgtatcctacctcctcctccatctgtatctgcttcacctatcaaggatatctactattgccactaaaattcaggtgcttatggcctccctcattcatcagccagggtttatctggccaggaaagagaagccccttcaggcatttgcaacagagggagtttaagtcagagaactagtcaccctggtagttgagattgccatcagcaagaagctgttaccatttgaaggctgcagggacaaagggagtgagcagtcctctgggagactgaggaaggaagctcctggcttctccccactttccactttccacttcccacttttactcatctgtcctccaattcccttttggctgagcctagctgaaacccagctgacaggggagtttgagcaagcagcctccagggtcagccctctgagttacaggtagagcaggacagggaggaatggatctcaggacaaacaggttcaggatccggcaaactaattttacactccagccattgagttggaactactggccagcctcccccgagttagcatgtagaatatgggataccagctgagtgcctgagagttatcattcacctcagtgggggtaggggcggagaagggtgacatatagccagccacatctatatccactggcccttccttgtcctagtcctctgtattcctgagaaggaactattctcgaggacctgagtccaagttcatcttacttagagtacagagaaaagaaccgctaactccttctctctttcccccatcatgtctcctctcctttctagttctcatcactctctactcccccctgccccccttttctccatcttcatcacctttgtccagtctctatccccattttcaattccttcctcaaaacaccaagttgcttggtagcatgcagggttggaacatgcctttaacagaaaatctcgtgtctcttgaacctagttatttattccttgagcagagtagatattcaacaaaagaattgttaaattcaattaaataggatatatcttattattaaatatttttttcattttttgtttacttatatgatgggaacttgagtagtttccggaattgtctccacaacacctggccaaggaatctgtgaggaaaagaaagatcaaatggaaaatcaaggtacatgacaccagaagacctacatgttacttcaaactttttcttcctcatgaaccattaaaatagagcataactcttctggcagctgtacatatgttcataaatacatgatattgacccatagcatagcagctctgctcagcttctaacaagtaagaatgaaaagaggacatggtctttaggaacatgaatttctgcccttcccattttccttcagaaggagagattcttctatgacctcattgggggcggaaattttaaccaaaatggtgtcacccctgaacccactgcgacacgccacgtaagtgaccacagaaggagaaaagccctataaaaagagagacgatagcgctacattttgtccatctcatagcaggcacaaactcatccatccccagttgattggaagaaacaacgatgactcctgggaagacctcattggtggtgagtcctgcactaacgtgcgatgctcttgctgatttggaccagatagtatttctggaccgtgggcatgaaacgctgggttctgactatggagatccaggaatactgtatatgtaggataggaaatgaaagctttggtaggtatttaagtcattgtgcagcattttcaagaactgatacacagcagtttgaaagataagattaaaactgaaagatagctatattggggctaaaccacacaagaagtgtcacatgatgctgtgcagtaagaaagaaaatttattgaaagtctgtttttctgagtacaaaggatttaatataattctcccacggcatttttctttaaaatgggtcactatccttgagattttgaaagccgtagcagcaacaacctttgtttccattatctcgtaccatattctcagtacattgaaactatgtattctaactaaacataggtataactgtgttttagaataagtggggtttatattttttaaatatttaacttcaagtatcttttttgaaatctgattttattacagaatcaatacatgttaaatttagaacaactggaaaatatacctaagaaaacatgaaggagatcgagtttttagttggatgcctgccagtagcaccaacagcacttctagcatgaatattgataccacatagattttctatagctctttcttccaatgtgaatgtttgacttcacgatgagtttcacagaatatgggactgagaacaatggtgcaggaggatatttctacctagaaaatcaaggttattattccttcccagacctgacaatgatgcatgtgctgataggctaatgacatgccatgacttgacatttttattaaaattattgccaaccaatggataacatgtctttcctaagtcaaaaggagaatgttgaaactagtttttttaaaaaaattttaaagccatggtgttaacattatgttggtcatctacctagatttttctctagctgatctgaaaaatgtagtatagattgtcctggaacattgtgtgttctctatgattagcaatgcatcatcatcacaattaatttgtcaaaaagaaccacatagtaatctaatctccaacctctctctcctttcccattcaattctagtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccagtacgtaaagcttccagataaaaatgctatattcttcatccctcttatgcatcagactgccagttaaatctccctgaggatgattttattcatttagaattaccagtcaaacctggaaggaccactgtgaagagcaattctcaaactttctacagatttctttaaccaagcacaggacagcctccaataatccctatcctgttagatctaattgtcactgacaccaataatcaacccaaattaattataatcattattctaatatttatgagaccccaagtctattctttatttattcaaagaatagacatttatcaaagaggattaatgcttttattatcttaaccagagctgccattgagaagatttattgcaaataattaataattagggttttttacttttattcttttgcttatttttgtttttgaatcccagtggaataagtatcactggggtatttctacccctttgtgtgttaaatagtcttgatctacttcctaacatacctatgcttgctgtatccttagtatacccagtatttagaccccatcaagggttaaataccaaatgtattttgatcatttgacttcatacaaataagtctctgttctgtggagcctacagattggtctgattgtaggatttcttctcttcttcccattactaggaagagtcaaaataaatcaattcaaaaatgcaagcaaatcattcactgatctaaaagagagagggaagagaaggtcatagagacacttaaccttttgtttccagccctttatctcagctctgggctctgtcccacgaatgtgatctcagataaaattttgatgtattccctcttcaaagacagacttcatcaagtcaaataaacagctatcttattctagatggttccaagtctactcttcctttggtcttcttctgtctgtcaaatgtaccctaaaaaagctatcatttgtgtcaaacttaaattttttctgtggcctcagtctatcttattttattcattcttcaaataaattggagaaaaactgatcactgtcttcttttctataacaattcacgtgcttgaaaaaaaaatccaatttgtccccaaagttcttcttcaaactaacatcatttaaagaatttgcaatgcctataatttgtcatcctgtgaacttgcctctcttcatgtattcctgttttatttctttcccactttaccaggaattcactttcctcctgatttttctcccctctgcagccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaacgaactttaagtatgagaaaagttcagcccaagtaaaataaaaactcaatcacattcaattccagagtagtttcaagtttcacatcgtaaccattttcgcccccatggcccatgtgctgtcttgccctacttctgaaggcctctagatattctcaggccactctgcaggctccctgcttcttgaaagaccttcctcttcactccatcctgctccatccagtgtgctccagcccacccagaggcccatggcttttctaggcttctttccctattccaaatccaggggttggcctctccagccacctcctctcagtcattttgtgctcacatcttgattcctgtgaccatccctgtcaccattttcctacaggaaatccccaggcagcttccagggacagttcctcacagcctttacgctttcaagcttctcactaaaaacctgctgctcgttttcaagctttctctgaacggtgatgatgaaaagaaaaaattgtttttgtttttgttgggagagggagttgtaaaggatgtatatgtctatatgtgtgtgtgtgtgtgtgtgtgtggtcctgaaccattatttcccactagattttgggtggggggtatgcggatgggaagaggcagttgctttccatgtactcctcccctgatacactttgcttttattctctcttcattttccccagttagcactaccatgtacctagtcatccaagctagaaatctatgtggcttccctgaatctttttccttctgcctctccctcattcctaacatccacatatcaccaaatactatattctcacttccaaaagttctccaaggaacccccacctccccaccaataccatactacccaggttcaggactgcatctattctcatttctctcctccatgattgctacaaccttccacctgttcttgctgccattgttcccttctctcaatccatcctccgacctgtacctatgacacaaattcaaatataacaaaaagcgccccccagaaatctggccttgctccctctcctgttctatcccagggtgcctcatccttgacgttttaccctcgagtcgtggtgaagttgttgcggagaccaccatgctattcttggccttgatgcctatgctatgtggtcccttctgcgtgaatgcccttgccaccttccccctgctatccctccagtcacacgctgccctccccactctcccccatttctatggctctactcacatattaaaactttctttaggtctcatcttctctaaggagactcctggacccatcactgcctgttatcctagattaggtccctctctttcttacgggctccaaaagcactgtgcagatcctttatcactgaccttacatactatatcagctttacctatttagccagtttgtggttcctcaagagcagaaacatcagcacctgacatggcaggtagtagacagtcaatactcagctgaactttgaaccaatagtccacagacacctcaaaatcaacagagacaaaactaagctcgctagctttactgccaaactggctcctcctactgcttttttatctactggaatggcatcatctactcatctgagcaagaaacctagctttctctccatccctcattcccctcctccagtcagtgaccaactcttcatcaatgtctcacatgtcctccccttccttgctaactccaagtttgctattacagttgcattatattatgacactaactggcctctctgccttgcttcttatatttaataattcggtatctctcaaacttgtaggggagtctagtcagagtaggtaattaatagcttctgcaacagacaaagttcaaataaacaaaggtttgtttcttgtgcatgttacaatccaacaggatcattagggagctttgctctacttggccactgagagacccaggctgacacagaggttctgacttctacaacaccatctagcactgcaatgtctaacacagtagccacgaggcatttgtaactattgagcgcttggaatgtggctagtcccagttgagttgtgttataagtgtaaaatgcatactagatttaaaatacttaagtttt

SEQ ID NO: 13202 - DNA, 8426 bp, Human
aaaggagcaataaaagcagcccccaaatggagggctaaggacgcgtctgggagaaaatctgaaagcgagctagcagtcaccccaatttaaaataggagggggatgcggaggaaggggcatgattcacgttgggggtggggggaaatcaagagccttaaatgggcttttgggaatcgcctggatggtggtgtcggatcagcccagttggcttttcaagttggaactgctaatacaagggatttgcgtccatcctggcggctggggtcgtgggccaggccagcgggctctcttaagggtaataacacgtttgctggcaagatgcatttctacggaaacgtctttacatcagctctggggaatatgaccatggtcgaataatgcatctgaaggaactggacagtgagaagacgaagcttcacgtaacaatgttcagcttggtgatttttaaagcaacgcttgaacaaagagttactggcttgaaccaaccgtctttttcactcagagtgtgacctatttccctacaatgagcagaaaataaaactgtttgagaattcagagccagcaccaggagaaatgaaccattccctcgactgcttctcaccttcataagcgaaagattattccttgcaagatcaccaaatgtaaacgagaaaaggtggtctgattttgccacgagtgaaaactttgggaagaaaatgcttattaagctgtttccttggttcccctcacccctcatactttaagtcagtgccttgtctctcacgcacaaaaagcgtctggtacttcggtggcaaggagtgcagtgacagatggaggtatcctgtgtaccattatagaagcttttcctctaacccaagttagacttggagagctcagggatcttgctatctctcaacatacagaacatttctccttagaactgcaatccggtttagaatgtcatcgttgctgctgcctcccttcctttcaggagcacattcgcctgcgtgcgcactcacacacacgttcaaaaagagtccattcgattctggcagtaggctgaaaacgatccatattgacgcgaataacatcccaactgtaaatatggattcgtctactcgaggctgtgtctcatttcaccatagaggaaaattatgtcatttaaaacagtgataaaacgcgaagagtttcgatcttctgtaaatggctctcactttgaattgtgggggaaaaaaatcactaattgggaatagccagagaagggggaatttgttgagcgcccaaggccaatctcaaaatattttatttcatgccaatgtgggagagggaagggagtgtggcttcgctgtttgccgcttttgcattttccacatctggcctacagacctaattctaacttgcgatctcgcttgatgaaattcgatcttcgtggtttaaatacctttcaatttgggacgatttaaccattgcagcagttcaaaaaacaaaccctgagcattatctgtaaaaccaatatggaaaaaagaaagaaaacatgctgcaaacacacaaatcgcaaccattgtctttaacactcgcatacacacacatacacataaacacacggaaagatgggggaggggagcgagtggagagagagagacacacggatatagaccgacgagagtcaatgcgagtcaagttaacgctttctccgccccgatgcacaagtacccccctcccgtgttaattaattccaaacaaagcaagccaatcaagaaatgcattattattttcaagcagagagagacgagtgccatgtattttttaattgatttatttatttggaggacattaattctcggtctgaggctgattttcaaaccgtttgcaaagcgcggctccattgttcgccaggcgcgcagaccccgccccctgctttgtgtgcggcgcgcggattggccgacgcgcgcgggggccgcgtcagcgcccgcgagcccattcatctgtgcacttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggtaaattctacctgtggttgtggtcatttatttcgtgtctttctctccttccctcctggtggctcccaaggctcattcgtggagaggagtgtggctggattctagtctgaaagttgaatggaaatggatagcctaaattgtggatttttcatagccggggtccccccacaccaaaggagtggttccttagaatcctggagaattcttgagtagacgggaggaaaggagtgataaatcgtctaaaatggcgtggtttggagattggcagaacgtgactagctaggtgccctccttcccccgcccccagccaggtttcatttgtgtttgggggcacaatggtgtttgggtgtctctcgggtttgttgtcgaagctggattgtcttcgagatttctgaactggtggtgtgattgtgtgtggcgggggggggagtcgggaaaggggggcgcaatggggatggtggtggagaaaggcgaggagggaaaggctgtcttattgtatgccgcggcggcgtgccctgggttcttggaaaggtggctggctggggccagacagagggcttcggtaccttttgatgaggctttcccactgtcctaaatctttattcgtagctgtctgtggaattacacatccatttgatttttaaatggtatctgtggggtgggaacactcggtgggtcctttaagaacctttccagatggtcaaaaagaggcggttcgtgcctttcggtcgggattgttcttgtgcgtggcgcctcgaccacccgcgaggggccgcccggcgctgcccggacccaggcagatagccacgattgggtggacccgagaggtcggccatgggtggctgcttcgcaaacactgggcacccaccacgcctcttttcctagagaagagatcgtgtcgcttcgcctgctctaacctactggggaaagcgaggtctgccaagaggctttaaacccgttaaaaatgcaaaatgagccgccgaggcgcgcccaggcttcgcagaatcgcaggggaaggtgggcgtggaagcagaggcgagacctcagaaataatgggtttccccctgccttgttggtttcagcccgaccggcaggccaggaaaccacctgagctttgtttgcggactgttgggctgcgcgatccgggctcgggggcgcctcggcctgcgggcagggcccggctgggcagggcggggtggcccggcgactccgcccctcctcgcctgcctgcgcccaacgcggcgcggtggaggcacagcgccccctgccggtgccaaaggcctgggtgggcgcaggagctcggagggccccgcgcgggcgctcctggctcgagtgctgtgatccccctgggaattcctggtattttgaagaggcctttatgtatttagggcgaaagagggatgtgaaacgtaggcgcgaaccaccagctctggctctgtgccttcttccaaagggcgtttgctgtgtcaactagtccctggcaccttttttcccccaagcccccgataaagcgagggctggcatggttagcctttgcttgctacgtttcggacttcgtctttagggcacttgctgaatggctgggaggccattgccgtacttgggggctacagttgtgttttcggggggtctccaggcagcggtgcccatttcctcgttcgtggggctctcttctgggcatccacccgcgcctccctccccacaacggcgggggtggggtctcgatggccacaggggccttagggggaagcggggcactcccggtccagggctgggggcgggaatggcggcgccccggccgcttcagtgacgctcccgctttctctgccccttaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcatttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataatcaagcctgctaaaataggatttttttttacaaattttattttaaaatgcaaatatttttagagaaaatttttaaatcttaagtgttaaaggtaagcattcagtttaagagatttaaatgatatgcttggcattatatttaacaaataaaattatatccattgaaggtgagttgtatgcccccaagccaattaaaaattttaacgatagaacttgataatatatttgagaaacaatgcaatttttttatcatatgaatataaacaatatatcttttcaattaaagttaaggatttggggtaaggtacttttcacagccatatatatatatata

SEQ ID NO: 13203 - DNA, 94019 bp, Human
  misc_feature (1)...(94019): n = A,T,C or G
atagtaattatatctttattttacagatggggaaactgagacagatgttaaggaaaagcctaaggtctaaggtcacacagcttgtaagtggcagagctgggatttgaacccagccggtccagcgccacagtctgtgtcttcagtcattgtctccatctctgctggagagaatgaaatcacagtacaggctcttatcatccaagaagaaatgggcttggtgtcacatagaagtcacacaggagtccctcaggcagcccagagctgcagagtgcagtaagtgtcagtgcaaactctcttcaaaagaaaatgtacaggcctggggtgaccctcttccttgtgccgaaggggctggaggatgcaccatagtacattgggaacccccagaagtaggtaggaagtaggagcctgtaggacctacaaaaatgctattttataagagaagcaaaatataacatttctaacaggtttgaatgtagatcttctactagctgaccttgtgacgggaaacaaatgacacacatcacagatgggaaatgcacacatcacatacacacacacacacacacacacacacacacaggtgcatgtgcagccatgctgctttgggaagttgtttctcagctcactcattgattgcgttaacaaagagttacacaatgctttttctgtgagaggcactgtgctaagacaaagggtagatacaaagacaagtctgctaccatgcctggtttttgtaaaagagataaaacaagtagaaaactataatatataaggtcagaggatttaagggacagcaaggaaactacaaataaaagatcaagggagttgggtggggagaataggggcagatgaggaatggggctggcttcagggagaactctgcttctgttccacgcctggaagatgtgtgggtgtgaaaagaaagtaactgaggtagaaggaagagcttgtgcaaaagtgtggaggcgggagagcttggtacaggttggcagaggttgggatgtctgaagggacagaatgtgagaaaatcctagagacattagggctagatcttcaggtgtggaaggggttctaaatgtcaagcattttgtgttcgttttttaggcatagagagtgcattggggattttcgatgaggggagtgcctagcaagttgctgggtacatagtaggctgataatcaatcaatgatggttcaactaatgaaggagagaaataataattgccacaaattattgggtgattgctatctgccacacacttttctaaacattttcactactcatgtaattctcaccacagcccatgagatggtttctccatatccattctacagatgaggaaactgagactcagagaggctaagtgtcttgctcaaggctgtgactaaagagtgggcatctaaccagagcctgtgcttccacactgctgtgcaatttggaaaacagaagaaggggagagaagaaaaaggggttgtgggaccaatgtcatccagaaaggaagctatgataggcccaaagtaggagaagaacaatgtgggttggaaataagagacattccaaagatgcaatcaacccaaatctgttattatttgatatgggtggctgggcagagggaagggtcaaaaaggctcccagcttctagttcagtcccggggaagtgatagagctattcaaagaagttgtagtgagagagagggaagatgacagtttggttttagttgatgtgtacagaaatacgggtgcccaggagcccacaaaacggccagaggagaaatgctttcaaaggcaagctgcagggctccttggttttgtcacattcctcattctggggctttgcggttttgtcttgggaatctcgaggctctcccaaggttcctttctatgtttatatcatttagcagggaaggattgttaatgactaatctgtgtccatgaggcacagagccaaggaagagatgctgctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaagtaagtacctaattcctttgggagtgggttgtgtatctcacagcaacagagaaaaaatagtcacttaaaagtttctctttgacatctgtaatgtatgtcaataaatgaattctaagttagtagagtttgatgtaaagtcctgaaaattaaaaaagagagaaactaaaaaacaaaaagaagcagaagcaaaagttaatgagtcttaacagttgcttacctattgaaaacttatttagaaatactcttttaacattgtggtcacctgagtaaatcactggagatagtgcatttcagaaatgtctccgttctgattccataaacaatttgacttgtatagtgtgctatattttggtgatttatcaaatcttgatgtgagtttgggagtattgctaatgtcagatgacttgggaactaagaataagacatttaacctatgcttaattgaaatgaaatttttccctagaagaagagtaggtggaaaaagtcttctttcttgacttcagttgtaaactcttctattgctttccattttgaatattaatatgacaggaaatatcagatggaaatatttttaaaagatagaaatgtgagtatgacgaagaactttagtaataaaattgtccaaggactaaatttatagataagatacctctttgtctccttattgacagagtgaatggggcaactgtggagcctgacttacttcttttaattgggtttttattcagaagggaggggcaggagggaatgacaagtgactcaccttgaattcttcctctaagaaactcacacctgagctttgagctataaagaaatctgatgctgtttctggtgctgtcttagaatcacttcaggagtattgacaagaggggtaggaacccttagaaataatattagtgataaataagaaggcaggaagaaacttttggaggtgatggataggtttatggtatagattgtggtgatgatttaatgagtgtatgcctatccccagactcatcaaagtgtatacatggaatatgtaaagcttttatatgtcagtcacacctcagtaaagtggtttacctatctatctatctatctatctatctatctatctaaatttttttttctgttcctaaaaaaaggaagggagaagagaggaaaagatgttcagggagctaccattttgtttctagctgtgattttataaaatgatagacacttttatctttgtgttacgttcctacccccagtcctccaaattatggatctgtgccatttgtaccgtggacttttctgttttctgaggatgttgcaacaaatactgatgcaactcctggttaactgataaagtactggccagggacaaagctctcttgtcctgagacccttcctcaagatttgcagcaatttcccaccacgtacctctgccctctcctcacagctggagagggaaagtcatggaatccttgtccttcctcttgtttccacctcttcaagattgggccaattgcaatggaatatccattggttgtgaggcctttgtactctgcaaggaaaagaaaagaaatgtgtgtatgtatgagtgtgtgatggagctaacttttctacaatgtctactaacatgtcctagcctttacttcattcgcctgtttccttctcacaaaaaccctgtatgggagtttttctttactttttattattatttttttgagacaaagtctcgctctgtctcccaggctggagtgcagtggcgctatatcggctcactgcagcctccacctcccgggttcaagcgattctcctgcctcagcctcctgagtagctggtactacaggcgtgcaccaccatgccactattttttgtatttttagtagagacggggtttcactatgttggccagactggtctcgaactcttgacctcaggtgatccgcccgcctcggcttcccagagtgctaggattacaggcgtgagccactgcgcccagccaggagtttttcttatactcattttacagatgagaaaactgagactcaaaaaatacaagtgacccgtccacaggcagatagttaggaagtagcgggacctgaacttgagggcgggtctttctgactccaaagcctcttcctggctactctgatattggctattggcggaggctgggaaaacttgaaatggggaatgatcggggagcggcgaggggggaccagccgttaagcattccagcctgacaggggtgatttgttaaacccaggaactagttagacgtttcctgaaacctcctgcatagggcattttcgagagattgcaccatcagtagggaaactggaaagtttggagcactatttgttttaacccagagaccagtctaagatagctgggtgaatatttccgttatcagcgttttaattaaagaccacaatgaactctccatgctgctgtgattagggacatcttagagaggagctcagaactgctgtggctcacagtctctggattatgaatgccatgagaatgcatatcatgatgtgatagattttcaaaggctcacattgtcattaggtgggtgcataaaggacagaaaaggttctttacttcatagaaagagatttcccttccctttgctctcagtctcatttttatcttagtctctagcaacacagattataaaggggaataaaagaaaataggaacaagctagatacagtgatgagtgcctgtgatcccagcagctcgggcggctgaggtggaaggattgcttgagctcaggagttcaaggctgcagtgagctatgataatgccactatactctagcctgggtaacatagagagacaccacctcaaaattttttttaaaaaataagaaataggaacaattttcctcccaggtatttttttattgtcacagtagtttctaccagtgaagatgtagctaaaaggcatcaccatacgagtgtccttagtcaccaagctgtatgaggaggcaaaaatcattattacatacaaatattcatccttctgtcttttctctcccttctctcaccctgctctggaatcccctaacccctttgctcttcacagtgaattattttctccctcagtttgcccatttccaattttggccataaaagaacatctactattcctactctctctgctttgtaaattggtgataagatgacactaatataatgcaacttgattgcaaagtaaaattgcaaatattgcacaggaaaaaaaataagatttattctttgttaggattaagaaatataacagggttctggtgattaaaataaataagtataaatataaaataaatttttattaattttcattttttaatataaaatcctaacaaaactttgagattttgcttcccattttaaagagatttagatgacctttcccaggtctcaatgaacctgagacaacctgggtctattacactttaattaatgttattaatgtaaagaaaaggagaaatggtatggctttgcattttcaagtcctgtagatatatttaacacagttatctggaaaacatggtaaataatgtagttgtgcatggagaagatagtcctgctgtgggatgttgctgattagagaaaacaaaaacactgctctgggctgtgactgttcctaagcagagagctatttgctgccatgtcctagagagttatggaagctgccagtgtagacgacaagttgataccagcctggggcttaaggagcaaaagctggttgccatccagaatttgcagggcagagacaggacaaagaaatgtcattccaaagtggtcatgtaaaagattcttgctctcctggagtcccgactctgaatctgaggctatagctgggcttcagggggccagggtcacttaagactacatttaaaaatctatgcattttacagagaatttttagggcagtgaattcattctatatgatattaccaatggtgggtacatgttattatacacttgtcaagacccatagaatacacaacaccaagattgagccctaatgtaaactatagtccttcgctgataaagatgtgtcagcataggttcatcgattgtaaaaaaatgtgccactctggtgctggttgttgaaagtaaaggaggctgtgcatgtgtgtggggggtgggggagaagacgtatatggaggctctccatacattttgttcaattttatagtgaacataaaatttctcctaaacatttattaatttagaaaaatatctgtattttgtgtatgtctttcctagagagaggtttataatttttgttgaagctcaaaaatgctgcacaatcctaaaattgttttaagaaaatgaagcaaacccttcttttctggagaatctaaatatacctgcttatagcatctgattatataattggcaaagttgaggacaggaaatgataccctaggagactgacatatcttaatgtagtcattgtgttaaaagtttcaacattatgaataagtctaaaatattttttgaccttcccctagccctattctcctctacttcactgtttcaatgttaatacatatcaaaacactttaatcttgtttaaccacttcctaatagttgatactatagagcacagttcatttagccattccactgttgatggttttttaggtggtttgccctctttctgcattagaggcaatgctacaatgaacatcctggtgcataccagcaaagatttctccaggaaagatacctaggaattaaaattgcactttattttaagatacactgctaaagagccctccaaaaagactaaaacctatgcccccactagcaatatgtgagaatgcatattttcatacactttgaatattatcaaagttaaaattttttgataatctcataggtgaaaatggtatttagttatagtaatatccattttcctaattattattagtttcagatattttctgtgtttactggccacttgtgtttccactttggtgaatttcctttttgtatcctttgccaatttctctcttgggttgtttatcctttctgtttttatttataggaatcgtttatatattgtttgtactaatatttttggtgttatttatgttgtaaatatttttatccatttttatatatttagctttgtttgtgatgccttaacctctgtcttacatttcaacgttctcaaatgtattcttttcctatttacttcttatttaataaagtccttctcaatccccaaatccataaagatcataaatatattttctcccaataattttataattttcagtctttaatccatctgagatgtattttccaagaatgattcataaagatgtctttatttttaccctcaaagcataggcaattttcttgccacaatttcttgaataggtcatccttcttccactgatttgagctgagtccactagctacagcatagacaactatttagggttgctcagaacacagcatgctattttcccttcctatagccatccctgttgcgtgtcattttcctagcctaatgcctattccttcaagactaagttcaagaatcaaccctccacgctcagaaagatttccctcattctcctcactatacccttgtttaaaactcatcaattacttccatttagaagaaaatccaaactccttaccatggccaacaggccatacaagagctgcctactctcagacctcatttcctatagcccctccttggctcactcatttccagcctcactgggcttgtgttgttcttccaacactccaagcccaggccctttgcttttgctgatcactctgcctgaacttattttccctttgtatgacttactcattcttgtccttcacatctcagttcgaatgtccacttttcagagagctcttctctgattgccctctccaaaactgtgttcaactacaacactctatacttctcttttactttcttattatcctcatcagaaatcctattatttgttgacttgtgtattattcacttatccctctagaatgtaagctctttgtcttaccactgtatttctaaaacctagaccgaaacttggtatgtagtagagaattaatgaatattggatgaatgaatgtccctgcttgtgctcctgatggcacctgtgcttagctctgttgtagcaatcctcacactactaccattgggtttttcttgcctgacttttccactaagctttctgaaaaatcattattttttactatgtctagtgtctgtcaataaatgtgcactgacaaaataaatgagtgaatgaatgggaaattgatgttgagatgccgtttttaaagagtaagtaccttatcacacatagctaaagagaccaactgacacatccaccgtactagtgggaaatcttagatctataagtttagaaacatttctatcttccaagttaccacaggagacagtgttactgattgtttcatgattataaacaggacccccatcttcccacctcctatgggaattttcttattgttcttccagtttccactaaccagtctcctcactgcccttctagcctcagatcatcccccaatcccaaagcccaggccatatatgttagcggtttttttagacagcatctcacttccaggtactgatttctataccagtcatttatgtctttgtaacaaccatcccaaagcttagtggcataaaacaggaatgatccattaattctcatagttctgtggggcggctgagcagcttctctgctggttatgcctgggttcactcatgttgctcattcagatgtgagttcaactggaatgaaaggactgagatggcctcactcatgtctggggtcttgatgtggccgtcagctgggatagttggaagagctggacttctttctccatgagatttttaaatctgagatatctgcaaacagtatggcaatctcagggcagcattctttcttagatatggaaaacagaagctacaaggtctcttaaagcctggcttagaagtccccaacctcacttccaccacattctgttggtcaacgaatttattagaccagctcaggtccaagggctagcgaaacagactttgtgcattgatgagaggtgtggcaaactcacattgtaagagcgtgtggaaaggaagcaattgtggtggccatctttgcaaacaatttccatgagtaagaggcataatatttcaaagatccaattaagtatttgaaaaaaaaaatgacaagttagtcacggagaaagcattcaacaaatagcttcttgaccattttgactaatgtacataatgcgaaaaaagaaaaaacaaactttcctgattatgaagagtgaacattaagaagaccaaacaaccacaacaacaaaactattcctggtagttctgatggaagagaattaacaacgggaaattcgcgagattaattaaaactatttccggcccagcatggtggctcactcctgtaatcccagcactttgggaggctgaggtgggcagattgcttgagctcaggagttctagaccagcctgggcaacatggtgaaatcctgtctctacaaaaaattaaaaaaattagctggggctgggcacggtggctcatgcctgaatcccagcactttgggaggccgaagctggcagatcatgaggtcaggagatcgagaccatcctggctaacacggtgaaaccccatctctactaaaaatacaaaaaattagctgggcatggtggcgggtgcctgtagtcccagctactcgggaggctgaggcaggagaatggtgtgaacccaggaggcggagcttgcagtgagccgagatggcaccactgcactccagcctgggtgacagagcgagactccatctcaaaaaaataaaaataaaaataaataaataaataaataaaattagctgggcaagtggtgcatgcctgtagtcccagctacttgggaggctgaggtgtgaggattgcttgagcctgggaggtcaagactgcagcgagctaagatcgcaccactgcattccagcccaggtgaaagagagagaccctgtctcaaaacaaacaaacaaacaacaaaaaccctgaaacaaaacaaaacaatttcctggggtggtcaactcatgtataaaatggttcccatggggagactggaaagcctatgcttaagagatttccaataaaaatggttaccattcactaattagtctacattgtggggaagcagacttagttgttagatttctttatgtgacaaaaaaaaaatccttcttcggctcttgtgtgtattgtgttgtatgcctctattcactaatttctgtcctatggcctaagcaagactgattctaaaggtggttatctagtaaggtatattattcattcactcatttatgtattagttactttatttattcatgcaaccatttgttcatttactcaattaacaagaatttattgtgcatctaagatgtacctggctggcattgtgcaaggcattggagatccaatgtaatctctcctagagctgctggtttaatgggagacacagaaaaccaaatccacaaaaacaaaggttgaattacaatggtaacaccactgcaaagaagaagtacccagggctatgaacgtctcctggagtttgtgctaatcaaggagttgagaagcagggctaggcctagagctaggcaagtgaggcactgagggtgcaaaatttaagaagacattcacttccaggttcctggtcctggaagcctcaactccaggtgcttcttctacatctagttggaaataaaggtcagctgttgtttaggcaccattgtgtaagctccagagagcagagacgctttgaaagctgtggatatctagttgatgcaggtattttattatttatttatttatttgagacagagtgtcactctgtcacaagactggagtgtagtggcgcaatctcggctcactgcaacctctgcttcctgggttcaagcaattcttctgcctcagcctcccaagtagctgggactacaggcgtgtgccaccgtgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgaggttgattagtttgaatatcagtataagttgatcatagatatgatccagagaatgctattattaaaaatttaattaaaatgttaatttaaatattaaattttattttaatctatcactaaaaatctatgtagtggttactaagatagtaataaaaattgtttggttcttatagagcactgtcttcagaatgatgtggtccaatggtcatattggctcgcagccatccttgttggccatatgttgtccttgacgtgtctctggattttcggaagtatctatttattctaaatctgtatttctgtcctggaaagaacttcagtttgagtgctgcttgaagaccaaatacttggaaaaataaaacgttttttcttttcctagagctcttttctctttttccttaagaatatatttccaggtcaggcgcggtggctcacgcctgtaatcccagcactttgggaggccaaggcgggtggatcacttgaggtcaggagtttgagaccagtctggccaacatggtgaaaccctgtctctactgaaaatacaaaaattagctgggtgtggtggtgcatgcctgtaatcccaactactcgggaggctgaggcaggagaatcacttgaacccgggagatgaagattgcagtgaactgaggtcgtgccactgcactccgacctgggcaacagagcaagactctgtctcagaaaaaaaaaaaaaaaaaaaagaatgtatttccagcctttgggcagaatctaaggcttcctctgagcataaaatgatgatggttagaaaaccttcatgttttttcctgccctttaaaaatggattacatagatatccaacaaagtgtatactttctatcaacaactgagttcatttgagacaatgtcaccaaggatgatgtcttgatatgtagagttcatagtgaactagtgcatgtaatcggtttttatcttcatcctccaagcactaagattcctctaaatcagagtcaaagttatttaattgcagcagtgtctttccaaggtctccgattgcaaatggtttatactaagtcagaggagctccatacgccatgaacttcccatgacacacggtatctaaataagtaaatattgataaccagaaagtgggagtccaagctaccagtaactatgtgtcttatcacaataaaaacaaacagtgcataccatttctgaaataattcctgggtccttaaatgaagacttaggttacagcattttagaaataagcaaaaagtaaaataaacattttgtccctcctttcaccaatacccaaggtttaaactttgtatcatggggctgctgcttctccttcctcctcctttttgtatgctgtacacaagttccttccttcccatctctactgacgccacgctgctatgcactctggtcaccacacaacaacttcctgaatgtttctccttcttttactgcttcccctccccagcccaccttctcactagagtaatcatatctactgattttattgtgccactcaaaatttccagtagttccccattgaccacagttaggttccccaaacattttatggggaggaattactttttcctcaaagctttaagaatggtgtgtagcaagggcaaggatgtgtgagaaagagagaagccctgtatgaacttgtgtatttttacataggaagctttccatatataatttcattcaatctttttcattgtgaaatattttcaacatgcaacaaaatagagtaatataatcaacttccttgtatttattgctcaacttagaaggagagcattacaggtattatagaaactccctatgtacctgcccagtcacattctgcagctctattctgaatatggggctcattactttcattcatgtctttacagttaaggcaaggatcacaagctttttctacaaaggatagactgaatattttagactttgcagaccatatggactgtattgcaaccacagtacttaactctgtactgtggctcagaaaggagccatagagagcaagtaaacaaaagggcaaatctggtccttggcaggctgggttgggtctgagagtcatagtttgctgatctctgcagtagagtaacagtaataatatgtagcactgctttgcatatctttatatcaaactgtatgtattattctgcaacctgattcttttgctcaatatgatgtttccccatttattcatatgaatacatctagttctagttcattttattttattttattttttaattttttttgagatggagtgctctgttgcacaggctggagtacagtggtgcgatctcggctcactgcaacctccacttcctgggttcaagtgattctcctgcctcagcctcccgagtagctgggattacaggcatgtgtcaccacccccggctaattttttgtatttgtagtagagaagggatttcaccatgttggccaggctggtctcgaactcctgacctcagctgatctgcccacctcggcctcccaaagtgctgggattacaggtgtgagccactatgcccagccgctagttcattttatagtcatttattttagttcagattataattattttaattgctgtatagtattcacctgtgaatgtgcaatttatttattgtatccattctctttttgatggacattatgctgtttccaatttcttaccattggaaacaatgtggtgaactttttttgtacatgtcactgtatacatatatttgaaaacctatgaaagattcactttttaagctttacggcaaccctattatttcgatttaaatccccaatcaggggagtgtctgggtggtagtgtcaggaggaggtgctgagtgagtagttccaggtcatgcgtgaagctacggaatgtcagaactggcactccacccttaatctcctcatgtctcatccccagtgatatttatactagaccaaagctattatttctgcatatgtaaaacattgccagctatgcaaagggaatatgaaataaatataagcaatgattcctctcttctagaagtttacgatctggtgatatagtaaagacaaaacagatgaaatcaaagcattaattactatacaaggaggagggagagaaaaatgacaaggaagcatcaatcaacaaactggaacatataggggaaaaatctataagactgagaggtgcaagagcacatttgagcaaatggagacatgctgtgcccttgaaaggcaaaattaaatatcagaaatgagcagattttctccctaaatatctacgtttggcaccgtctcaaactcccaaagaaacttttctttttaagagtgtgataaaagatatgataattttatcacagaaaacaagcaagggtatcttaggaaatgttgaaagagaatgatcgataataagaaaggatgatattgatacaagaagtaactgcacgatcaatggaaaactaaagtcttaaagaagcactatgaaccaatgggtgagggaaaatgtactcaagaagcaattctgaaaaaaaaaaatccaccttgtaccataaactaaaaataagaagcaataaaagtaacctttaaaaaatcagatatatttaactacatgcaatgcaaaactttttaggtaaaggtaatttaaaggcatgtagtaaatataatagaatgctaatacattcaacgtatgaagaactctgccaagtcaataaaaaaaggaacacttcagtagaaaaatggcaaaggaagtaaacccaaaatggaaactgtcacacatagccaatatagatgtaaagaaatgttttttaaattactgctaatcagagtaatttaatacaacaagataggatttgtcacctagtaaattagaaaaaattgttcaaagtgagagtgggtgatgctaataaaggtatgatgagaaaagcagtcttactgctggtgggagtataaatggaaaaaaatgatagaacacaatttgacattttttatgctttgctgtattgcctcaattttctgcaatgacccttttattttaaaaatactttagcttaaaaataaattttaataacttttcagaaaaacagtggatgaaggaatgcttaaagttggggttttattaagttaacaaactattaattgagactgattaggctaacagagggggcagctggctaatctatcctgcatccaccctatccctcttccaggacaggggtggggaatgggggagtcagggggaaggtagggaagtgatcatgttcaaatcagatctttttcttttctttacctgctctgattcttcttcttcttctttttttttttttttttttgagacgagtctcactctgttgcccaggctggagtgctggagtgctggagtgcagtggcgtgatctcgagttactgcaacctctgcctcccaggttcaaatgattctcctgcctcagcctcctgagtagcttggattacaggcacctgccaccacgcctggctaatttttatatttttagtaaagacggggtttcaccatgttgaccaggctggtctcaaactcctgacctcaagtgatccgcctgtctcagcctcccaaagtgttgggattacaggtgtgaaccactatgtctggcctttagctgcatttctaaggagatttgcttcctctacttcatgtgttctgccagctgttgaccatggctatcacctgacaatgttgttttcctttctttcttttctttttgagatggaatctcactctgtttcccaggttagtgcagtggtgcaattttgggtcactgcaacttctgcctcccgagttcaagtgattctcctgcctcagcctctcgagtagctgggattacaagcctgtgccaccatgcctggttaatttttgtatttttattagagatgagattcctcatgttggccaggctggtcttgaactcccgacctcaagtaatccgcccacctcagcctcccaaagtgctgggattacaggcgtgagccactgcatccggccataatgttgtttttctttctgatctggtgttctctcttccacaatagactgctttctctacttgtgccttttggcatggaaaatgagctgccccatttgtagagacagtctcatggacaaggcatagttttgagtaaatgggtactcataatagctagtcataaagtaaatcctgaaattttaaaaaaatgtttaaaatcttaaagtcattagaaattaaaaaaattcaaatttatatacatattttagtggcagaaaatatgataaaatgaccaataacagactctcacgtgtagacatatgctaccttaggataaaattctgccatgaagtggaatggaatgaaatgtaaacttgaggaagaacaggaatgattaaaaagtttccagctgttaaagaataacttcatctatttcttaaaaggataagggagggtaaaaagttgctgtgatatttagatttaatcgaattatttaaaagtaatgcaacaacatgtaaaaatgtcaatttttataatacatcagaaattatattacttgcaactattttattttttagtgaaagacattagatgtcaacccaaaaagtgtgttgaaggagcatattgtttttcaagggtctttcaaaggttaaaattctcaacctataacatgactccttttatggaagggaggatttgaaggaaaaaagactatagagctaaagtcaagggtctcctgggagttcttcttttgcagttccttccccaaaatgaaagtgaagagtattagagaaagaagagcaccaaagtaaccgtaattagacaaataatgtatatggaaactcttggcaaataggctaaagttgctaatcccagtaagaagctgttaagaggtaaagaaaatctgactattatgagatgtatttaattaagtgggtttatatccccaaggtaatctttacatttattcatagtttacctctaacactactttgattgtttgaatcccttctgttctttgtttcaggcagggattaacatactttttgtgtaaaaggctagatagtaaatatttttgggtttctgaaccgtgcagtcttgtgttgcaactactgtactcaactctgctactgcagggagaaaagagccatagatattccataaacaagtggctgtggctgagtaccattaaactatttataggcactgaatatgaatttcatataatttccatgtgtcataaaatattcttcttttgttttttttaaccatctgaaaatgtaaaaccattctaagctcacaggctacacaaaaacaggcagccgaccggatttggcctgcaggcaatagtttaccaactctgtttttagatacagtatttgaaggcccttttatactgaagagtgagaacaatattctggaaggatacacaaagaattagcaattgtaattgtatttaggtaaggaaaatgggtgtctaagctgggaagactttttttcagtatactgtttgaattgtttaccatgtgcttgtgttactatttcaaaaatttagtttctttttttttaaagcccattcgggaattgtaaacccaatgaatctgacttgagtggaccctgctaactatctggattctagagagttctgctgttagctaatcaggggcattcacatggtaggtctccaatcagggataataacttaaatgatgcagaattaggggaactggacttttcatttgggagagcaagtgataaattatgtcctaagcttttgtgccaatagggcttataacatttctccaggaagagcaagtcaaatgtcatagaatttggcagaactaagcaagaaaaacaataaatgcagataatttaatagagccaacatttcttgagggctgactgtatgccaggcccttaatttgaaggtgccaagtttatatgaatgtattgaagaaaatatatcacaggaatccaaaatgaagatgagtgtgcctggaaaatattaaaaaactgtaatgtgcagtggaagtacgggggagcttgctgaacatggctcaaggttaaaaaagacagatgtgagacaaggagagcacagagggaaacctgaagtcagagtcacagagctgtaatatcctatttttaaagaccagaggaaatgggccttaagttacagagtataagcttgggttgaatattaggaaaactttctgaccgttcacattgtgggttcctggaaaatattattatgggaaattgtggaatttcctattcccaagataggagaaactctagaacaataattgcctaaattttgatggggagtggggtatttaagcccatttattatacaatatacagacacatatacatatttagtatcatgattcatatatgtattcatatatacacattatatatatccttatacaattgatatgtacatgctgaaatttgaatttccctagtcctcaactagcttatgagtatgaatgaggtcctgttaataacaacaactcaacatttttcttttgagactttagctctgtcgtccaggctggaatgcagtggcatgatcagagttcactgcagcctcgacctcccaggctcaagtgatcctcctgcttcaacttcccaagtagcttggctgggactacaggtgtgcatcaccatgcccagctaatttttaaatttttattagaggtgagttttgtcatgttgcccaggctggtctcgaactcttgggcttgagtgattctcctgccttggccttccaaagtgatgggattacaggcagtagccactgtgcctagccagaaactcaacttttactggcttactcttcaggacctcccgctcctatcagagcctccctccccgacaacaccccagttatttcaggagtgccttggggtctcttcatgtttataactaagtctgctctggctgttccttccactccattttgtgtccatggggcagagcagtgcccaaccagtagtcatgattcctctgctgggcacctctgctgcccagccctcttgggttcggagttccactgtgatatatggcatagttgtttgaggatgagggtgaggttgaagtgagttctctctctcttctgcttgttgcattggacggatctgccttatacctcaatgtttccagacttcatttttatttacaacccttttcttctcacctctgggtggtaggaaggtctcctgaatctagtatgggttggtcaaacacagctacactgaaaattacatatgtctctaatggctaaggctttcctttggggtgaagttcatggtccctagctctctatgagtttagaatggattttctcccaccaagccgcttatattaatggatagtagagtttggcagtagggcttggtggaatttgatgggctatgccgtgggtttaccagatggacccagatatgcctggaacccacagtggacacagtttgtgtctcttctcagaagactctccctcattcttgcttcttcatgtggttcttctctgttgtcttcccatcaatgcagattgctctagtatcgcccatctttaaaaattgcccttgaaactacatcctccctccgctacttctctatctcttgactctctatctcttcacatccaaacctctctattacagcatcctgttatttgccttcataaacagctttcatgacaatatataattatctatgtatttgggtgattatttaatatttattcctaattaagcttgatatcatggatcatgaatgtttattttccttttgccattttatcttcaaatatctagcacagagtttagtgcagaatatgtgctcactgaatatttgttgcaagcattgaataaatgaataaatgaaggaaacaggtttctggtggacgactttcccagcagccaagtgcacctgaaactcacttctgtttgagctaggacatttggtgagtgagagagaaagagagatacgaataatggggaaatcctaatgaaatacatacttatccaaaaaacccactatatcctcttcctgggcagcaaatatagacagctatttatttgtaaataaagtcataccttggtggagacagaaaaaaaaggtttgaaaatcatcctcagaaaacagcttgggaaaagagattctgacagcacacattatcacttttcattatttaacctttcaaattacttctttagggaggtagaagacatcgtagaaggagtgaaagaagaaaagaagacttagaaacatagctcaaagtgaacactgcttctcttagtttcctggatttcttctggacatttcctcaagatgaaacttcagacactttggtgagatttaccattatttttcttcttactatatctttttaaaaagccccggatcaatacatgaccaaggtagatcatgacagtgaaaatgaaagcccctgaaatttcctctaaaaggcagatacaaggaatatctctgattttctgatctgctgacataatgcctaaatagtcaaaaaaaattccagtaggaagtggctttaaatcactattaatgtttataaaaacctattcaactttagaataaagtttaagataataaatcatggattcatctcattttaaatcaaggccttttatatttgtttttttttctaataaagacatagtcaaaatgtcatcatatcttgcccaaatctcccaagggctgaaatttgaatgaaaacatacggtgtttttttcagataaattagtatcttttatgcaagcacgtatcttgggcatttttaggtccaaatgaggtataaaaatgataaatattgagaaaagatacatacagaaaggctatagtaaaatgcattcaaagggagccatttgtactttcgtaaactatctcgctgtctccttccccagctctcctaaccaacccttcccgcattcccacagtcacaaactatttattttcctttcaggagttttttttgaagaccaccataaagaaagtgcatttcaattgaaaaatttggatgggatcaaaaatgaatctcattgaacattcccatttacctaccacagatgaattttctttttctgaaaatttatttggtaagttgtcaagttcatttgaatatcaataagaacaaactacgatttggaaatacatgaggaaatgcctagatgatgagtccagcccagggtcaagaacatgtttttgttccttccaagtactcaatcaatgttagctactctgcaaggttagaggtagatcggaccttggattcatgggacttaatggtcttcatttttatagatgaggactgcaaaagctttgtgaattgctcaaggccgcgaggctagataattaacagagcagggagtagaaagcgattcctcctctaaggctaattccaatattattatagcaggtactaaactatgaaatcatgattcttatggcttaatatgacacctattaaaggctgagtttacttaggttatagctgggcagatttccttttgcagttcctccggtgctgggggatctatggcacagtgtcaggattagtcatttaagcaggattgaggacaaattgtactaagcagttttcagtagatctgtaactagatgataccataaaatgatatattgctccactttatgcatttatgaaaaacatctcattataaagagtttcaactgcaaacattaacaaagatttaaccaaggcaatattttgggtgggacagggagcctttctgccagtgttaaaataattcccttctgcataatagccctgctggcagcctgggatgctcccagttttcaccctccgttaatatatgggccatgatataccataatagtgaaaatgcaaacactagaagttcctcaaagttcaatgtatgaaggcatgaccgcttatttggttgctgatattcctaggacctgttaattaataatttgttctgttacctattagtcattagcactttagtgtgtaatagttgattaggccatttccaaaaaggggtcattatttgtaataattatttacatgtgtacctgcctccatacagtacaaatgcatttaagggcagtgaccatatttcattaatattttattatccagtgcatatttagtaggcacttgataaataagagtccagtaataaataatagaagggaaaagaaaaagaggtttatggaaaaaacagatgttgatccgtaactcttagagagaccaaaggcggcagtaattatttattaaatgccagttctcccaagtacttgctgcatcttatttcttccagttggcttatcttcatcctgtagatgcagtcaagggcagtgggaggccctgcctccatgtctagccacttgaccatttgcttctggcctgcctgcccttccgtggttcctcagaacagagtcaatgtatagacatcttaatgattttttcttctagcaatcagaactcacagaataattaggactattggcacataccacagataaagaaaaattgcactcaagattttttttcaaacagaaacttccatttcctgctgtaaaattttatgattgtaggttgagatctctgagcttaggcttcatcattactaaaccaatctattcagctccaatttgcatacagagagaaaattgtagggttttccttacaagctagcccaattttcagccagcacagaagatttcagggtgatttcagcagccataaggtgaaaaagatgccagtaaattcagaaaaagccacgaagatgccgtcaggttagaagcatctaaagatgattgctaaggaagcactgtgccttctgcttttatggtgtggttctctcctctctctcttttgctggaccacattcttattccatttcctaacactgcatttaaggtttctgagaatatatagcacaagctgcatgagctgcaatgcagagctgtaattctttgctggagcagtttcctcaactctttatctggtcccctcttctggtaaactaatctgaccatgtgtgaccattaggactccttttccttttctccactaagctgtagagccacgtctaagcattattttcaaatctctttcccctaggccctcagtctcacttcacttaacacatctgagctaggctgggcatagtggctcacacctgtaattccagcactttgggaggctgagggaggtggatcacgaggtcaggagatcaagatcatcctggccaacatggttaaaccctgtctctactaaaaatacaaaaattagcttggtgtggtggtgcatgcctataatcccagctactcaagagaactgaggcaggagaatcgcttgaaccagggagtcagaggttgcagtgagtcgagatcgcgccactgcactccagcctggtgacagagtgaggctccaactcaagaaaaacaaacaaaaaaaaaacatacctgagctaaaggtatgccaaaggggaggacgaagaaaattttgattcctttattcctcttcctcatcttcttgtgtgtcatgatgacattgatggcttctatggccccttcatgtgcgtagggtggaaggcaccagggaaaagactggcccatgaatgagtagcccacaggcctaactcagtactcctgagtctaagctacgccaggggttcagaagggttaatccatgggttcaactgcccagaaagctggactcttttccagtggttaactgtgtattgaaaacagcagtcatgttgttataataaaggcaaacaaggttaatggaatagtctatggatagctgtcacttcttctcttcaaatatcggacactgacaatacgctgggccttggaataaagcagagaataggacaggcaagatcctagtagaaagcaaactcacaataaacttgtaagtaaatcaataaacaaaataatattatttttataccttatttggacctacagatgcccaaggtagtgatacatgctatgaaggcaacaaaatagggtgatgccctatagcctggagtgatgggctgctctaagtggtatagtcaggaaaggcccctgaggagtccacaattgagcacagcctgaaagacaagaagccagagagaacattccgggaggagacaataacaagtgcaacggcccaaagtctggaatggactcagaaggaccttgtcttctactcatttttatttaggggtggacaactgctttcccattaaccagctgtgcagccttgaacagctcactcaagttcagttggtaaaagtagattatcaggctgggaattctaggacatttactcaaattaaacatttgagtccacaaaaatgctactgttgtccacgtcaggaagtggtgacttaatggtactcacttggtacacggctcaacaagtccttttaaggtggtcctgggcatggtccccttcactgcaggttattataaaggtcataattcaatgacaactttaaggcatttagaaggtgacctgaagacaaatacagacaagcactcactactgggtcctggagacaataatgaccttttcagtgataacttgcagcttcttctagaggtgaccatgggccccttactcttcaaaggctttgcttaaggtgaaggggaaatttcttcacccctgtaatgtttattccaaaaagcagagcccaaatgaggacttgtgtgaaggcagtttatgtgagacatgatgagggagtggaggcgagggagtgggcgatgcaacagggaaggagggaaaaccaaagaggtcagttgtcaagatccctggtgtgggggaggccagcttgatgccactgggagcagcacagagaactgtcagcagaggggtcagggactggagcatatattaatattaactgcccctcggctcccgttggttgagcgtcaccccagggggcattaattccccgcacttctggactgtttttgagctcaggccaagctgtctcctgtgggattagagaagttctgggcagaaagcataggaacgtgcggcatgctcttgaaatgacaggtggtcagcctgcagtcatcatctgagctcgtgtatgatcagctgccacaggtatggccgagatcagagacgggctgaagggatgtgacagctccaccagaaaaagaagaaaagaaacttggacagaatggaatcagagagatgggggttggaatcacctccctgaagtcctttaatttattctgttgccagacatccctgacaaatccagacggaaatctagcccgtcggtaactgaatccacgtagaggcctgggggtggaaggacacagttaccacacagagattcgtctcctttcctctgggagatcctgcaagccaggaagcttggtcaaagattaatttagtggattaaaaaaggcgtctctgatgaatgaataaggcaaagttttatgcaattagtgcataataaaaagtaataatgacaaagtccacagctccccaccatctgacatagtgaataaaacaggagatggtatattaactaaagtctatatttacttttagcaaattatgtttttaaaactcaaaaattacaaaaatttagagactaaagagacaaagcattccaacaataagagaagaagcaagagaaaatacagtcttatcctcccacacccaatgttcctgggcacagtgattcctgattcacttagcacagtgacactgggaatggaaataaggaataaaatagcgggaaatgaaatctcagaggcaagtgagattctctgaacttcagtttttacccacataaaatgaggataataatgtcacacttcacaggttgttgggaggaaggaatgggctgtgtgggaaagcgctctgtaagctgcaaggcatcctaaaatgttacaattaatccagagtttgaaatgtagttgtcatattttaaattgttgaaatgataaacaccattccactcattaaaagaaggaagtactgtttatctcaacattgtggagtgcaaagaactttcaaggggccagagagaatcaacaatacgtaaataaggctgggcgcgggggctcatgcctgtaatcccagcacattggaaggccaaggcaggcggatcaccagaggtcaggagtttgagaccagactggctaacgtggtgaaacctcgtctctactaaatatacaaaattagctgggcgtggtggcacgtgcctgtaatcccagctactcgggaggctgaggcaggagaatcgcttgaacccaggaggcggaggttacaatgagatgggcgacagagtgagcctcagtctccaaaaaaaaaaccaaacaaacaaaacaagaaaaaaacaccaaaaaacaaaaacaaacaatatgtaaataaatttctggttacctcacctttgcattattacattgctaacaacagctttggaatccacgtcttgtattgcttttattattgtatctaacagtctttccggagccccattctgattgaggcctagcaagtgtcaggaggtagatcctatacaatcccattcacttatctttcatttcctttggctatttctcattgccttatgcttcacttagctgtgtatgcccattttcttagggtgcgctttatttctttatttttatttttatagagaaagggccttgctctgtcacccaggctggagtgcagtggcacaatcagagctcactgcagccttgaactactgggcccaagcaatcctccctcctcagcctcttcatgctttatttgtatcagaatacactcactttgaaatctgcttcttccctatgacttatgcttaaattgaacgaatcttccagatgttacagagtcagtcagatgttttaaaatgcaattaaaggttttgagatgcagtttgtagaatatttctgacatttgatttcaggtatttttccatctcactgagttcaactcaagtgaacgtagttctgacttcttgggtgaattaaagttcaaagtttccaaaagatagagagataccattgtctcagataaaatgaagctttgtttcagcatacttgaaatattttgtcactgctatttcttctccacagctcttccatagctgtaagcagtctctaaggcatttaatttactgttactttggttttttctttctcaaggaatctcagttctggttctcttgatagtggagtaaagaaatgggagaaggaaagaaatattgaatgagcctcttcttattacaaaatagattactgattctttcagcaggggcttgcagagtttggaaaaggtgtgcaatgagtcagagagttggccagctggtaggcgattccactgcagtctaggccttagctctcaaccctgcaggctaagaaacagattcttagggatgccaagttaaaaaagattgactataaaatcatattgcaaatatattaacttacaacaataaaaataattgtaatgataacagctagtatttcttgagtgctttatagaaattaatgtgtcagatatcaagctaagtacattttagatttgttaacagatttcctgggttggttccaatctctgccatctactaccctgtggtcttggacaaattccttaactttgcacaagttacttgccttatttaaataaggtgataagaagaatgcctggcacatcacaagtactctatttgccactaaaattcactctcacaacacacctataaggtaggtaccattactgttccccttttatggtgagaaaaggaatatttagtgatgttaaataatctgctaaacattccataattagtaagtaggcaactgaaatataatcaggacaaggaaacaaaatccaatgtttaagtctccaggcttagagaatacttctattaaccttgtcaactgggaaggtctttcaataagattatctacctttaaagtctgctgaccatgtctgttctgaaggatagttctcagaaaaaaaacattgccaacatttactctaggacctcccttttttcatgccttcatagctgatgccccactcagcgtgagaggtacaacattcacagtgctcccaaatactctgccgaacagtgccatcagatagaactttctgtgacgaaggaaatgttctagctctacttcgtccaatacagtagccactattcgcatgtggttattgaacacttaaaatgtgactggtgtgactgaggaactgactctaatttaatttaaatcaatttaatttaaatagcctgatatggttgggctctgtgtccccacccaaatctcatctcaaattataatccccacatgttgagggagagacttggtgacaggtgattggatcatgggggtggtttccccatgctgttctcatgatagtgagtgagttctcatgagatcttgttgtttgataagtatctggtgcttctcccttcctactctctctcctgctgccttttgaggacatgctttgctgccctttcaccttctaccacgattataagtttcctgagacttccccagccatgcagaactgtgagtcaattaaaccttttttcttcataaattgcccagtcttggatagttcttcatagcagtgtgaaaagagactaataaatagccatacatagctagtggctactgttttagacagcagagatattcaggaaaaaatatttttttagggaaaaaataatatgagacagttgatcatctctaagagaaattcaaagggatccaatcagtcttgttatgagaacattctgtgtgaatttcactcagcaacaagggtttcctgggtcagctaaataatcctgctcatttcttatctagtatagatgtttctgagggcaaccgacaggtccatttattttggccagtgaaaaacttagtggagaattcttgaaatggaaaattctgaatcattcgtctagcttcatatcctttgggtagctttttcacctatgaccctctcagggaaaggatagctctgggattgtgaggaagggagaacgaggtcagaagtaaactgaggactgaaaatggctttgcagatggtgaccccgatcaagcaattcaaactgaaatatacccatagaccaccactcttttcctctttcttggcaattagggcaagtgtaccttagtttttccaccacgggattttgagtcagaagacctgggttaaagtcccagcttcattccttactaatgggatgactatagacaaatcactgaaactcactgagtttaaaaataggcttaaagatagtggaagttagaaataatacctccctccaagggtgcaagtgaagatctgatgagataatgcatatggaaccgctttggaaacttgtgaaggctatagaaatgtcttagcaatgattattccacttgtatagctcacctttgcctttcaaaattgctttcatatttactatctcattttatcttcagaacaggcctaaatagggcatgaattattatctatgttttaccatctattgatgtggacaaatggggcccacagaagctgagagactcatctaaggttacacagtgcatctcgctacattatgcctgggctccaccctggatcaactgagtccccttctaaagccctcatttctaaaaaacaaccaatagacttaagcttgatgtacaaaagttatgctgaaggataaaatatagaattattcctattcaataagcaacccaaggtacaacatgagtccaaagctgagcaatcataacatcaatgtagtgatgatgggtagccacctgttgtgctaagcattttataaatactattttagttaataatcacgtataattctttgaggttgtatagttatcaaccccattttacaaccaaggaaataaaggcagaaaatggttcaggaatttgtccattgtccacagagctaataagtgccaagacagcctggatgtattagtttgctgggtctgctgtaacaaagtaacatagactgggtagcttaaaccacagaaattatcccatagttctggaggctggaagtccaaaatcaaggtgtcagcagggttagctcttcctgaaggctgtgggtggaggatgtgctccagggctctctccttggcccacagatggccatctccgtctcctctctgtgtgttcacatcaacttccctctctgtgtttctgtctctgtaaccaaatttccagtttttataaggatacaagtcatattggatcttcattttaatttgattttctctgtaatgaccctatcaacaattaaggtcacattctgaggtactggggtttaaggcttcaacatatatacatcctcatcttacaatggttcaacctactatgtttagactttacaatggtgtgaaatagacacttttagcatagttttcaataaattgcatgagatattcagttctttattacaaaaaaggctttgtgctagatgattttgtcttacatggtggtaggcatgtcttacatggtggtagggaagacagaatgagagccaagcaaaaggggaaaccccttataaaaccatcagatcttgtgagacttactcactaccacgagaacagtgtgggggaaaccaaccccatgattcaattatctcctacaggatccgtcccacaacacgtggggattatgggagctacaattcaagatgagatttgggttgggacacagccaaaccatatcaagcattatgctttaaattcttccattttaaatcataccattccattttaaatcataccattctgccaccttttgatggggacaaatgtcaggacccggagcatggcacttgacctccaagtccagttttagagccagtgaacagaaacccaccctctaaaagttcttaaactggaaaagtactcccccaaaatgtttatctaagagactggtttccagcttactaggcaatttggcattaagaactttcctcataaacatttacaaatattctgctccgtaatgaagttaatcagtaaaccacacaacctctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtaggacactgttcacaggtgctttcaggtcgagctcttgcaactggactgaggaaatctggggactttggttggagatgacagtaacagatgtctgtcaaagatagtggctcagtcagacccagaagactggaatgagagtttgggttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatagaatagaaatattagtgtccctcaaggagtaaagacaagtggtatttcatgaaattttgtttcagttacatgtgtataagtatgtacgagggatatgagataaaatgtatctaaaaccgtaggttgtggtaaaaaaaaaaatgaaaagagtttgggaaacacgaattaatgaagtagtttcacagcaggtttctcccaatagtccatgaaaaatcagataagcacagagttgagctttaggcccaggctcttggttttctctgaattaaaacatcgattataattaaaacacagtataatgtaaatcatattttaatattttttaaaacagaaattcatcttttaaatttccagcaagaaaaaactcgagtcatttttataataatgataattgtgaacatgtttttggtcatagacttggtagcataccattttgtttaaatgcgatgtttaaaagtgaccgacactgtatttagaaatggaaatgagttggaaggccggggaagcaaattttctatttacttcaatttaaccaacatttaataaacatttactatgtgtcagccattgagttagatgccaggaatataaagaaaagaatatagtctaatattttccctcaaagagttcacagactaatcacaacaatcacaaaagtatacatgtgtatgtggtgtcaggcactatgcagtttccattctttgtcttagttcatctttattacagcctctcatgcaggcactacattctttcagctttgtaaaggaaggaacagaagcttaaagaagttccatgtctttcccaggttcatatacctaacaagttgtgggtgaaatgaatccagatttgtctgctcagagggcactcttaggtagtatctcataccatctcaagttcagcgtggaagataagcctgtaaacaaaagaaatgattgtatgtgcttccaataagtgccataatagaagtgtgtacagaggtaggagaggtgaattccacctgggggaactggggcagacctcccagagtaggtgaccagaagtaggtgatcagctgacaaggcagggagaggcactgacatcacaaaggcctgatgccaggaacagcaaacaactttgcagtaaagccctgccatttagtgaagaaaccatggattaagaaataaaggaaggcaaaaaaaaaaagtgacttttctaggcactgcaattcaacagacattcattaaacatttactatggtcagcattgtgccaggaatgaaaaactggatataaactggaccctttcttaggagcatcagaaactcactgtgagattatgggggagtgccattgtttttatgcaaacctgatttcccatttgggggtacagtggttctggtcccaaactccttagagctgcactggctaatatgccacatgtggctattcaactttaacttagaattaaataaaatttaacagtcagactctaagtatcactagccacattccaagggttcaatatccctatgtggttagtggctaccatattggtaggtacagaacccttctatcacctcagaaagctccctcagatggcactcctttagagaaggtgttgaaacctggagactgtctaaccagaagaattttactttcttttcagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccacatcttattttctgccaatgttgtatttgtttacttgtttacttatttttgtcctaacccttgacatccccacttcccaaaacacacaaacaagagaaaggctgggccttcgtatgtgtcttttcactttcatatgttcagaccctaacacagtgactgctaaatagcaagtgtttataacacacacacacacacacacacacacacacacacacacacagagagagagagagaacatgagcatatgtttataaataataatttgtaatgaaagaactatcctaatacttatatcatcaagacagactgtgttaataattacttattaactatcaattaactatgattaaaatcaggattttgctaggttctttaggaaacatgtcttttaatgacactcaacttaccgaaactgcttctcagcaaccgtattttacactcagaactaccttctgagatagcaacagtcccatttttataggagagattgaaataggaaaagcttagccagttaagatctcatggtcagttaactgtggaagttgttctagtccaaccattttggaatatttggccatgctggttctttggttgtaaagttcctttgtaattacttctctatttgtggagatttaggagacacactatgaaatgctagaagtgaatgtgctttgagaatagaaggttttttttgttttttgagatggagtctcgctctgtcacccaggctggagtgcaatgacatgatcttggctcatcactgcaggctccacctcccaggttcaagtgattctcctgcctcagcctcccgagtggctgggttacacgcacctgccaccacgtccagctaatttttgtatctttagtagagacggggtttcaccatgttggtcaggctggtcttgaactccttacctcaggtgatccactcgcctttgcctcccaaagtgctgggattacaggcattagccactgcacttggccaagaatagaagtattatttaatattattgtgtacggttctcatatttttactgatgttctactgttttagcatgatattatctatatctttgtgaaagctttccattttgatctagattattccagagactgaaagacagggatattattatctgacttgacttgggactcctttgtatttcttgattatgaaaataattgttttgttgaaataatgcttaaagattttagaattgtcatatgaggagaaaaaaagtacacatctccttggatgctacagaatccagattctatcggtttttgatcttgggcaaattacttaaccttactagacctgtggcagagagaaattgggctaagggaggaaggggagttaagggaataagataggttagaggataaaatctaagtgtacgtgaaactaatgcttttaatactttttagtttttttcaattccattcactccagaaattttcatcgtatttggtgatgaaatagatcaggattttgcttctattttatcttttctttttgtgtaataattccatatttttctccttccattttgcggtcataagacaaggcaccatttctaaaatattttgtccatcagacatactcgtttttttgtttgtttattttattttgttttgtttttgtttttgttttttttgagacagagtcttgctctgtctccaggctggagtgcagtggcgcgatctcggctcactacaaccaccacatcccaggttcaagtgattctcctgcctcagcctcccaggtagctgggactacaggtgtgcaccaccaagcccagctaatttttttgtatttttagtagagacggggtttcaccatgttggctaggatggtctcaatcttttgaccttgtgaaccacctgcctcggcctcccaaagtgctgggattacaggcgtgagccactgcacctggcctatgctgtttttatatggataagtcacacagaaggaaaggaaattgatttttgtacagatactgtataccatgtgttctgtcaatcatttcctgggttaatgcagaaagcattattttcaacatgtaatatgtatattctgaaatttggcagtgtagaaaagccctaaattctaatgttcataaactattagtcatatacttatggagacttttagatataaagaagaactagaagattatctagggtggagtcttctctttacagatgaacagagggaggcccaggtagggtaagtaatggtttttaaatggcatgtaactagattcaggaacatgactgccagggacctagaaacctcttctgttgggaagacttcccaagagaagcaatacccacagggaatttagaggtaagtggacattagtgagatgaagccctggaaggggttggctgtgttgagaaccatttcaggctcaggaagcagcaggtgggagaagtcctgagtctggaagcggcaaggcacattcaagaaacagagatgtccgaacatgcaaaatggctggaaaagaaagcaagggtagagtcatgcagaagcttgcaggcccagttataggttatgtgcaagcggaggccgagaagggggtacaaacacaagtaggaggatgcagagaggggctttgaagatcatgtttttaagtatcacacacctgaaattacccccagagagcagcaattcagtgcatgggctttgagattagactcctagagctcaagtctcatctacttaggtaggtaggagtaaagttgcttaactactatgtgcctcatggtactcatttgtaagtgggggttaataatgttacccacctcatagagttttgtgaggaataaatgagaacatacaagtgcctgctactacgaagaactctataaaagttttctgcaaaatgtggtaatagtaatcataataattatagtaatcgtttcaactatcttttgagcacagcaaagagcattgccaatttgaaatccccaaagccccaaaaaaccacgtttttctaaaagtttggcacacacttttttggtgacagaacctgacctgaatgaatgtgaaactatttatggtctttacttattgcacttgctgtgaatattcatacgtttccctgtggaaaatattgctgtatttgattctgggttctgttccagactgtgctgggagggatatataaatagcactgtattctgttctgaaatcctgaaaattctgacttctaaaacacatacgactgccagggtttcagataaggaactgtgaatctgtatcatctcactcaatcctcagactaactcttgatatcgatattatcatcccaaccttgctgccatgaaaaccaagatttatcaatagtttgaataatttgctcaaaatcccactgttcataagagatggaattggaattttggtctagaattgtctgacaacactttgaagagtcagacacatttgtaaactttcctatctcttatttatgtctattttttcagcatttgcataatttcaattttttattttctaaagagccatagttgatgtttccaggaaatagaagcattttcataacctgatgattttctattacctagaggttttctaaataagggactcctttaataatgatggtagtaagaataattgttattattcctattttaagtcagctataatttatcgagcacttctgtgtgccaaacatttagcaaagcacttggcacacattatctcatataatccttacatcaacccaatgaggtaggtgttattattctctgttttattagaagaagactgcaacttaaagacattaaggaattgccagctgcacacagattgtaagtaacagagcaggaatttgaatccagtagatagattgcaggcactgtattcttttttttaaagctcctcctttgttttataatgattaaaataacacatacatatacacatggcaaaaactacaaacagtaaaaaaaattatgcaatcttctatcccagaatataatgtaaaaatatcacctctcacagtcaccaccacctactttcttctgtatcatgcagaaatttgtctttgcacgtgggcacgtgcgcgcacacacacacacacacacacacacagagttggtgtttaataccgatgtgaatatacacattggtctatagcttacctttttcatatagcaccatattgtagaaaatttccataacagcacatagaaatctaaataattgttttacatctacttaatagtgtatggatgtaacaaatttattgaagcagactcctatggatgaatatttagatcgtttccaatttatggctcttgcgaatgtgctgcaagtgaatatttttacaaaatactttttcatagaggttcaagcatatttctaaaataaattttcaagcagtggaaaatttatgctgggtgaaaaggacattgaagtttaaaaaactggaaaatattgacaaatttccccccaaaaatatttgtttccccaacagtgtgtattattaaactttttaaaccctcacacatttgaagatgaaaactgtaatgttttagtttcaatttaaatttaattattggcaaaggtgagcacatttttctgtttacaaaacacggttatatttctaacattgactattcctttcctttatccctttttccatagcttctcaaatattttcttattggttttcaggagctctttatacattaatgagatgagtctgtcctctatgttgcagatatttttctgaatttttaatttgtcatttaattttatatatatatatatatatatatatatactctaaagaagttgtaaacttttatgtagttaaatgtttcaatcttttcttagagcccacactcctaaccattacgccaaactgcctctctaatttccagaatgatgacattcattccagttttgttgtcacttttgttcaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtaagcatctttgattggcagttttctccttcaggttttactatattggttgttgaaatcccttgaactaattgcttcccttttcccaggcaacttcccattttctcctcctgtgcgcctacctcctcctacatcctcacctttgttgtgtagtcaaagatctgtaggaaaagactgttagagtatttagcttaatgtttaagactgttagagtatctagcttagagtgtttagctttcttccttttcacaacctcacacgtagctaaagggaacttatgattaaattgaattttttgtaggttttgtttgtttttgttgtttttttaaaaaagaaagaagaaagtgatgaacacatctcttttaaaattaagatctagaagaatacaactttattcaataaatatttaaaaatatttttcatgtactttagttaattgagaaagagagaaagaaagagccaagtaataatagcttatattacaaaaaaatattttaacttggcatggtggctcatgcctgtaatcccagcactttgggaggccgaggcaggcagatcacctgagatcaggagttcaagaccagcctggccaacacggtgaaatctcgtctctactaaaaatacaaaaattagctgggtgtggtggcaggtgcctgtaattccagctactcaggaggctgaggcaggagaatcgcttgaacctgggaggtggaggttgcagtgagccaagatcgcaccattgcactccagcctgggcaacaagagcgaaaatccatctcaaaaaataattttttttttttttatttagcctaggcatggtggctcatgcctgtagttccagcactttgggaggctgaggtgggtggatcgcttgagtccaggagttcgagactagatagagcaacatgggaaaaccccatctctacaaaaaatacaaaaattagtcaggtgtggtggagcacgcatgttgtcccagctacttgggaggcagaggtgggaggatcacctgagcccgggaggttgaggctgcagtgagccgtgatcatgccactgcactccagactgaatgacagagagagaccctgcctcaaaaaatatatattttatttagcagtaatacagttctgttatggatgctatagagaaatcataacaaaattgcaatccatttaagatggataaaatataataaatgaaatataaaaatgacaatgtaggccgggcatggtggctcacgcctgtaatcccagcactttgggagaccaagacgggtggatcatgaggtcaggagaatgagaccatctgactaacacggtgaaaccccgtctctactaaaaatacaaaaaaattagctgggcttggtggtgcatgcctgtagtcccagctactcaggaggctgaggcaggagaatggcgtgaacccgagaggcagaggttgcagtgagccgagatcacgccactgcactccagcctgggcaactgagcgagactccgtctccaaaaaaaaaaaaagacaatgtaaagtcccatgtgattactgtctcaactaaggcacagataatcgtggtatttattcattaaacaaatattttgggaacacctaccatgggtcaggcactctgctaacatctagaacattgaatactgaataaaaaccatctcttgagcagaatctttcggatggtgtgacacactggggttccctgatgttggtggttgccacagaaataaacagaggacccagtcacataagatcggctcaaggacatttcaaacctttgaaagttcaaatgatcagattgtgtaaagccacattagtcacttcttaaaaactgggtatgatattgttagaattttttttaaataaagaagcatttgtacaccaactttacaaactaaagcagatctataaagaaaacttaaaagatcccacttatggccttcagaatgtccttaacctttttgtggagagtcacgtctgaataggtaaatgaacttatacattcgttggaagcatagattaagtcttctctacctatattgctactcatagcacctagcacagtgcctggtacatagtaaatatggaatgtcttttgaatgacacaatgaaaaaccatgttcatcactggtacgtaattaatcagcctctactttgcaaaaacacattaaaatttttttttacaatacttaattctttcccatctccgaatgataaaaagtaaatattaccctcgattcctatatgaagtggcagatctttttgagctggcagagctgtggagatcgagatctgcttatgttaaagattttaaaatggtgtggaataaagcaggaaaacatttctaattggttagaaaaataaaataggccggacgctgtggttcacttatgtaagtcccagcactatgggaggccgaggtggggggatcacctaaggtcaggagttcaagaccagcctggccaacatggtgaaaccccatctctactaaaagtacaaaaattagctgggcatagtggcacgcacctgtagtcccagctacttgggagtctgagacaggagaattcctcgaatccagaaggtggaggttgcagtgagctgagattgtgccattgcactccatcctggatgacagagcgagactccgtcaaagacagaaaggaaggaaggaaggaaggaaggaaggaaggaaggaaggaaggaaggaaggaaggaaggaaggaaggaaaaaataaagtagtttccaaatgacaagccttgaactggaattaaaataaacaaaaataaaacttctacagttaggtttgagaaaccaactgctgatctacaggaaagaaaaagaacaaactttatagtagctctagtcaaaaagtggctggggctcttacactggagggcaaattaggaccaaaagatgaagcttataggatggcatcttttgaggcctaattcaagaattaattttttagcactaacatgaattgtcccaacaatgagattggctttttgccttaggtggtaacgaacttctcattattacaggaattcaaaaagaggttagataaacaggtttgagtacaggagatttgtatgttaggtgggacactgtattagctggcttctgaagtccttccttaaattctgtgaatctgtagtaccatatttataatattctaatctgcctgtttcatcttctaagcaagtttataaatttcataagttaaaaagtgactataattcatgtactccctcctgttgctatgaactgatgaaagggaaagctagaccatggtttttaaaccttgacactattgacattttaggctgaaaaactctgttgtggggggatgtcttgtacatactgtgggatatttagtagtagccctggcttctatccactagatcccagtagcaaccccccacttgtgacaaccaaaagtgtctacagacattgctaaatgtcctctggggttacaatcaccccagttgagaatcactgagagagactattcagtgaaaagtataatatagagcttctcaaacttgagctacacctggagatttcttgagggaagctataatatttcttgggtgcctctaatgttgacttaaattgcttttaatgaattacttatgctatcaagcaattatagcataagctatattatattataatagctatattatattgtgtatcatcttttatacactgaaaaatttctatacacaaaggaacaaacacaaatttacaaaattacatacaaacaaaactacaaaaccaataaaataatgaagtatattagattgtatggttttgttgcccaaaatgttaccaaactcaggttcttttgagtttggtatcactagaccatgtgtcatatgaggcctcaattctccactgcttttctctcttcgaagaattgattcaaccaaacctttgttcatccagagctccatttggccatccctgagctgggtacatctcaggcatatgaagtttgcctttgccattttgtcaaagctttttttttttttttttttttttgagacagagtcttgctctgttgcccaggctggagggcaatggcatgatctccactcactgcaacctctgcctcctgggttcaagtgattctcctgcctcagcctccccgagtagctgggcttacaggcgccctccactatgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgagggtgattagtttgaatatcagtataagatgatcatagatatgatccagagaatgctattattagttttttaaagactggcataaaataaaaatgtaaaaaataaatttaatatgtgtaaaggccttagaaaaaagtgtggcacatagtcaaaactcaatagatgtctattgttattattgttatggtcctagaattgatttacatatcgtgtaatggcaatgtgagtgttttctgcttatattgataaatattgatgctcaaatcatcgtgagttgtttaacaagatttatttgacatagattcagattacctaaagccacttcaacttgtctgtgtagaccagtgctactcaaagcatagtacctggaccagcagtatcagtatcactagagaatttatagaatgtggggttttaccccagacttactgaatcagaatttctgggaaaggggcccaagaatctgtgatttaaccagcactacatgctaaagtttgagaatactggcgtaaaaatcatatccaaaatcttcctaaggccactcatctggccaagcatcttggttttgtgttgtgagtgtgaaacccacaggatgggaaaagagaataggaggaatgctactctccatgaggtcatcaaaagcacaattcagtagaataaaatgtagacttgaaacctggactggaaagacacaaagcctaatctaagtcatgtttcctgctgggagagaaagaagcagaaaagaacacgcataatttattcggaaaatctgattcaaaagaaaaattccaatatacatacttttgaacctacaaatttcagtgctgatgacatgctaattctttttttttttctgaaacggattcttgctctgtcacccaggctggagtgcagtggcgcgatctcagctcacaaactccgcctcccgggttcacgccattctcctgcctcagcctcccgagtagctgggactacaggcacctgccaccacgcccggctaattttttgtatttttagtagagacagggtttcaccatgttagccagaatgatctccatctcctgacctcgtgatccgcccgcctcggcctcccaaagttctgggattacaggcgtgagccaccgtgcccggccgatgacatgctaattcttatggtaggcattttggaaacattctctctgatctttacagcaactatggaaagtaggaattattgtgtctattttaaaatgaggaataagcatatcatttccaaaacaagctaagatatagagatgccagtgctaatagcttgtgtgatgtgtttactatactttagtaatacacttattaattctcatatcttatgtccattttattttattttcttaaatttatgattgacataataattgtacatgtttatggggtacaacatgttttcatacatgtataattgtgtaatgatcaaatcagggtaattagcacatctaacagcttaatttatcatttcttcattatgagaatattaaaaaacctctcttctagttattttgaaatacacagtacattattattaactctagtcatgctgctatgcaatagaacatcagacatattccttctatctaactgtattcttggacccgttgactaatttcactgtccccttctccccccatcctcctcatcctctcataactaccattctactctctatttccatgagaacaacgttttagattctacatataagtgagatcatatggtatttgtctttctgtgcttggcttatttcatttcatgtaatatcctccgggctcatccatgttatcacaaatggcaggatttcattcttttttatggctgaatagtattccattatgtatacataccacattttcttgatccagtcatccattgatgaacgcttaggttgatcccctatcttggccattgtgaataatgctgcaataaacataggagtgcagatatctctttgacatactgatttcatttcctgtggagatataccctgtggtgggattcctggattatatagtagttacatttttaattttgtgaggaaacatcatactgttttccattatgactacacaaatttacactcccaccagcagtaagggttgacttttctctacatccttgccaaaacttgttatcttttgatttattgatagtcattctaaatggagtgaggtgatatctcattgtagttttgcattttcctgatgattagtggtgttgagtgccttatgcccattttatggaagtggaagctgaagcataagttgttaatctatttacccaagttttcatagctaataagagcttcaaaactatagcttataatctaactccagagcctgtatgattgaccactaggctatgatgccttttattggttgtccactaagtgattgttctgctcttcagttgtttgctcaagggtaatattgactaattcaatggcgagaggaagaaaacgaagcagtccgtttagctgttaaagaatcagtagtgtctaagccaagggaatgaatccctaaagtcactaaccttggatagcttacctccttagaagagaatttttctttctgtcttgtgaactgtgcttatgaccaagtgaaacttggtccacctgcgaagagttctggggcatggcagggtaaatagagtgagaccagtgggccaaggacaaccctggaaaacacttaccttaaaggtggtcaggggaagagaagcccacaaaggatatagaatagaagtaatcaagatagaagtctacaaggaagtgcaggatcacagaaggcaaggagatggagaaagtagtcagaagagagccaacctttggggaggtttaggaaggagaagctggatttggacataaatatatttttaagagcagagaaagacaaaatttttccattgattttgatttgagacgttgcccccatggtgtcaggaaaaggacaagcatgcaagggagaggatgggttggaaccaggcagggcccatgttctatgccagggattggcacatttttttctgtaaacatccagacaataacaagttgaggcttcacaccacagcagcctctgttgcaactaatcaactctgctactggagtgcaaaggcagccacatagaaaatgagcatagctatatttcagtaagctatacttacaaaaataggcaggaaaaaaaatgacagtgggctggctgcagtttgctgaacactgttcttgaccaatgacttttttttttttttttttttttgagatggactctcgctctgtcacccaggctggagcgcagtggcaatcttggcccacagcaacctccacctgggttcaagtgattctcctgcctcagcctcccaagtagctgggattacaggcaccagccaccatgcccagctaatttttgtatttttagtagagacggggtttcaccatgttggctagggtggttttgaagtcctgacctcaagtgatccacccgtctcagccttccaaagtgctgcggttgcaggcatgagccaccgtgcctggccttgacccatgactcttaagggttggtgtacgaattaactggaagctgtgtagtgaatgagcacaagattcaactcacagcccctatgtgagagaaatgtaactttattttttaaaattggatttaattcagtctagagctcggtggaaactttatttcattttattcagtatcattccattcacccccgccaaaattcttctggcggtttatctaagtaccaggattaagggagggttgtggagggattgggcactggggagtggggctctggccccacagctgtggggctgggtggggcttggtgccacagctgttgacacagtctgagatctgttggagtgctgttgtatttggtcttcagtcaccagtgggaaaggtctctgtgacaccatcctggggtactgagcacactcttccatcacgtctggccctggctgtctccttcattcagctcaggtgggtgggttctgatgttgcatcagtgctgtgttgggatgcctggcttcccagagaaaccatgctgccatttcatctgctctatgccatgctgggtgcagagaaccctgggggtttctccagttctacccaggaaagggcataagaatcctcgtcttccaggatcccaaatgacgtggagtttctataatctctcaatccacctatcctaggattctgtctggggatagggagttgggagggacagagctcaggaccttctcaggtacctaacatgtcttagctctttgacttcccctttagttgtctgcttcctcccgacttgaataagttttatctggtcttcaggattgggggcttaagctctggcgtctgaaaagccaaaaacaggctcctttatcttccttatgtgttctcctgtgaaaacaaatgaaaattatcctaccttagtgaatggaggaatgaggaagggctgtgaggaaaaccagaggagaaggacagaatagagtggaatgcatatcagaggaccaatgcctcatgcctgcaggtcttgtgagagctgctcagccaacctggtttccccgctgaccccgcagcccacttcccccatgcacatctcttgatatctgcactcagcagatgcaaagcgaattatactctgtaactttccatcaaagggagcacgggctttgcgggctgacaagctcacattgaatctaggctctgcacttcttggctgaataaacaagttacttaatatttactggttagagttcagcaaaataaaacagaaaccaacaattcaagcagaaaagaattaatacagaagttggaagagtcagagtaacaggatctatgctaagtttctgggagatgctcagagccacactgcagaactggcccgccggttgcttttctgccaaaatcaagaagatggggactcaggaagccacctcaggactgttggctccaggaagacaccacctcagctgccatctagggatcaggaagttgccttcactggcaatcactaactccagagacggggcttgcctgccaaatctgcacctgcaaacaatgaataccctgtcccctgcctttcaataccctcaaagctagtgactggaagccagagtgctgccacagcaaaactccacaatcccgcttaccagtagaaacaacggaagaacagcttgcttctcctttccaaaagtcttacaagggcatctctatgggagagcttaaatcatatccaccatgttagctgcgaaggaagtctgggcaaggttatgttctactttcctgcctctctggtaataggatgtgcactagactagaagggaggtgcagaagatataaagctagcgaattcttaagaccgtgcaatatttattcctctgagcctcagatctgcaaaatagggatattatctattttgtgggacatttgtgtggattgtacaagatttatattacattatattatatattagaatttaccagctctcttgctttagtatttcactgaagatttgtcagtcctgtgatacttaaaacaaacaaagaaaacacaagagaatttaaaaaaaaaaagcaaccttagaaacaaaacaaagatcagggttaaatttcctcattacattggtctctttttctggttccactaaaaatattttaatttgtctcagtgttttatttgtcataagtatttatagcatcaatgagagaaatgatggttttcaatttttgtaagtaataacttgggaacacaagcatcacgcagaatgacaatgactgccactttctcaggactagattaaatcaagagctttcttttgccctcagttatcagtgcagcatatggaaatgtgctaatgtctgaatgaattttgattcaaacctcaaacctcaaccaacaaaactgatcagcatctaactgaaaatttcaaatggctgcatttccaaataggtcagtgtctgtcacatttgtttcaatgccaagagagtcttcacacatccgagaatggtagaattcctaaaagatgctgtctgagtaaatgagtgaccctactgcctttctgaatatatttttgtgtaggattgtgaaccagcattagacttaggtctgaagttttaaaaaagcttccaaaagtattgaaactattccagtatagaatagatgtagtgtttccaaaggatcctttgtttatggacatttgtgaaagctgaggagtgctgacctatatataaacttattgacatcctatttaagatcaagcaaggtctgattttatacaatttaataatgatcctaatgaattctagaggtcaaattatcttggagtatgatgcaagatggggttccaaactatttcactgcattggaacccttttgtagtaagtgttatgaaaatcgtgggaagagtaggaccctgaaggcaaacaacatgctttccaatcccagctgattctcttcccaggtgtcctaaattacttaacctttctgatctttagactccccacctgtaagataaggacaacaatgaagatgagataaagatgaggagatgatgatgatgatggtgatgatgataatggtgatggtgatggtgatggtggtggtgataatgatgatgatggtgatggtgatgatgatggtaattatggtaatgttggtgatgtgatgatgatgatagtaataatcatgttgatagataatctatatcaagtgattactatgtgcaggcactgttctgggaggctttatatgtactaatttgtttaatcttcaggacagtcttttgaagcaggtatctgtagattgtcatgaggattaaataaattgatacctgtaaagtacttaacagagttcttcccaatggaaaatcctcaatcattgcctgctattattactattatcattgggttgttgtgaatttaaaaaaatgggatattatttttaaaatatctagctctgtacctggcactctttttaaaaagtttttttttttttagatttcaatagcttttgggggtacagtcgtacaaatggttttttgttacatgaatgacttgtatagtgatgaattctgagattttgttgtacctgtcaccagagtgtatacattttatccaatatgtagttttttatcccacacttttctcccctcctcccttttgagtctctgaagtctattatacactctgtatacctttgcttactgatagcttaggtcccacttgtaagtgggaacacatggcatttggttttccattcctgagttacttcacttagaataatggccttctgctctacccaagttgctgcaaaagacattatttcattcctttttatggctgaatggtattccatggtgtatatataccacagtttctttatccactcattggttgatgggcacttagattggttctatatctttgcaattgtgaattgggttgcaataaacatacatatgcatgtgtctttttatctaattactttttttcctttgggtagacactcactagtgggattgctggatcgaatggtagatctactttcagttctttaagaaatctccataacgttttccatagaggttgtactaatttacattctcaccaacagtgaaaagcattcccctttcactacatccacaccaaaatctattattttttgactttttaaaaatgggcattcttgcaggagtaaggtagtatctcattgtcattttaatttgcatttccccaatgattagtgatactgaacatgttttcatgtgttttttggccatttgtatgtgttcttttgagaaatgtctattcatgtcatttgtccactttttgatgagattacttgatttttcccttgctgatttattgagtttcttatagattctggatactagtactttgtcagatgcatagtttgcaaatattttatcccattctgtgggttgtctgttcactctgatgattatttattttgctgtgtagaatctttttagtttaatcaggtcccatttatttatttgtttgtttttgttgcatttgtttttggggttttagtcttgatgtacctggcactcttacatgctcagtaatcattagatgtgattttgttggtgaattcttatttgttattcctctgttcattcaacctccccagtctgggtcatacactgttttcaaaactctccctcttcctattagttaacccaattctttattcagcaaatattattaagtaccagtttgtatgccggagtctattctaagcataggagatgccttggtgagcaaaccagaccaaattcttgccttcatagtcaccattctaaagcaaaagcagaaaaatagtctacataactcagctaaaatagacaaaaagagaaaacagtcaagcaaacaaaaagattaagaaatataaaatcagtaaaagagtatcgaaaagaatacgtagaaaaatgcaatggtaataaaatgatttccagggaatatgaactgacatttcacataaacatataggtgatgaggcaagacaaactaagatgataaaaactaaatttaaacaagaaaaaatgtttaaagcaaacatataagcaatatgtataagtagtggttaaaagaaacgtcttaaagcataaattactaaatgagaaaagttataaatctacactcaagaaaaaaatggaaataggcatttaagcagcagtttggaggtgaaaggtttaaccccacagagcaaacgaattcacttgggctcaggtagctacgagcagcatcaggcacctcccagtgctggaattcacctattagaaacccagaacacccctaggaacctcagggaagatgctggggaccaggtgccggtcactgtgggccactagcttctgggggtttgcctacctggcactttaaatggtcactgaaggtatccaaagccaaactccagcacagcttggctgtcctcatcataacccctgtcctcatcctctcagcagaaacccagtaggtctgatggtgtcagtgggtttttgctttctactcctttagcctccttcatcacttaataagcattttgtcaaagaaatgagtgcatgtgattccaaagtcaaatggtaagaagggcatatcattagaaaaaagccccactcctaccctcttcaactgctcctagaggcaacccctaagaaccacttcagttttctttgctttttgtattttattgtttctttctttgttgtgtggatagtctttatttatttctgtagtaccatcttccctcccaacaaacatggaagaaaaaaagaaggggctggtgggaagaaatgccctgggggacacacctctccaatctctgcagttttgaagagggagtgttgaggtggaagtcttggggatatggggaagatggccagcccctcctcttgtctcccaggtggctcttggcagccttttaaagcttaaactcatcagttattttggagacgatgcttttaaaagacttggaagtctgggatatatgcttaaatggaaacttcttgagatatctccaaagcaattttcacacctccatcttccactgtactgagttctcttggtcccactgtggctgcatgcacagcagcatgcagttcttgtacagtctctggagtctgaaggagttccattttgtcttatcaatgatctgcacagctacctctttcctagttagggtgtgtcaggccaactgcatggtgaccaagttaccctggttgatggtcgtgatgagccagtagttgccaatatgggtatcctcagcagagatgcctgagaggtcctgcagtacgttggagatagggcttggagtcaaggtgtcccgaggtaggcttaaatttgggaaaagctgattaaaagcttggtccaaatcatgtcaaaagaatataacttccaaaatccacctgatgacctaatctttataatgaaatcaaaacacaatgccagagaaaaataaaaataaacaaaaacaaatgctaacacactaaatttaaaaagaaaaatgagaaaaaattcttacaaagtctttgtatagttttggtattagggtaatgctggcctcataaaataagttagaaagtgttccctctgcttctattttctggaaaagattgtacagaattggtatcatttcttctttaaatgcttgacagaataaaccagtgagaccatctgggcctgttgctttctgttttaggttattcattattgattcaatttctttaatagtataggcctattttgatgaccaatttctccttgttgagttttggtagggtatgtctttccaggaatttcatctaagttagcaaattagcaggcttggagttgttcatatttctttatttttcttttaatgtccatgggattagtaacgatgggcctctccttcatttctgatattggtaatttgtgtcttctctctctcttttttcttggttagccttgctgggcttggttagcctagccttattaattttatagatctattttattgactctattaatttttattgatctatttaaagaaccagcttttggtttcactggtttttctctatcattttcttactttcaatttcattgatctctgctctaattttaagtatttttttttttttgcttattttggatttaatttgttcttttctagtttcctaaagtggaagcttagattattgattttagatcttaatcaatatatgcattttaatgctataaatttctctgtaaacactgcttttgtcacatcccataaattttgataaattgtattttcatttccctttagttcattttcacttagttctttaagtagtcacctctatgtcttctatttgcattatgtgtaaccttttagaaacctttgtgatgtaagatatgttatattcctatatttctctaaatcaaagttaatctcttctaagctcacaactctcccggctgatgtgaaattcatctggtctatgtttgagaatactccttcctccaggatcgtgcgcaaacctcaggatcatgttcaactttgaattggtcccttcaaagtgaacaactcagccacagtccagcatggacatcttaccccagggttttcaaggccatggttcttagtatcttcctgtccttgtctcagagctacatcattagagatctgtcactcctctagaagctctttattagtgctggttcaatactcacagaacctcccagactcatcccattcccaattctacaagcattgcccttcacctccaacacctttgagatgatgcaatataaccgtttcaaagagaggtcgaaaacaaaaatcctatgtgagagttatctttatttagagacagaaaaattgcagcttttgtcccagcaagtgaacaagagtttccgccctcttgggatggaaaagaaaatgaaaaagcaatagaagcaagaaaaaagcacacataaataccttgatcagttatcctttcatcttaatgctcctacaattattgcaaaacaatcatttatgaactcaaactggggacggtaacaaatttgttatgggctgggcacttgccatgctgtgtaaaacctgggtagattcatgtctcaagataatttttaaaaatgtaaacttcctactaaaaggacagcataaggcagtggttaagagcacagagtcaggtgggcacagtggctcatgcctgtaatcccaacagtttgggaggttgaggcaggaggattgcttgagcccaggagtgagagacctgcctggacaacatagctagactcagtctctataaaaaattaaaaattattaatagctgggcatggtggggtacacccatagtcccagctactcaggaggctgaggtgagaggatcgcttgagcccaggagtttgaggttgcagtgagctatgattgcaccatgcaatccaccctgggcgacagagcaagaccttgtctaaaaaaataggaaataaaaagagtgtagggtgtgagcttatcaaggttcacatctaaactctaccatttgctctctgcaggaccttgagcaaattaacttctttgtaactcagtctcctctttggtaagaaagagataatagtatgtgatgttccccttcctgtgtgcatgtgttctcattgttcaattcccacctatgagtgagaacatatggtgtttggttttttgtccttgcgatcgtttgctgagaatgatggtttccagcttcatccatgtccctacaaaggacatgaactcatcattttttatggctgtatattatccctaaaacttaaagtataataataaaaaaaaagaaagagataatagtagtatctgcctcattggattgttatgaataggaaatgaattgccatttaccattttagaacagtgcctggcacaaaataagtgctgtataagcggagacagacctagaagctgtctctatttaggtcatcttgaatggaaggatctctagttactcacctctgtgtgtttgctgctattttaaaagcctgtagacccttaaagttttacaacatcaaccaatattttattgattgcaaagtaatgggtggcctactaccagtggctatcagtatcagtcactggagtctggcacgtgcatgtgtatgtacacatatatgtgtatgacttgagaatagggtgtggtatgtggcttctaccagtataaagaagcatgagaagtgcctgaactcaggaagcagaggttgcagtgagctgagatcacgccactgcacttcagcctgggcaacagagtgaggctccatctgggaaagaaaaaaaaaaaagaggcagaaaagcagtgtgcaatattctgcagaatcgaggaatccatgtaaaagtaccatcctatagctattttcttgctaccccagggatcccattggtgctacacattccccagatggcaatgccaaccctgtctacttatcctgtattaccagcaaggctctgttcctcagtgaatttcctttccattcattttcaaatgacttttctgatatgagcattgttgaatatgcacaagaaagaggcagaggtatgtgtatggatagatttgcataagtataaatacagtatatgtacccatatttaaatgatataatgataatattgtgttgctattcagagtgaaagctaattaattcagctattgagatgataatgatttctttttcagttaataccagagtcaaaaaaccctgcagaatggttctacgcactgttcctttgactcatcttggaagaaagacctttattctgttaactattaagctgtctatcagtatctatgacagttttaaaggaaatcattcctgggaggggtagaagattattagtaggaaggctgactcatgtaggctcaagtggacattgaggtcatgatttggtaccaggaaagaaaaagtcctctttttgcttttagtctcttaaaatgcatgctttggtatttgcactctcaatatcaacactgatctgcagcacaaagtctttttttagactttatttggttggatttgacatttagaaaaatgttaagatctttcctactgaaatttacaccagctgaaaaattcacaagcaagtccatgactttcttaaccttgacatctctaacttttccttcagcctctgttttcatatttcatgagttaccaaaacctgatgttctctctgtttcctcctttctcttctgtcccactttagttcaggcattggtagcctctcagttgtattatggcaatagtctcctctctctagtctccaatacgcgttccacctttaccttgctccgaggagcttcccaacatacaggttaggtcatactgtcccctgtcaaagcctttaatggcttccctctttcaacatggtaaagactcaactcctttgcttggcattcaaggacacttaatcacattctgttcctgttacaactgcttacccatctcccactaattctctccatactctacccaaccgccaccaagatggagtatctaccctttcttggaattttcataacaccctgtgtttgctcatttttccgaatgtctttcctccctcatggtccatgtttctaaaaccttacttattcttcaaagcccagatcaaattctatttccttcatggacccctccctgattctggctactcttaattaatcaggttcactcccagtctatacaatgccttttcttcggggcgcttgacttctagcagttgggaaatcctcatattatacttatcttgctagaacaatttttaagtgccttctgctggaaaattgtcataagaaatatgcagctctacatgggtgcagtgtaattgctgcctctcctccttaaatgtggcacaatctttacaagcatatggtgtggacctgcttctacatttcaataatttattccttgtttagctatctcatcactcatattttatattatgctgtaaatttacttctgtttattccaactaagtatgcaactctgaagacaaggaatgtcttattcatcttggtatttcccaggtcagagaatgcagctttcagatagttggtacttaacagtaaactattttactctcttgtaacccaagggtggcaattgcaagatagtaaagagtacaggctttagtgcatgactgcctgggtttgaaccttcctagccaactactaaccatgtgatcatggccaagatacttaaactctctgtacctttttttcttcatctataatatggggacaaataatactatcttcatcataaaattgatataagaattacatcagtaaatggaggtaaagtagctcaaacaatagctactaggtgcttaataaatgttagatattattccaacagtctgttaaaataggaaggactcctctcaattttgacagagacatgaagacactagatgctacattccaaggtgagcccatctggcagaaatttcacagtggatattcaagaaccagttaaacatctcacttattttgagggaatgaagagatcaggagttggaaattatagagaggtcttataaagattttggagcatgtgactagtgtgctgtgtgaatcttacatccctactgcaaaggagaatgttggaaatgggagtgtctgtccctcgggccaccactggaacgtgtagtaactttgtgagaattggaaaatggtgtcccctcatgcccccaaaatgtatactaaagaggtcctgttgccccaagcccaatgaaagagtcttcaagacgatcacttgagtaggttgacatgtatcccctgaagctgacagacatggggactttgtgtctcactttcacccgagaagttgaaaggcaggaagccgggtggctgactgctcatggataaatgggagagatttctctgctccacagagattgttagatcagagaaagccattatggggttatcttaggtccatgtgaagagaaccacatagagtgacctcagtgtaaaaattgtggagtgaatcgccagattcctagatgttgaaggagacacataccatgggctagaatagatatgtatttgccctcatcaaaaaagttcagatgaggctgggcgtggtggctcatgcctgtaatcccagcactttgggaggctgaggcgggcagatcacttaaggtcaggagtttgagaccagcctggccaacatggtgaaaccccatctctactaaaaatacaaaaattagtcggccgcggtgggcggcgcctgtcatcctagctgctccagagggtgaggcaggagaatccattgaacctgggaggcagagactgcatgagctgagattgtgccactgcactccagcctgggcgacagaacaagactctgtctcaaaaaaacaaaaaacaaagttcagatgaaagtatcccgaagatgagaggtctctaaacaacccaacccaatggagaaagagacaactttgaaaacttgctatgcacaaaccagcttacagaaatactaggcgagtaactgccttcctgtcatttcttctcttacctctcacaatcctctcctgaattcaacactgcctccttgactctgaaagtgtcaggaactgtggttagtcagatggaggagaaagcagaaagtggggaaatggagcagcagagttgaagtcggttacctcccttcttcactctaggcatcttacctgttaacaggctgcagctgtgctataccttctcgggggagatggttgcttttagctcaaggttggcatttttattattatgccaggctggcatataaagtactgaattgaaaccttgaatgcgattttctccctgaatgcctggttaacagcaactcactttccaaaacttagctcagtgctcactccctatcctgacctcttcatcccaaactgaggaatctgtgtgtctgctctgccgcagtgcagcttttagagcccaggcaacatgtaatttcacttgtttagttgtttgtgcgtctttgtcctcagccagcctttaaactcttggagcccaggggtgaattgtttgcctttgtaccctctgcacttagtgctcactggcatagaattgtcccccaataaagatctatgaaagtaatttgtcttagaaaacaaattcacatttttcctaagagaggctataattcaaatttgtctttatttctgagagataaattaaaaacaacaggcttctcaacaacacaatgtcacataaagtatttgtcactggtgtgctcaaggatggcctgggtgctctccagcagttggtgagaaaatgtcctggcatctctcaatccaaacctgtttttttcctgagaagctgtgagaggactttttacacttttcagtgtttctcccacaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggtattcacttcaagcaattacatttcactaaaaatctcttaaggaggcagatgtcaggtaactcatcacgagagtgctacttcacatattaaagaaggaacctactaagccatctaagttcttgaaaagggtaatgaaccactgaaattgtccaaactgtcaactaaagagcattttagtcacccgaaagaaatgggttttttttgttgtttttctttgtcgcagtgaactatacatggagcccagtggcattaacataccattcaaataatgtgctttaatgagctacgaatgacatctaaaagtttcctctaaatttgattttaatatacttattatttattgcttaattagcatacaaattcactattgtggaaaaaaatgagaatgctttataaggtataactgcctctgaattgtctaaatagagttctaaaccaagtcattttattaaggatctgtcttctcttagtgcagctttgaaccaatttgtataggtttacacaggaaattaactactcccagttttaatataattttgtctttctatctgataaagagacactgtattaactgctggctttgtgaggaactgtaatcttcatcaaaaattggaatgcatgctagtatataacataattaatttttcattctgcaaattctacagaccactcagattctgagatatgtcctgtttctcctcaaaacacaaatagacaaatgtcaccaaggggatgacagcattcaggcagggaatgccaaatgaaataaaagccttcagaaggtgactccagttctattgttaccaaactgtacgggcaactgggatggacccagggaaataatgcatgcaggttgggggaaaataggtctgtgtaaataatccagctctgggtggatgaaaattttatagtagctgatcacaatctcatcttagcatacatgaaatgagaacctgcaataggggctgctgctggaatccaatcttgcaatggaaacacttactctgacactgcacagctcatatagctcatcacttaaatatgaacttgttccagctggagcgctgaggacattttgcatgaagccacatatagcagtctataatatttatgaacacaaactcatccagtaacagatgcggatatttcatggttctataaaataaattccctgtacaaagaaattcctggaactttgttttattggcattgagaaaagagtaaggacgttaaatgggatgaagggaagattgttttacattatttttaatagctctcttttttttttttttgttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatccacccgcctcggcctcccaaagtgctgggattacaggcgtgagccaccgcgcccggccttaatagctctctttaagtgtaaatcaatgaggttgattgtatgatcattcaaagacattttaaaagtcaccttgtattatttttatttttaactgtattctcaggaattggcactgttcttaaaattaacaggattttaaaaatttccctaaaggatgttaacatttgtttttctcaataagtttatatgtatttaatgtgaaattcaatatccttcttctggtacagtatgtaaacatggatgaaaataatattaatggcatgttttaaaacaccaattttcacagtcccctagagcaggaacagggagagtgtcattcaccttttcattgactgaatcccttgcatttgtacaatgctttcatatcacaagttctttatataaagctcatttaaaaatgattattgcttttattttgtgtagattattgcttttaatctacacaaaactctatgaggtagatattattcccattttacaaatgaggaaactgagactcacagaggttaaactacttgttcaaggttaagtctcaaaccttggccttccctttctaaaatgcataaaaggctagcgttagttctgtgccattgcataggggatcttctgggccaggtacatatcagtggttttatgaccacacacccaacagtactttctgtgattggtgaagtctctatgcttatttgttttaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggtaataatatgcaatggtgtctgccaagactggcaggaactgagtttctaggtacatagtgagctggccaggaggctttcaaattaaagccacaggcacagctgaatttctagtccaattgttcattaaaatggattcctaatacatgctttgatgtaaacattcaaatagtagcaatgcataaactaaaaagtgaaagttttccttctctctgactccattccagtcctactacctagtgtttgccagcagaaatgatttggtgtataaaatggattttttccaactgagtattgatgaccattttttccctctttttgagaagacagtctcaaactgggaagaacatggtctcaatagaggctgtggattaatccttataaatgagtaaaacagggtgaatacacgtatgtggatgaatagagaaaagtcctacccactggggttacaaatttctcaagaaatccattgagcaacttaggacaaaataggggaacagcatccaaggtgtttagacacacacattgtgataatgcacaggacatttgatggaattttattttgccattagctgaaaaaccagtaagctatgattgtccaaaccacacccttctcaatatttattacattattgacaaagaaaactttatccacatttagttttacaaatacgtatttttgtatttatttaagaaaaagtattttatatgaaagcattattttgccatagtgcttcatcagtaacactttggtataagaaaacaaagagttgacataattattcacactcttcaaaagatgctgtagagggagaaagagatgtttggggtctgaattgtccagattgttgactctctattttaggggttgacaaactttttttctttaaagggctttggccacatggtatctacaacagctactcaactctgccattttagtgcaaaagtagcagagacaatacataaacaaatgagtgtgactgtgttccaataaaactttataaaatccaatggatttggtccatgggccacagtttgttgatccctcctccacatgaatactctcagatgacttcaccaggtggaattcatgtagaatagtatatgaatatagtattcatagtagtcatactatatgaaaacctttcattagttataattaaagcttgaactttcagtgaccttcaatatgaatgggctcaatagtcttcatatccagactaccatttattcctaagaaatacacaagtggaatattttgttattcatattttatagataggaaaattcagtgaaatgtgatatggcctgcctgaggacccagagaaagaaattatacactctcttagaactcatagttcctgctgtatttatgcctttttttttttatgatttctgctattaggtccctccagatgaatgcacatatagaaagaaggctttatacacatcttccctaacaccttttattttcttgccagtgtaggagaaaactgaactcaccccagatcaacagactcttctacattttattatggattcatataacaaacagaggatgcctcaggaaataacaaataaaattgtatgtataatatctgaaaatatgtgggtttaaagttaatattttctggagtttttattgccttggaggtataatttatatgtgaatatgttactttgaaatgattagagctgagaattcaagttagacttttaaactctcagcaacattaaacaattcaagagtatgaagtctcccacctatcttgataatggtaattgccctccaaagatctgagaaatagtaagatgggttttcaaattttatcatctaaacctagtttttctttagtctaatggttttatattatcattttcttatctactttttaatcattggtttttttcttaaaatttagttaaaagaagaattcagtgcagaagaaaattttctcattttgacggaaatggcaaccaatcatgtacaggttcttgtagaattcacaaaaaagctaccaggtattttttaaataatcaaagttaatatttattgagagtttaaatatgtgcccacagattagattacctattttacatacggtgttttaattttcaaaacattcctgtgagatcagctctattttcactattactttgccaagtattttcacatgtacttatttcactgctattctctacaatagtcttgtgacattgagaaaggcaggtctgttctttgtaaaatgaaaatcatttaatatctgatttaaagtaactgtcgaactactatagacataagatattagaactagaaaggatatttaaaataatgtataataattctttcaaatcaatagattaaaaattgaaactttgcaaagttgtcattcacccatttattccttcaataagcaattgttgatacctactctatactaagtgcctggctattaccttcagggagagtgatcaaaggtgataataataatgataaatacacatacatacacatacacacgaagtgctgtttgaacacagaggaactggttgctaattgtgtctaggaaagatggagagacttcagggaggatcatatttgagttgagtctaaaagaaaaagaagttttccagttggcatggagaagcagcagcattccaagttgagagatctgcttgtttttttgtttttgttttgttttgtttgagacggagtctcgctctgttgcccaggctggagtgcaatggcatgatcttggctcactgcaacctctgcttcccgagttcaagcaattctcctgcctcagtctcctgagtagctgggactacaggcacacaccaccatgcccagctaatttttgtatttttagtagagatggggtttcaccatattggacaggctgaattcaaactcctgacctcaagtgagctgcccgacttggccaaagtgctgggattacaggcgcaagccaccatgtctggccgagaaatctgcttgttataaggcactgaggcatgaacaagaataggattatttgagataggagagaaaattcagtgtggttatagtatagtgtctgtggtgggctcctaggttagacaataaggtaagttggtaccagactgatgaaggcctaactaaggaatttaatctgtgtaccctggacagtaaagagatttcggtggtttttgtagcagagggaaatgaagtttttgttatacagaaatgacttaatcaggttcatgtaagatgaatttgaatggaaagggtctgggggcagggaagatcaagtagtatgctactgcacaagtccaggcaacagggcttgaaataaagcaatagcagtggggaagagaagaagaaacaaaaagaagagagattcaaaaatcgatagggcttgaggaacagttgtatgtgtaaggtgagggagagggacttacttatccacactcattctgatggtgccagtatagaaactagaatgtgggagtcttcttatatcccagcctcaaattctttttgccacattattaatgctatctaagctaatgggttttagttgtttcagtgtttattaaaatattggtgtattgaaatcccgtagtctagaagagtataataaataccttgtatagcagcataatactataatattaaattatagaagataacttctgacataggattttagttaaacatgttaatttgccttctttttgccagcattatgctattattttattaaatgtgtcacagatagacataagcctacataaaactcataaagtgtgaggagaaatttctcactatcattgaaacactaatatgctctcatttctttattaacaatgaaagaggaacttaatttactatatgctaattaaactgaaggcaagctcaataaaaaactggattatataagagtaaaaactgtggaggaaagaactggaaaaaggagatatttttggttatttatgggaagagattttttaagttcaaatggtcagttggttttgaatcaagaaataattgaagacaaataaaaaccttattcataagaaggtagcttatctgaaagcaatagcaatatcttggcatctcttaattcccagtgcctagcctcgttcctgagggagcaagtacaattagtgtgtgttcaatgagtaaagcagaaggaaaaaatttaaaatatggaaagaaataaaaggcaaaaacccttgagaaggaaaaaaattgacaataatgacagagatagcattattacaagtagtaacaatagggatataataccagtactgaagggatattttgtgaaaaactgaattgaatcattccattcagtattcattgagcacaacctgtgccaggcactgtccaaggtgctggagtccctgagggcaataagacagggcccctttcctcaaagaagctcttagattctctcggatggtggctcaatttttagcgttgctctcttctctatactccctttgctatttagttcttcccaagccatttaggccctgatggtgttatctctattcatgtgagtgtatgtgccagcatgcacatgagcttgtgttttgtttcccattcattcattcaatctgtcaattatccaacaaataattcttaggtacctattatgtgccaggaactggggatacaaaagtaaagaaaaacaaggcctctgcccccaagaaatgtacactccagtagaggtggcagacaattaacaaataagcaaataaatctataatatcatgtcgggtggtgataagttctataaactaaaataaagcaggtagagactagtagtggtggggagtgtattttagattggggaatgctggagcagaggcttgattgcaggaaggagcagggcatggggcatggggttatctgggaagaacattaatctctgaggcaaaaagaggcttgtgtgttcacagcagggccaggtggtcagtgtggctggaacacaaagagtagagggaatgaggagtagaaaatgagttcagagaagctgttgggactgtactatttaagcctggataacaactttgaattttccagggagtgttatattccatcaggttggcaattcttaccatatttttctgattttcccccaccctgtgtgtcgcagtgctgagttcagagcagatacatcaacatgactttggttggctgtttttgggaaatactacccgttctttagcttgactaaagactcatgagttagccaaatattctgggtgcatataaagttttcttctggcttgtagatgcttccaatctgcagagttgaccctgtcacatcaggtgtgactaacataatggctcaaagaaaatctacctgtgtctagtttctgagggtttcttcatctgaatcagtgtatctatgccataatatatgtatctacttggacttgacatctccctttgcccagcttgtttaataaattctgctcaatgaagataaaagcctctattttattggcgagtacaaatggactcaactagactacccaattttaaacaactacagaatcacttgatgtaaatgttttatcaatggcaatgatggtgatcatgaaatattgttactccttgataccaatttgattatcatcattacctaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtaagtgatttggctaatggtaaaagagtttgtttctaggagtaaaattggtgtgcttcatgagggtggggctcttgccaatcttatgcaatgttatatgcctgttgtgcctagcatgaagaatggctctaaaaagatatgtgttaaattgataagacttctagaggcttggttcaaatatctctgttgtaataacaaagtagcaaaactacccctttactgcactaagatgaagagccaaaggaagacttttttaaagattggaaaattcatctgattttgaacaactagcacaaaggagctaggattcttcagccaagaaaaagattatttaaaatcttctggtatgtaagactaagtatccagctattatatatctgtatcaaaataaaataagaagacattttaatagcaacatttatatgtcatttactaggtctcagacacttttctttcttttttcttcctttcttttttttttttagacacagtcttgctctttgcccaggctggagtgtagtggtgtgatctcggctcactgcagcctctgtttcccaggttccagcaattcttgtgcctcagcctcccgagtagccaggattataggcatgtactaccacacccagctaattttggtatttttagtagagacagagtttctccatgtttcccgagctggtctcaaactcttggtctcaagcgatcagcctgacttggccttccaaagtgctgagattacaggtgtgagccaccgtgcctgactaaagttaactttttttttcttttctttttttttttttgagacagaatcttgctctgttgcttaggctagagtgcagtggcatgctcttggctcaccagtttcccctgggttcaagtgatttttttgtgcttcagcttcccaagtagctgggactacaggcgcatgccatcacacccagctaatttttgtatttttagtagagacagggtttcaccatgttggccaggctggtcttggactcctggcctcgagtgatccacctacctcggcctcccaaagtgctaggattaaaggcatgagccaccacacccagccggtttcagacacttttctaaatatatgatttcatctaatcttctcaaatattctatgaataaatactattatcattcccatttttcaaatggaaaagctgagacagagaaaggttaaataactttcccaatgacagagaggaagtctgacttcagaagctttgtgtcagcccaatgcagtggctcacgcctataatcccagaactttgggaggcagaggggggtggatcacttgaaatcaggagttcaagaccagcctggccaacatagtgaaactccgtctctactaaaaatacaaaaaattagctgggcatggtagtacgtgcctgtaatcccagttactcaggaagctgaggcaggagaattgcttgaacttgggagatggaggttgcagtgagtcaagatcgtgccaccacactccagcctgggcaacagagtgagactcagtctgaaaaaaaaagaagctttgtgtcttaaccactatgctatagtacctctcaagagacgagataatagcacaagttactcagtgtttaacttattgtggaataacactgtgacagggaagctcaagagacattgagatgaattaccaggaattctgtgcaatttatcttaggagatccttaagataggatgagttcttattttcccgagagatttcatatatgggttgggagtggggaatgaatgagatgacttctcaggatgttttctttctaaagtcttatcattaacaaaagcaaatttaaagacttttaaaaccgatattttaagatagagattagagggaaagttttcaggtagttctgcatctgtgatataagtgaaataattttttaaatggaaaattatttttaaaggcagtttctccatagtcattatgtttttttcctagttaaaaacaaaaagcataattagcatcattggtagatttaaaaaccacacactttaaaaagatgcattattcttaatatattaatttactagtctaacaaatatttaagggcaaggtactatggtagcagtgaagagagaaatcaagcatgttctttcccctaagaagcttacagtctaatgggaagagattaactgtccatgattatgataaaatatggaagagaaaaacagagagatgatgactcctagttgagagagctccgaaaaagttttattggcatttgagctgggacttgaatgagatttgatttggatatccagggtgcaagagagaaggaccagcaggagcaaagagaaagaggcaagaaagctcagggaatgcacacaaagaagggtgagtagctgagctgactgaattgagggttacattaaagggaaatagaaaggaataaaagaatcagatgattgagggccttggatgctgggctaatgattttgttatttcccaagtaataggagagatggaagatttttgagcagaggagggaaaatgtcaaaattaagctttacaaattttctagcagtgttagggtaagccagaacagaagtcacctcttaggaggcaagaagtctcaaagatgtcacgcttgctgccaggagaaatggagagaagagaaaggatctgggagatatatcttcgtggcttatcaacttttgaaagacattatgttgtcaagaaatatggattttggttctggacagattgtgtgtgtgtgtgtgtgtgtgtgtgtgtccaggctaaggggaaaatgttgaatcaggtaacctccaaggcaccattcagttctacaagtcttactgcttttcctctcttaaataattcaattttcctgatgggtggtttagctagtcactaggccagctactgaagtatcctgattttaaagccataatcaataattgacagttcaacttaggaaagaattaaaggacaggctgaattttcacatgtatgggtataattgttgttttagactattgaacatacactggtggttctctctttatgcagaaaactacaatggcttcaacaggttcagcagcttagctttgtcatttatttgattctggcttccatggactgtggcggtgctccctttaagaaaatcccagttggccgggtgcggtggctcacgcctctaatcccagcactttgggaggccaaggcgggtggattacaaggtcaggagatcgagaccatcctggctaacatggtgaaaccccgtctctactaaaaatacaaacaattagtcaggcgtggtggcgggtgcctgtagtcccagctactcgggaggctgaggcaggagaatggcgtgaacccaggaggtggagcttacagtgagccgagatcacgccactgtactccagcctgggggacagagtgagactcggtctcacaaaaaaaaaaaaaaaaaaaaatccatcagtcaaatctaattcttacaaaactaataaaataaaaaggaatgatgactcatgacaaaacttattcattttactgacaggtctctactctagggaatgtgtgtttggtttattcatcaagagacagtggtgattaaggatactgactgtggaatctggattgaatatgggccccactacttattagctacatgtcccatttttttaaagctgttgaaatagacttcataaccaatttgatctctttgaaatcatgtttaactttaatatttattctgcagtcttgcctcaagtttgataataaaatcttgataagacagggttttcttctttttgagtcagtattttatcccaagcacctagcacatgcctggcttggactgggtgctccacaaaattctgtggaataacgaaaaaaatgaatgaaggtttgtccggagctataaaactggtctgtttatttacttttcagatggttgtttccctgaatatcagagttgttaatgtccaaagctaacaagtaaccaacaaaaagttggttaaacattcttctagacattgcctgtagtagttaatttggggaacagatatcttttttgcatttgagtgtaagaaaaggaaaaagacagtttggatatggaagttctgttgtgttctctctcctcctcctcctcaaagatgagtcatttaaagttgattcaggtgccagacaatgaaaaagaggggtgcaatgtctgccatatgaattgaaatgttttgatgagagggcatctgcaggagaattatctggtggttgttctatctttctttctctgtctctttttctctcctggatgctcagcttcctttaaaaaaaaatctttgcctggctccatcagatctcctgggtcctgagccaagtcagatgctgccatttccatgatgaccactgggttagtaccagattccttccccagcctggctgaggtggggaaaatcccttccactgtggttcagctaaaaggggaaaaatagtcttccaaaaaagtttacaaggctactaagaggagaattatgtttatagaaaggcatatataaggctgagcatgctgactcacacctacaatcccagcactttgggaggccaaggcaggaagattgcttgagcccaggaatttgagaccagcctgagccacagagcgagactccatctttacaaaaaagttaaaaaaattagctgggcatggtggcatgagtctgtaatctcagctagttgagaggctgaggtgggagggtctctagagcccaggaggtggaggttgcagtgagctgagattgtgccactgtactccagcctgggtgacagagtgagaccttgtctcaaaaaaaaaaaaaaaaaaaaaaaaaaaaccaaacggggggcatatatgcgtaatgtctggatctattaattacggcaccagaaagataattattcagcacctactgtgtgtcaggctgtattatcagtgtttgtgtgagctttgggtcctacaagaagcagatatcaacatgggactaaatatgtcagaagttaattgggggaaatgcctctgaagaataaagggggaggaagcaggtggagtccaggagactgtacactactatgctgatctgacacctgtgaaagtggagcaggaaggcatgattgggcatgaagagcatcagatcacagcacagtcctgagaaagtctcagctaggccattggagagggacctagtccgagctgcccactgaatggacaagcactaacacacccactatgctcattcaccagttgagacaagactggtgaaagtgtgtcctcagcactcacagggcggcagctggaggctatcagccagccagactccctactgtgggctgtctttaagggtgatctgagtgggtcatctccatggctaacattttgcttcacgaaaaatattgtttgctctttgtagcactttgaggtagatattatcaattctatgccagacctagaccctgttaatcccaataacaaaatatcagtcccaagtatctgttccctctgatattactctctaactttccagcttgccaccttccagtaccctgactctagggattctttgttccaaatcaacgtccattgccgggcgcggtggctcatgcttgtaatcccagcactttgggaggctgaggcaggtggatcacgaggtcaggagtttgagaccagcttggccaacatagtgaaaccttgtctctattaaaaatataaaaaattagcctggcgtggtggcaggcacctgtaatcctagctactcaggaggctgaggcaggagaattgcctgaacccaggaggtggaggcagcagtaagccaagatcgtgccactgcactccagcctgggtgacagagtgagactctgtctcaaaaaacaaacaaacaaacaaacaaacaaaatcaaaaatccatttgttgaccctccatccactaaccctccagccattgactctacttccttttgcctgaccacactttcctcagtacttggcttagagttcgtggttcatcaatatgatcatttccttagatcattcaccagatatcctcaactctttgtctttctttcacctaagaaaaccctctgcctgactgagtacgactcttaacctactctgtgcttgagcctgagaactgaaacagtatgactggcttacccaaagttagtgatcaaacacttcaggtggacctcagtactttccatgtatcccttttctctagccaattcactcttatacttatggaaaattgtcttgtaccttctctttcttcaaatttccaacatctcttcccactcattctcaactataactttgttgagaaaaggtgtctttcaagaacatgccataggagttggagctcaaggatatgtggtcaaaccccagcttcaaggaaatgtaatcaagcttagagaaagatgaactccccgagcttagtcaatatgtcaagacagagattgtcacaagaaacaaagctggagccaagttcctagaattagatgcacacagagctccccagggttttctgagagttgacttcatccacatgatccactatggctccctaccattttggtaacattccagcaagtggggagggcaaaggggaaaaagagtggcacaccttccctttaaaggaataatcctgaagtggtatgcacaacttcacagagttccccagagttttctgagtctgggtcagaattgaaacctgttgaggcaagtggtgtggttctagccgtgaagacacaaaagcttccaaaaccaaagtcaggcagttacaccttggggctcccatgatttctggctgccacatattgctggagcctctctgtcacaaatcagctacctccaacagaagcaattgtcttattcctttgttttatttatttatttatttatttatttattttgagacagagtctcaccctgtcgcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttattatattaagcactttataaacacttgttttttgcctgaagaatacttatgagctgagtgcggtggctcacacctgtaatcccagccctttgggaggccgaggcgggtggatcatgaggtcaggagattgagaccatcctggctaacatggtgaaaccccgtctctactaaaaatataaaaaattagccgggcatggtggcacgcacctgtagtcccagctagtcaggaggctgaggctggagaattgcttgaacccggaaggcggaggtttcagtgagccaagattgcaccactgcactccagcctgggcaacagagcaagactccatctcaattaaaaaaaaaaaaaaaagaatacctctgatgatcagttgtagggtagagatgatttgcatcccctaaaccttcagaacaggcaaggctttctgactcatgtcatctctcatcagaatatctcctcatatttctcagggtggtggctcattagcctccctcctctcacttgatgagacacttagcttcgaatcttatcattttcatttgactctgcctgtagggcaactatccggtagcaatggaagatcatttccattaggacctgtatttgtttatttgtttacttttttttaacaagcttttattgagtacttctatgggataggtacactggcggtacaaagatgaataagataaagtcataatcctcaaggacttcatcttctaggggaaatatatttgaaaagaattaatcacaatagatttcatgcataatttaagttagaggtttggctgctgtaacagagacaaaaaataaagagtgcttaaacaagatggaaatgtatttctatcttatactagtctgggcatgaggagaatgggactgatagggaatcttcatagtgtccctctgtgtcatagttctatccatacagatggatgtcatgctcatccatccacagagagttgacttcatcttcttggtccagtatggctccccaccattttggtaaaaacacattccaggccgggcacagtggctcacacctgtaatcccagcacttcgggaggccaacgtgggcagatcacgaggtcacaagattgagaccatcctggctaacacagtgaaaccccatccctactaaaaatacaaaaaattagccgggcatggtggcatgtgccggtagtcccagctactctgaaggctgaggcaggagaatccctggaacctgggaggcagaggttgtaatgagcacagatagtgccactgcactccagcctgggcaacagagtgagactccatctcaaaaacaagcaaacaaacaaaaacacattccagcaagtagggagggcaaaggggaaaaagaatggcacaccttccctgtaagtgaataatcctgaagtgttacacataacttctactggcattccattggcaagaacttaacttcttcatcacaccttgagacaagagacctgtaaagagaactactaatgcaataactgggtgagaaatgatgagggtcttgctggttagaatgcatataatcaaaaagaaaaaaatcttccatgtaatttcataagtttcagaacttgtgatacctcaagtttcagaaaagctaaagaatgaagttttccagaatatgatctgtataaataaatatgcatgtttctagtttataataagatactttctccaaatatcaaccatatattgtgacaataaaaaccatccaaactcacatgctgctgcatattttatctataatgttttcatttattaatatttatgaatttccttctcccagtgggttttcagaacattgcctcttccacacaacacataaaaacctgatctcgcaagatgacctttcagactaactttttattcttatgctaatacaatcattcttatttctattatacatttaattccagagtaacataatgctcaaagttactctgtttatgcctatgcaactctttaaagaatatgatgtgaaatctcttttcttgttcttcaaattcatactcttttgtttgctgttattaaatcccaatcacatacacaaagataactgtctctgagatgcttttaatgagaattagagtatttatgttaattgaggctttagaacgtatatctgatataatttgtgcttgagttgtttctatacaattctagtgcatcattgattttattcctaatgtaccattacttacaaactaggggtttaagttggaattgttaataaaaataggaataatcatagtatataaaatattatagactgaaataggtttgctaacactgaatgagtttatattttgttttgttttgattttttttgagacaaagtttcattcttatcgtccaggctagagtgcaatggcacgatctgggcttactgcaacctccgcctcctgggttcaggcaattctccagcctcagcctcctgagaagctggggttacaggcgacaggcaacatgtccggttaattttttgtatttttagtagagatggagtttcaccatgttggccaggctggtcttaaactcctaagctcaggtgatctttccgcctcagcctcccaaagtgctgggattacaggtgtgagccaccgcgcctggcccaagtttacattttaacattaaggaaattagcaataacctctcagagatcaaagcaacttgttctgtccatttcaaatataaataatccctgacatttatagtagttttgggcctttttccatccccacaagggacataaataaaatattcaattcagtaagaatttaccagtatgacaatatatctcatgttttgcaatgttttgttttcacatgcattatcctgttagtgctgctcccaatggccctcactaggtgagtgttatttataaaatatcctattttatagatgtagaaatgggcttagagaggcaagatgacctgctcaagttcatacagctaatcaaaagagtgcgaggaaattaaggtgggtattctaactcagagcccagcactctttctatatgtggcatctgtcactcaccaatttctaatatttgcccaactatctgctagcagggaatataaagtaaaacatggtttctgcccttcagttgagagataaagtataagcagttgttagcaatttcaaattgctttaagtcagtgatcaaatgaatagacaatgaagtcagagaaaggagataatcttgttagggtgatgaagttgtagcccttaatagtaccatactaaaatatactgtgcttatttttgttatatgatttcactgctttagccttttcagcttgcacaaaatgaaaacagttaccagaactatgttttccaaagatgcaaatctaagctgattatcagttcagatactgtctttgagaggggttagaaatgtaaagaaacaaatgatagactatttataagaagggtaaatgctttagttaaatttagaaatcttaacacctctacttttgcttttgaaagtggtcacatgctaacttttgcatgggcaaatttaggactcaaattataggaagaaaccttccttggattaagaggaaacattaaagaaatacaagtgaggttatttccattgcccctaggcagaatccattgttcctcagctgtatttcccaagctttttgtacttgctcggttttagatattatgtatttatttatgtcaagtcgccccttggtatccacagaggattggttctaagatctctcttggataccagttaatggctgctcaagtccctgatataaaatacaacctttgtatataacctatgtacatcctgttgtatactctaaatcacctccagatgacttataatacctaatacaatgtaagtggtatgtaaataattgcttcactgtattgtttagggaataatgacaagaaaaaagtctgtacacgttcattacagttgcaatacttttcccaaatatttttgatctgtggttggttgaatccatggatacagaacccacagagagttaactgtatctgcttcttccattaacctgttaattgcctgaggacttcatattcccagattcccagcactaatatagtgcctgacacatagcaggaatacaaatattggtgaattttgttgagttgaatctggaacttgacagtccaaactctggtaactcctaagccctggtgagacctaattaggccggatagtttttagccactaggactaatgggaagcatatcatgtattatatattttaaattaaatattttatacttaaagtagttcttttttgaattgctagtttgatggcagctgtttacttaggaccaagagtatggcacaaatgactccctggggaaagtttagcagttgaaatagaggacatagtccaatctcttagcaccacaagaatatgtccattgccttaatggcatcccttgtccccatcacatctcacaactatgtcaccttcatcataaagaactacgaaaacatactactgcctgatttaacatgcatttattaatctcctattatgtcttcagaaggatgctagttattagagatgcagaggtgaataagaaatatctggccagtcacagtggctcactcccataatcccaacatttaaggaggccaaggtggaaggattgcttaagaccaggagttcgagaccggcctagaatacatagcaagtccctgtctctacaaaaaataaaatgtctggatgtggtggtgcatacctgtagtcctagccactcaagagactgaggcaggagaactgcttgagcccccaggaggccaaggctgcagtgggttatgattgtgccactgcactccagcctgggtgacatagccagattctgtcataaaaaaaaaaaaatctatggagcaccctttatgggtcaggcagcatggcagccactggagataacagtaactgattcccactcttcttttttttttgagacggagtctcgctctgtcacccaggctggagtgcagtgcagcgatcttagctcgctgcaacctccgtctctcgggttcaagcaattctcctgcctcagcctcctgagtagctgggactacaggcgcgtgccaccacacctagctaatttgttgtatttttagtagagatggggtttcaccgtgttagccaggatggtcttgatctcttgaccttgtgatccgcccgccttggcctcccaaagtgctgggattacaggtgtgagtcactgcgcccggccgattcccactcttataaaatgtatatggtatttcacactccagtgagaaggagagatatgaattgtgataagttgcaatagaactgaacctagaaaaggaagtaactaattctgcttctctgtgacagggaaagctccatagaggaagcaaaatttgaacttggccttgaaccatggatggggtgccttagtctaacagggatcctgccttgtatttcaggaaaaagcatgaagacataaaaagtgtatcccacttgttaggggagctgtcagaatgctcttggccgatagctacagaaaataaactcattatggcctaaaaaagtaagaaaatgtatgagctcaaacaagaaacccagaggaagggtgacagcagaattggttaatttaggggcagaacccaccatcggaaacacagatccatctcatctttctgctttgctatccttggcgtattgaccttccccacaggctggttctcctcctggtcatctaatggccacagcagtgctaggcactatgtctgggcacaacactggtcaaaggaaaaagaaatgctgtcttcctcagtatggaaatctttcttaggaacttcccagtagactcccctttagtctcatgggcccaaatttcactgctgtccctaactacaccaacctctgatgtgggaaatgagaccaacagtggctggaccttgggctggagctgggatttgcctctaccatagtgtatggccatggggcagggagggggaagggagcctgtgcaggcaacaagctgaatcagctttaggagccttagatgaatcggtgttattagttcctagggaaactattgggctgctgagagattagtttgaaaggaaagcagaaggcagatgtggctttgtgtgccgtgtcagggatttataccttgacctctgtgctatggagtgatgtcatttctagaaaagtttcaagttacatggttttaaggaaatagtatcatttttaaccagatgctcagtccatcttgaggacgtcatcagaataagtcatatagaggtatttaagatactaggatatatgtctagtgtaatatgcatacttgtaaataacacacacacacacacacacacacacacacacacacctgcttcatttttgttcccaattacgactagaaagctaattaggaaataaaaacttttaacatttaaaacacctaaagcagtatagtgttaattctatcaaatggttattctctcaaagaatatttctgatcattgaacataatttattaatcacagacctctttttaaaaaagggaaaacaaataggaaacaggagcagaaacataacattatttttgcattttcagacttttccatggcaaagtctttggtagttaagttagaaaatagcccccccttgtgaccaaaaatcaggtaattggtcattcaagcgaaaatgaagcaaattttaagcaattctccaggaagaaggaagcaggaaaacaggaaaaggctgtccccttcaggatgatgttagtgttacatctccagtgttagaaattgctggttcacaagccctttgtttatgttggcatggttaactctgattgttgactctaattccaaaagtagatttatatttatctatcttgtaggaaaattattttttaactctcccattatttcttttttacattttctctatattcactcttggcttttacaacatgcacaagatgaaataatcattttaaaaactttaaccttattttccccaaatgttatcaattgtaattagatagctaatggaggcaacatctctggagggtgtgtggggatttagaaaggcaaatgaaataggaaatttggtaatcaaagaaatttctaaaaattttaatattttcaaatcagctgtcttgaatatccctaaatcttcatgtactatttaatttaatggcatagccataaattattattttaggtaaccacaactgaggagtgtagtctctgaatgctgaagaaagcataaagattgacatttttttgaagatgaaaaagaacagccttaccaagaaaatagagaacttagtttagctttaatacctggaaaaatactgaagcaaatcactgatcagccagtttgtatttatccccagtaatttgcagaatttgttggttttttaaaacctacatggctttgtaaagacaaaagttcacacgtttaatctaagacttaagatgaactgaaattaagatggactaatgtgttgattcagttctcctgaataatgataataatagctactattataattatctactctgacatttattgaggatttactatgaacctggaattgtgctaagcactctctatatatctcatataacactactgttatatggagtacacattatattacacgtgacaacatttcacagatgagaaaatgaagtcttaaaaaatttaagtaatgtcccaagaccaagtcgtggagtttggtttcaaactcagagctagcttatgacctcttaaccactaggtttgctggaagccaggactggtattctccaggctcacattctccaatcctctgcactttaagttgtatctagttgggtcatgggtatttagttcattctgtaacagctggataaagggcaatcttccacatgatgtaatccccaaattgctcaacaaagacattgttgttaatagagtccactggggtcaattaaaaaatcaaagtcaaaggggagcagagggtggtattttgaccagagaggaaaacggcaaggatttaatttgggaagactgttttttaaaaaatatttaaacatttattgtgctcaaaatttaaatccaaaaaaattaaataaatcgtataattctctttataggctgggtgcggtggctcatgtctgtaatcccagcactttgagaggctgaggcgggtggatcacctgaggtcgggagttcgagaccagcctgaccaacatggagaaaccccgtatctactaaaaatataaaattagctgggcatggtggtgcatgcctgtaatcccagctactcgggagactgaggcaaaagaattgcttgaacctgggaggcggagtttgcggtgagcctagaccgtgccattgctctccagcctgggcaacaagagtgaaactccgtctcaaagaaaaaaaaaacaaaaaacaaaaaacaactctcttttaaagtacaaaataattcatcaccttcctttattatttacccattatttcatctaaatgtttgtagctaagattttcttaaagcaggttacccatgattacagctgcctgagaggcctgtctcgtggcatgtatatatgtttcaccaaaggcaatttgggaatgtgtgttggatcaagattcagataatgtagacttgggttttccatttattatgccagtaaacttagtcaactcagattacccattctgagccttactttctcaagtctgaaatggggatagtaatactggcttatcagtacttcctgcacaggattgttgtacagaatcaaattcgtttatatatttgaaaaatatctacggaagggatgggtgtaattattgaaaagaagaaatcctagcatacttcgggatcttttactaccatttgcatcactgtaagatagagaaaaatgagagctgtgtccatgcatgttagaagtaatttttttcctttttgtattcattttattttaattttttttacattttattttagattcaggaggtacatgtgcaggtttgttacatggtgcgttagtctgttttgcattgctataaaggaatacctgagactgggtaatttataaaggaaagaggtttatttggttcatggttctgcaggctgtgcaagcatgacaccagcatctgctcagcttctggggaagccccagggagcttttactcatggtggaaggtgaagggggagcaggcatgtcacatggtgagacagggagaaagagagatgctaggctcttttaaacattcatatttcacagtaactaataaagtaagaactcattcattaccatggggagggcaccaagccattcatgaggggtctaccccaatgacccaaacaccttccaccaggccccatctccaacactgaggattacatttcaacatgagatttagaggcaaaaaacatccaaactatttcacatggatatattgtgtaatgatgtgatttggacttctggtgaacgcatccctcatccaaatagtgaacattgtacccaataggtaatctttcaaccctcaccttcatcccaccctcccgccttttggagttgccagtgtctattatttccatttgtatgtccatgtgtatccattgttcagtgaggacatgcggtatttgattttctgcttctgagttatttcacttatgatactcttctaacagtgagaatttaggctttctggtaagtataccttagatgataattgtactctttagcgtctggaatcaaagtttattctggtttgctcagccaaagctctttaactctggatctggtttggaagaaatggagcagtctattctcatctggaccaatcccaggaaacatcctcatctcaattaatccataagtcacatcacaggtttttgtgtttgttttgttttgtttttctgtcaccacgattctccatccaatggctcttgtggaataaagcaatgcacagaagtggcactaagaagtctgttttttttgtttttgtttttgtttttagagatagcatcttggcccgggcgtggtggctcacgcctataatcccagcactttgggaggctgaggtgggtggatcacaaggtcagggtttcgagatcagcttggccaatatagtgaaaccctgtctctactaaaaatacaaaaaaaaaaaaaaaaaatcagccaggtgtggtggcacacacctgtagtcccagctacttgggaggccaagggacggaggttgcagtgagccaagatcacgccactgcactccagcctgggcaataagagtgagattccatctcaaaaaaaaaaaaaaaaaaaaaaaaaaagagacagcatctcactttgtcacacagactggagtgcagtagcacaatcacagcttactgcagcctcaacctccaggcttaagcgatcctcccacctcagcctcctgagtagctgggaccacaggcatgtgcccactgcacccagctaacttttgtagtttttgtagagatggggttttgccatgttgcccaggctagtctcaaactcctgagctcaagcaatcttccagccttggcctccttaagtgttgggattataggcgtaagccactgcacctggttagaagtcttaaatgacaaagaggagtgagctagataaaagagaaaagggatatttcaagtagagagcacaacatgtacaaaaactgggcaatgtgaattgtttagggaactacaagtggccgaggtggctagaggaaaggcagtgtgatagagtgatagagtgcagcttagccgtagccactgtcaggactttggagcctgccagctttggtttgaaacctagttccacctctctcagccgagtgcctttgggctagttatataacctctctgtatctacctcacggggtttagaactattaaatgaattatggtatattaaatgcttaaaatattgcataatacataatgagtactcctactattactattgttattgtgaatagttagataggcaggggacaggtcctagaggctcctacgttaaaaggaagaaaattaaaactatatgcctaaagccatggggaggtttagaaggtttttgtaagaagtagagagaaagtatgtgatctgatttttagaaaggtcattccaatgagaggtgacagcgtgctggcagtcctcagagccctcgcttgctctcggcacctcctctgcctgggctcccactttggcagcacttgaggagcccttcagcccaccactgcactgtgggagcccctttcagggctggccaaggctggagcccactcccttagcttgcagggaggtgtggagggagagacgcgagcgggaaccggggctgcgtgcagcgcttgcaggccagctggaattccgggtgggcgtgggcttggcgggcccctcactcggagcagccggccagccctgctggccccgggtaataagggacttagcacccgggccagtggctgcggagggtgtactgggtcccccagcagtgccagcccaccggcgctgcgctggatttctcaccgagccttagctgccttcccgaggggcagggctcgggacctgcagcccgccatgcctgagcctcccacccactccatgggctcctgtgcggcccaagcctccccaacgagcaccaccccctgctccacggcgcccagtcccatcgaccacccaagggctgaggaatgcgagcgcagggcgcatgactggcagacagctccacctgcagccctggtgccggatccactaggtgaagccagctgggctcctgagtctggtggggacgtggagagtctttatatctagctcagggattataaacacaccaatcagcaccctgtgtctagctcaaggtttgtgagtgcaccaatcgacactgtatctagctgctctggtggggccttggagaacctttatgcctagctcagggattgtaaatacaccaatcagcaccctgtgtttagctcaaggtttgtgaatgcaccaatcgacactctgtatctagctgctctggtggggccttggagaacctgtgtgtggaaactctgtatctaactaatctgatggggacgtggagaacctttgtatctagctcagggattgtaaatgtaccaatcagcgccctgacaaaacaggccactgggctctaccaatcagcaggatgtgggtggggccagataagagaataaaagcaggctgcccgagcccgcattggcaacccactcgggtccccttccacactgtggaggctttgttctttcgctctttgcaataactcttgctactgctcactctttgggtccacgctgcttttatgagttgtaacactcactgcgaagatctgcagcttcactcctgaacccagcgagaccacgagcccaccaggaggaataaacaactccagacgtgctgccttaagagctgtaacactcaccgcaaaggtctgcagcttcactcctgagccagcgagaccatgaacccaccagaaggaagaaactccgaacacatctgaacatcagaagggacagactccagatgtgccaccttaagagctgtaacaccgcgagggtccgcggcttcattcttgaagtcagtgagaccaaggacccaccaattccggacacaccaatacgtggatagggatagatcaaagggaatcaaactaaagataggaaggccagtaaagaggcaactgcagtaatccagaggaagagagatggaagcttaaattaagtaaatgccaggtgcaataaagaggagagggagcaccaggtgagagtgaggaggagaagccacaggcctgggtgcctgaatctcagttgtcaggcctgggcagttgagtggtgtggataccactcaccgagaatgggaacgccaggaaagaagtggatttggagaaacgtgggggagcttagttctgtggtgtctttgattttggacatactgggtttgaagagaacagccaattactgatgcttagtaggtaatggcttggtgcttcaggaagagatcagaaccctttgataagaaccctggcctggctgggcgcggtggctcacgcctgtaatcccagcactttgagaggccgaggcgggcggatcacgaggtcaggagatcaagaccatcctggctaacacggtgaaacccagtctctactaaaaaataccaaaaaattagccgggcgcggtggcgggagcctgtagtcccagctactggggaagctgaggcaggagaatggcgggaacccgggaggcggagcttgctgtaagccgagatcacgccactgcactccagcctgggtgacagagcgagactccatctcaaaaaaaataaaataaataaataaataaagaaccctggcccatttagaaatgaagctgtctatacttccagactgaataacaaccactttttgttagttgtttaagatgtgatctctgccttaattatcgatagtcatattcaaaagattcactaaatcccatctggaaaatggagacgtttttgagattcttttggcaattcaagagcattatcattgattattagtagtgactgaaacaaagacactgacaaaattagacatacactcattacactcattgttttggctatattttgagaattttgtcaactgattgtcttcacaatgtccttcctttggacatataataaaaataatatagtcattatttgaatgtgtgcatatagttgcaaaattaccatgtgtttatatgtataatgtgtttctagttttacactgtttagtcactcaaaaattgtattatgattgcaactttcccccacaggtatctctgatgaatatataacacctatgtttagtttttataaaagtattggggaactgaaaatgactcaagaggagtatgctctgcttacagcaattgttatcctgtctccaggtaattccaatgttacattttaatttttatgccatttttttcagtatactagtaataacgtttattgaaaaaaatctggaaaacatagaaatataaagaaaaagtaaagtagcctataattctgctatccaaatagaaccattattaacctttcagtgcacttcttttcagtctttttaaaaaatatcacacttattcatttaataaatgtatattgaacacctactatgtactaaccatgatgctaagcaccggggatgcaacaagacacagctcccatgcagcttgcattctggtaggatgagaaagataataaatgaagaaacaatattttttcagaaggtggtaaatgctacaaaaaatataatgagaatataaagaaagagagtggcacaaaaatggtattttaatttgtggtcacaggaggctttttttaagtgggtggcattggagcagggatctaaatgaaattacatactttttaacataataaggaacttttttctgagtttatatttcttctaaaagtcatttcccaagtcattaaaaaattacattggtaaagttgtaatatgtgctacatattccattgtatgaatatacaatcatttacttaatctttaccacatgtttgtatattcaggatatttccagtttttttgatgttgaaaatgtttcttcaacagttttttttggttgttgaaatgatacctctttccatatttttttctatattttttggttactttaataatttgggtgtcgaatgatgccatgctcatgatttgtagagcataataacaatgttagccttaggccatttttatacattatcttgaggcagaagctagttgttactttgctttaccataaaaattatgacttgtgactaaaaaactattcagcagaaccttctaaagttatgtatggatatgtcctatgacccagtgatttcacttctgagaatatactcaacagaaaggatgctcacgtccaccctacaggttatctttaggggttttgattggaaggggaattgggaggcttctgggaagcattacatgtgttgtatcttgatctcgttataattacgtgtgtgtgcataaaaattcatcaggttgaacacttaattttcacattttgtgtacaacatttaacttacacttcaaaatagttaacgttgctataattatgctgaattaatgcttttccactttttaattttgtcattttattttaaacttcaaaacagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacaggattttctttgggaacaaaatttgataaatatacaaactcatttctttaaatgttgaaagacatcctattgaatctgagggggtaatttacagaaagatactgtctctcgcacttttgtcatctctggaaaagtcctggtgaatagtcattcatttgtaatagccctctgatcatttccttttctttgaagttcaaagagaatagcaaacagaaaagttaacaattttcacataaaatattccctcaagcaatcctttcccccatagttagtcttgaggcaggattcacaaattcagagtatgcagctaactgcagtgatgggaccttcgctttcctctcttaaaagtgaggaaatgattggcttcattgtatccaatcatctttctgttttgttttgcttttgaaaacattcctacagctgggagcacagctgctgtatacttcccccaaagcaggaattagttcatttccttccttcattgttacactgttgcattcttctccctattatcctttggtgaatacaataaaacaccttctataagtaatgggcgtatatctccctttctcctaaagttagccaaagtggagcatgattagcaagcagtttttttgtatcaaaatactaggacaaccctggaattctaaaaataaccagtcagtggaaaactgtgttgaggctagcatcaattggattctgatacaacaaaaatgtcttgagttcctagtaagtacaagattcatttgctaaactccatggaggatacaaaaatgattaagatccagtaacagagctgagcccaattgacacctgtaatcccagcactttgggagactgaggctggaggattgcttgaacccaggagtttgagaccagcctgggcaacataggggaaaccctgtctctacaaaaaataaaaaagaataaaatcagccaggggctgtggcttgcacctgtggtggtcccagcaacttgggaggctgaagcaagaggattgcttgagccccagagatggaggctgcattgagtcatgatcgcaccactgcactccagcctgggcaacagagcgacaccctgtcttcaaaaaaagagaaagaaaaaaacccagtaactgcctggagggagttataaaggctgcagcggaacttgctgtgggtttaccctggaacttgggaaagtttcatacaggagatggtacttctgctgggcttcaagggatagccccaaattcagtgggtccaggtaggagggaaggggttcaaggtgaaaggggtggcaggagcaacagaaggaaggtggtgagttgtacagatgttaaaagacgatacgtaatctggggagggagggaggatgcacagtctctttctaaatctcaatttcaccattgtaaaatgcagagatcagcatttattgcataaggggatttagcttattaatgaagagtaagtgggaagtagcaggcccaccagggagagggttggtgaggaaaggacattgaagaaaggagtaaatttcagtttggtgtctccagatctcatgccgtctgcgcagacagcagtgagaaatgagcctggaactggtggggcactggagacagagcaagaagcttaatcctctagatctgcatttattcaagtggttaagaccttgtaatagcaaacaataatgctcatcacatggaaaactaattgtgatactataagaaatacatattgtgtttttgttcctggtttctgacacagcttctaaaagctttgggaattcctgagtgataggggtaataggagcaactctgggtaaaaataaaatacaaattacaagtgctatgaaacagaagtatttcccttgctctgatatgcacttttatgggtcattttccacactagtagagtgagttttttttctaaaatgcaaatctggttacatgttccctgtgctacttgatttcccattgacttcagcagagacccagaactccttgggagagcagttggctattga

SEQ ID NO: 13204 - DNA, 18149 bp, Human
ataattggtgtaagattatcatatttcatactgctttttcggctgtcatattgtgtataaaataggtttctaaggtagtgatgtttttaatggtggtttagagtatagcataggttatatgactttgattttgtattttattcataaatatacagaaacactggtttggtatacaaagtgtctggtgtctggtatctggtgtctggtgtctggtatcaccttctcccccatacccttagtagcctaacttcctctatattaacactttttttcctttttatgaataaatgagcccactttcaaaacaggcacttaaactgtacatctttacagtagtgcagtttccagctctgttgcaacattgccgtaggcttaagaaagtctcttcagatagtggcaaaataactttggttgtttttgtttgtttgtttagcttttctacatagcaaaaaaaaaatctcaaaaaacacgcaattcttgtgtagttgatgagttggctgccatcttttagcatgagaactgtaaccttccttggaataagcagatttataacttcttctcctacaagtaatgaaaaatcagactgtgtccatctgaggaacactcttttatactttatgatcctgagtcttgtaggctttgtaaaaccatagtggtataaccaaaagaatgacagatatataacttttcttttgctaaaacctgagtaagaattttgaaaatgaaacaggtttcaagttaagcaaatacgtttactcagcatggtcatgtattcattataatagaaatagtttggggctggatgcagtggctcatgcctgcaatcccaacactttgggaggccgaggtgggtggattctttgatcctaggagtacgagaccaggctgggcaacatggtgaaaccccatctctacaaaaaaacaatacaaaaattagccgggtgcggtggttcacacctgtagtcccagctacttgggaggctaaatcaaaagaatcacttgagcccgggaggcagaggttgcagtgagccaagatcaggccattgtactccagcctgggcaatgggagtgaaaccctgtgtcaataataataataataaataataatagaaatagcatggctattatgttgactataaagttttctcctgtattatatatttgctgtgcattattgtgctatattgctttttaaaatgtcgtttattatattgctagttttaatctgtttttctggtaatactgctttaatatagtatacattatagtcattactatactttgtagtcattaatttgacaaaagtaaaagtcactaaaccttttcattctatacatggtcattaaaatataactttattctaaggaaaacatagtatctgttacttaaaggaacacacagacaagaaaaaataattctttaaaaaatttagcatatgcagcagggggcaccagatgaaggcaaaaatgtactcttacattttgaatcagctacagcctgtatcctcttcatatataagcagtgtggttggtagttgtttctccttagttttcctaatggttttagtttctcagctctaaaagctgtgttgaagaagagattgataactcttcctcttttattaattcaaatgaaacttcttacaaccaaccaatttagtaattacacaaatttttcttaaacatttactattttgagagtttcaaaaaggggagttagacgccacatttaataattctttggttagaacaaggtattaatattgtgtgtaatacattttctacaaaatattttttcattaaagaataaaaggaaacccctgatgatttaaaagcctaattttgttttgctttatatgtgaactgaatgaattttaaatctggaatcctgttccctattgctaataaattgttatgtagacatttgtttccaaaacggcttgtttttgatgttggtaacatcattaaaaagttttttcttttaatttcctcttccccatcatccagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatggttagtaggaggtttattattcttttttcccttaatattattactactatttttgctttctgtcctttttgcctctaagagcagtctggcaggccttctcaagtaaataccaaccctgtttctgcagcagcctcagcagcagctcagtctagacagggtttccttctttctgtttatttttcttgctatcagagccctgatgtgtacattttggaatgctggagtagctgcttcatttctattcctccatctcccctccctcattgaaggggctggtggaactagaccagatgtctaacaaaccccgattgctagagtgtctggctctgtacgtgactgaccaatcataatacggtgtgccaagttttttttatacctctgacaacagcgtacaaaacctggactgtttcttagcacaaagatttttttcttttcggcctatttaatggtgtttcctcaagctctccagaccagatgttctgtgctgtatcagaactgtaggcaatttaacagctttatagccttccccctccccaaacactcacagtttgccatatctggcagacttgcatatagtttccagctgagaagtaaatgtaacgtcctgagtatctgtcagaaaaaatactaatgaatacgatcaatcttatgagctgccccaaaattgtttcagtatgttaacaattggattacagtaaagaacaagttgttaaagtatacttatattggctggaaacattgcatcatcagaccttgatgaattttccacttgtttcaatctattttggttttcattttatcacctattgctaaaagtttcactgtgttaagtttcagacaacatgaatgttaacacaggttttaggcgaatattggcatgccagagccgttatcatgcagcaagtgctaagctcccttactcatggagtgtttcagcggttagctttgacaaaattagtttctccaaaaccagaaagacacttttgtgatagcagtttgacttgaatggttttgtttttacaatctgttttaacgaagaaatgtgaacagtgattattaggattgataaattttgtgtgcggggctattcattttaagttgaatgaggagctacccaagtacatgcagtgaattttcatgtttaatatttatcagtgatttcctaattatacaatatgtctagaacatatgatacatttaattttcagcaaggttactagttcttgctgaggaatgaatttgaaaataactcttttgcatctttagtttttgacagaggaaattactctattgtaagtaggatagaggtattcctgcattttcaagtgctatttgcaatagtgctttgagtctgcttcaagttgtgttctggttgtttattttgatctttattttgcaaagattgtgcgatatgtaacagaatgtgcctagaaccaatgccattcaagcctggcagtgacaaaattcttagtaatttatttctctttccttgtttgagatcccataaaaactgcccaaggatctctctcactaaaggcatacagactgactcctaaactgatggaagtttgtaaagaaaaggatttttcccctgaagcgtaagtgtttgggggcatctggtaaagggttgggtatttttctgttaagatttttctttgccacatctcttgaatccttggttgtggtgtggtaatgcttttgccatgtggactgtagaagttttctgcatgccgagtgctgcttgctctctccctttccatgtttaaattattctttagggaatatctcatctgttgttctcaccaagggtgaattcagttagaatgggaattaattagctactggattcaaagaaataaatgattgaataaagggaggtggaaagagtgatcagtggctgtcagattgtaagctctgtgtcagactggttgtgagctgtgtgtcttattttccgaacccttgtttaatgagggggtgggaaagatataaacattttaagaatttggtaaagaatgtggcttattggaaattttatgggtgacagttatgcagagaattaactgatggagctgttttgggatcctatttaatggcattgtaatatttactttaaataaattaaatacttagaattcttccattttctgttaattatagaaatttttagttcttattgaatcaaaattaatggttttgacttcatgtaggacggttcttctctagtttcccatttggctcctaaaaagttaaggtgcagagaattttaaaagaaaagctaactcatgaacaattcctggatgtggtggttataactaatctatgagaaactgtgttcttggcatgttctaactattgtatctggagtctccttgtgttctgctacttgttaaactctaattcaagaggctttttaaatgaacttttcaagaaatagagtatttctcatttctagctattttaaattaagttgtaggtgtaggttgtgtagcataacttactgtgacatttacattttagtatcagtgaaattttaaagatacctgataacaaagaatgagtagtttcttctgccaagaatctcattttctgggctttagctcaaattcgcatcattttcaaagttactcaaatcactcaacttatgcttgactctgtaaaactccagtttctctactttttttttttttaagagtgctaatgaaacaaagatcttggatagggcctgtaattaggtaaattttatgaagtagtcagtttagcacttacttttgaccatcagactaaagtatttttaacatgcttcacagattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcaggtaagtggccctgcctaatgaaaagcccatgttttagaactttttgcaaaagattctttcacataaactttacctgtgaaacaagaaaacagttacttaagaacgtttataggttcttaaaacatgtataacatggagtaatagtctggccctgttaggatgtcagggaaaaacgccaaactgataacatgaaacaacacattatttgaatactaattgctcatattagaagaaccctctgctgccttctttgctgtatcatttgtgctttgataaggtcagtgcccaagagggagggcttttttatatggctcagctttatttcttgtacacgatcctaagaggcttagggtattaggtctggatatttaataatgctcaggaaaagaacagaaatgcttttttcttttactggttgtacttacccttgttcagatgcagactcttgcagttgtaaaattacagttgtttgagttttcaactaaaatttgaattttctgaacctgacattggcttcacctattttagttggtgataacgatttcctccaccgtgactgccttagctatctagttgctgagataatgtttattatatttgtaaaatgcagattgaggtttccaaaaggaagtattgttccctttgttaaattaatgtttatttccccctcatctattactcttaacagaaatgtgaatagagccacatgtatagctcctcttaaatgccctttgagcgttatgttagtgattattttgtctgtggtggaaggaggctagcagcagacttgtggaatgaaattaaatggtcagagtaggtaaagaatcaatatatgcttgttggctgaaagaaacaaggtgtgttttcttaagcaaccagtttggagcagactaaattatttatcagatttctagttatcttagatagagacttgttaaaaaaaaaaaagtgtacagactttgtacttcctcgatataaggcaagtgggatgaacccagaagggccagagacatcaatgttcttctctatgctctggcacgggtaggactgtggttgaagcgccgccttccattgcgttaattgatcacaaaggccactagaaagtcttaacggggcagggagatggacgatgaatgtaaatggagtgctcagtaacacagccaggttgcaaggctaatttggcaccaaaaagcatactgtttgactgcaaacatatattcataatagtcctttaatttgtctgttttagaaggtcatatttttctttattgcttttacaaacacattgggcacacctgtatttaaagcatttagctaagaacctttttcagcatacaaggttacaatttgatgtattaagtatatagttatataatacttttaaatttactgcatgaaagcttttgcttacataattcatgtcttcaccttttcccaggctgcctttattgagcatacaaaagaaatacatccctgatggtgctttaacattaccaatgagctggtctataatgtccatttgtccaaagcagcatttataatagccaagaaaatgttctcagtttgccctagcaactgagacctagacaaatattttattatagtttttgtcttctgtatttttatgtaaacgaggaaaaagaggtcccatttctttgctttccatatgaagttatttaaagtgtaaattggtgttcctgttaggaggaaaaaaaatgaagcaactttgaagcagtgcttttttgctagtagacacttacattgaaccaaatcgaccatactattttaaaagacagaaagataagttttgtacatctcaatttttaatttctgacagtaattgtgtgatgatggctcaggccagttgccataaaagtttgtataagaaaccccatcagaaataattcttatgcaggtgcttaaacttggtctttcctttcacagcctatagacatgggcaccagtttctttgatgtgcctgataagtttgttctctgcgacgactaaaacatactgtatttgcttttgttgaaaaattcaaatttttttattttaattttattagatggaagttctagtaatagttattccataacagcctttattagtttttaaaaatgtgtatcacaggcgttcagcttttcacacatgtaaaacaattctgtttttatttcctcttttaaaaaaagtaaactaagggtgggcatcatacattaaggattataagcataaattgatactgtagccagagcagacttaacacttcatgtcctggttcacatctgtttatctgttttcagttctttatttgcttggcaataaaagaaaaggcaatgttactgaaactcctaacaataagtccctgtttcagcatcctagttaaactggtactgaaaagattcccacaaaattggtcttggtagtggtctgattttctgtcattgttaatttctgatgcccttttaaggcctgtagtacacagattgtgtgtgtgtgtgtgtgtgtgtttctgattgttttttttctgaagagcattatcataatataaaagttatgaaatgcttaaagtccacatatttgtgcttgtagcagtgttctttcacaataacttcatatacttgcagcagataatattagtactttatattaaagacttttctggtagaaacagtgggtctgttttagtagtgcctttctcattactgtaaacaacctccaagatttaaggtctaggtgtattttctctgcatatggcagtacctctcctgtgctgttattttttccctactgtcactgctttccccttaacctcccagccacagcattggtgatgatcttttctttctctgatttccttttgcaattaatgacataaatgacttaacaactaatcatgtagctaacgacatttcctatacttagtatagccctttgggcttcaggttgctcactggtaaaaatgaaaggatcagaaacctgaagctagtgcctcctgtcttcttgccttctcaggacctcattaggttgatctactccttccttcttcatagattttcagtttctttctatactagtttttttttttcaatctttataggctcatttttccaattaaaaatttatgtttaaattttcaactctttagacaatttgaaagaaaaatacagtgaacatccatccataaacctttcatttagattcaccaattgtatatcatgccacatttgcactctatctacgtacgtaaacactttttctttctgaaccatctgaaagtaaattgtagacatgacttttaacccctaaatacttctaaaatgcgtgcatctcctaaaaacaaagacatttaaacttgtttacatccccccatctcaaaagaaaaacttatgaaaagaataccttttaatctcatgcctttagtatccatctccttttgtcttctgctaaatttttctatttgtttcataatcaaacttctcgatagaattttgatgtcactgtttcctcatttcccactgatttcccagtgattgtcaacagtttgtggtgttccacccattatatgtagtaagacctccctccaaagtcacagaagactttgatgtcactatgtcactgagtattttagactcttcagcatgtaatatgttgataaggccttcttcctgagatcctttcctaggagcctgtgaaactatagctcttctgggtttcctctcattctccacagtgaaccccctcttgtgctcatctctgtccgtgttcctcagggtctgtcttctcacacatgtactcgtggggcgattttgtcttactcctgtgacttactgccttagtctaggaccttatttctcttcctcattactttcacagcttcctcacttcctgttttttgaccttttcctctttcaaaattgtaatgatcttgctaaatgcaaattagatgctcatattactcctttgcttaaaatctttagctggtttcccactgtccttaggacagattccagacttgtagtatgtttttaagtcattgcactttgaccgttgtctgcctctcttttcctcagtcttgcccaattctaatacttaagtcggagtgaatttaaatcaactatttagaaattagggtaaaacagaagcaaatacattgtatccagagaagaagaaatgttttgaagttaaaagtgatttaaaaaattacaacacaacaaaataaatatgaaagaagcacttgattcctcagcaggtgaagtcatcagaccatgttactggaccaaggttatctaggtagtgccaggctgggattaaaagataaatttactcacatacaccttagttctatgctccttccattatttgagaaagagccaaaacttcctgattttcttgaggttactgatagaatccatattttagttggatttatttttattcattctcaatattcccaacctgtttccttctcagtctttcccttctctgtaaatgtagtaaccagctgccagaagactgggagtcaccctccattcctctctgatgcctcctatcaaataaagattgcctgctctgcctccagaatctctctcatttctgctcacttttctctatgctctgccaccatcctagttcaagtcaccacaatttctctctgtaatatcacgatagattatttgctggaggtgcagtttttaatatagagaaaaaattgaccatttaaacccttttcagatgtacactttagtcatttttagtatattcacaatgttttacaaccattactagctctagaacattctcatcaccctgaacgggaacccaaacccattaagctgtcattcctattcccctaacccctggcagcctctagtcactttctatctctacagatttgcctattctggatattttataaaatggagtcctggccaggaacagtggctcatggctgtaatcccaacactttgggaagccgaggtgggaggatctcttgaggtcaggagttctggcaaaaccctgtctctattgaaaatacaaaaaatccagccaggtgtggtggcgcatgcctgtagtcccagctactcgagaggctgaggcacaagaattgcttgaacccgggaggtggaggtcgccccactgcaccagcctggatgatgagtgaaactctgtctcaaaaaaaagaaaagagtcctacaataagcagccttttgtgtctaccttctttcccttagcaaatgttttcaaggttcatccatgttgtggggtatatcagaactttattcatgtttaaggccaaataacattctactgtatggatatataatattttatttatctattcatcatttgatggaattttagattgtttttagtttttggctattaagaataatgtagctattaacatacatgtatgagtttttgtgtgagtatatatttttaattccctagggtataaacatattcatagggtatattcataagagtggaattgctgggttatatggtaatttggtttagctttttgaggaaccaccaaactgttttccacagcagctgtatcactttaccttccctcccagtgtatgagtgttttcatttttccacatcctcgccaacaccccacagtagacttttaactaacctcctggtttctcctctccagtctatttgcatagcagcagaatgatcattttaaaatttaagcaaaatgtgtcataaacatgcacaactccaggatatcattcacattgcagttgtgaggtctcattcacaacaaactacattgctggggagttgtatggtgctagtgagcttcctacatgtgcttgtctggtctgcctgacctaatccctgtgctctagccatgccaggcctcttgtgtcatcaaatctgcctaattcttgcccatctcaggcattcagtacttgtattttcttttgcctacaatatttttggcatagctgactcatctttcactttcagtctgtcatctcctcaaagagatactctgatcatgctatctaaagtaagtgtctcttcacctcccccttctctttctcctccatccctaatcagttataagatcaatgaagatatagaacatgtatgtcttattcactgttgtctccctgttttctagtactaaggctggcacataataggagtttagtaaatacctgtttgcagttaatgaatgggtactactctttagaagcttgctattttaaaaatatatatatgtatagtagctgtccaggcgttaccatggtaggagataagttgcaggcagaaatcagtgaatatggtggtcattgtgccagtcattacatcactttataaagcgatgttggtaactgagctgcaatagaaatttcgggagagaataagaaatatgaaagactgtactacagattctaggaaaggtaagaggaaaggagcctcttcatcatgttttgtagaataaatgttaccattgttcatttaaaacctagatagagaaatcatgtgccagatgtcataatctgtgtggttctttcctgtgattactgataaaaatgttatggaatgcatttgggcaggagtaagttaatgaaaagaatttgggaatactgaacttggtataaaaaatatgtattatagatgtctcactaggtatgtttaacagttcctaccctaacatacctgtgctctcacaataagaaactcagctatttcaggtatccctgagattatagttggaagttcggtatggaaagtttagtaacaagttgactcagattttttcctctgctcttgcttttatgcatatgtgtgctctcattcttttagcaaaagccagttcaagttcatatcttaaaactgtttagagcagtagcaaagctataatttaaagtaagacttgtcagtatatttactttacatttcagcaatcatttggggaagaatctacagttgctgatggacagagtggatgaaatgagccaagatatagttaaatacaacacatacatgaggaatactagtaaacaacagcagcagaaacatcaggttggtattgtggaaaaattcaacaaacagctatttctaagtttcatgtatttcaagagtcatgttcaaaatgacctaaattatctttggtaaattattgaccgttagctactctatattatatttttaaaagattattatttttatggcatgtttgtaacatattatttacaggttatacttaaaaatacctgtgttaaagagagctgttaagctcagattgtaatgccaaggttatgcaaataagagatacatttattgagaaaatcagaagcaaagagattccagaatgtcacagctcatttctttactaactataattggtttggcagtggctcattgtggcatagttagcaatcttcagttcatttaaaaaacggagcaattgtgattaagagcaagcaatgttgataggaaataatagaccaactgctgtgaagtagatagtataatacagacaaaaaccctagaattatccgaatattctcatatgcacacatctacggctgtgaccatataaccttttctttattcatgttgcctgcaggccacatggttttcacagttcctggaatattgtatttggactatactgctctaaagtgttcttagcatttgattcatagattagttgattccagaatgtttatctgtgaaagtagtatttatatatgactactctgttcattaaaatgtactttaaacagagctttgttaaatatagaattctaagcacaactgagtggtttctaagaatgttgtatttaaattttctcttaatatcagagttcattttcagtatatagtgaaatttaaagtactttgtttctaccagcttagaattgagaaaacatatgtaaatcagtattttttttttttaactaaaaagatgggagtggttacaaatgtctgataaactgagggggaaaaaagtcatctcagctggatttcattttcatgctggtttttcctgtaggtgaaggactcatccagggtatcaaattgaatatttgtttcctatgagtaccccataatgaatacaggaatctttacaaagcaagttacgttccttcactagaaagaattgttgtttcccttgattttcttaggaatccaaagactaaatttttactagcccagcttggtttctcattacctgacattttaaggttgtgtatgggatattacgtgcttcactgttgggagcagtcatagctgttagctcttattgtagttgatctataagtttatagttaaagtttatatatatccctgctttctcttcagcgaatcataggaatccagagtttgaaagtatttgaagcattatctgagctattaatattatccatctttagttatagagctaaggtacagacaattatctgttaagaatagtaacaataggccaggagtggtggctctcgcctgtaatcccagcacttggggaggccgaggcgggtggatcacgaggtcaggggtttgagaccagcctggccaacgtggtaaaatcctgtctgtactaaaaatacaaaaattagccgggtgtggtggtgggcgcctgtaaccccaactactcgggaggctgaggcaggagaattgcttgaactggggaggcggggaggcggagaggcggaggctgcagtgagccaagattgtgccactgcactccagcctgggtgacagaatgagactctgtgtcaaaaaaaagaaaagaaaagaaaaaaagccgtaacagtagtgaacatagcagtaataacatcatctgtattgttattttaggtcaataggagtaaaggtgaaagaatttccagtgtggtagttcattacttagtcattaaaattaggatgaatcatttattacctcattgtcatgaatggtaaaggaactccctttaccttactagtcatgagcttctttccctttaagccccctgttacttacataactagttttgttttctgaatcattagttatagactcttagagctagagtgacactagagttttcaacaaaggaattttcttctgctattggcgtatttagcttcttagacgcaagttaccaaatgttgccaatgataaaaactgaggttggaattcagagcagtggggttctgctggttgtgtaggggaaggacatctttttttcctcctcagatggagaaaaataaccaaaccattttccctttgaattttagtatcagcagcgtcgccagcaggagaatatgcagcgccagagccgaggagaacccccgctccctgaggaggacctgtccaaactcttcaaaccaccacagccgcctgccaggatggactcgctgctcattgcaggtattgttgcccagtgcaaaacctggctggttttgttcgtttcttaggaagcagaagacagtgagaaatttacaaacagaaaagcatgccgtaaaagctagtatgtttgaaatagttgcaggatgaatttgaatctagcacctgtaatatctgaaatctaagaacttgtaagagtttgttcttttgtccaggtcctttcagtgcttcactctgtgtttctaaacatttttgagatggcataaactttctaaaatgagtcctttttcatggaaacccagaaaaattgtttacagtcttaatgcagaagaccacttagctcaggcctcttactcttccttttccagcacagcactgtacagtgggtacttgacttgaatttaggaaattatttcccttacttggacttaaattgtggcagcacaaatgtatttccggataaactttttctggttatacttaatgtttaataccacctttaagcaggagaggtcctgtgtcctgtactaggacttgattttgaatatatgacattcatgcccttatttggctataatcttatagaaatgttaaatgccatctgattcagtcagatccttacctgtgagaagattttatcaaagtgaaaatcctactcaaaagctgattggcaatttctcaaattatattgatacatttgtaatgtgggaggaaattccaaattccttaacattttctagtgtacatacaaattaaatttggaaatgagacacaattccttcccaaaggtccaattcaaacagaattgagatccttatattttgaagaagtatgtaactgatgtaactgttgcatgggattagatcattaaagacataaaaagcaatgatggagccctttcttcaagtgaactctttactcttactctgtctggctcgtaggagaaaactccttaacgttcccaaagcacaaactgaaaacctaccgtacttgttcacatctgggtccagtgggtctggctggtttgcagctctgtgatttattgttagtatctcctttctacctgtgaaggctagtcagcgctgttttctcagttgtacagcattggtttgatctatttagtcagtccttttgactgacagctattatgtccttagggctgataagcttttgaggagtagtttttctttattctccatgtaattgagagtggacagtagcttattttcaaaagaacttgtatttcttatcccttatggaaaaataaactctggattcaaaacaataaacaggtgattctgttttatgctgatttttctgtttgactagctttctggatcattttacaatttgtggaacattatggctctatctctttctcaaatgcacaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttgattttagatgtattttctctggcttacttttgtttgcttatacttgtttatttctaaaagctaaaacaagccctgaccggaagtttcaccaggcagaaacctataggctccaccacttttgctgcctctcaggtgccacctttcaacccacttctcccaactacttatcccagctcctgaccccgaggccctggcatctactgtgaatattttttttttgaatttttatacttcgctgctcccaaatgagcaccccgagagaagtccaggcttcatgtacttgcccaggaattccttgtccccggacccggaatcacttggcctaattccggtcagtctgccttttcatttctgcaggtgatggtcaaccagtccccgtactcataggccatgggacacaagattattattatcatcattatttttaaagacagagtctcactttgttgcccaggctggagtgtagtggcacaatctcagctcgctgcaacctccaccttctgagttcaagcgattctcccacctcagcctcccaagtagctgggactacaggcgtgtgccatcacgcctggctaatttttgtatttttagtagagatggggtttcaccatgttggccaggctggtctgcatctcctgacctcaagtgattcacctgcttctgtctcccaaagtgctgggaatacaggcatgagccaccactcctggacaggccacagaaattttaaagaaaagaatcatgccaccacaagtaaacttcattttgtttatattatttaggacttcacatttgtcttccgaaaccatgaagtataattctgctaacagcaagtgttgtgaatgaggaattaggaattaggagaatggtagtacattgggaaaaacatattttagtaatttttatattttaaagataatcacagattttgctgtttgtgcatcaccaaaatcagtgagatctgccagctggtgggggtgtgcctatgagaatttttgattatgatcccctaggagggttatcaaaaaaggagatgggtgaaagatcaggagagtcgagaaattcattttttggacaacattgttttgaaggcactactggggctctgggatcaggcagccagattgaaacctggctcctccttttcctaagttatttaacctccctgtgcctcactttttgtcaaccagataagataagaaatgagagcaggtctgttacctcacaaggtggctgtgagtgttgaagacgtttgttgggggtttgggtgaagcatgcaaactctggttggtatgtggcagccactcagcctgtatttatgatgagggaggcattctaggcaccccttccaggatgttgggttgttggctgggttttactttaaaaagctcagggcctagaacattctagaatccaagtacttgctcacatatataattatttctttaggataatctttgatatagacttacgagtcaaagggtatgtaaaatgtcagcccttttacctgtattgccaaattgccttcaaaagtttctgctgttttgccctcctacccatagtgataaccttaaattggagtcaacacaaatttgagtgtgactgtgttagacagaagggatatattaacaggtaaaactggccatggcccctgcccttgtggagtatatgctctgttggttcatttcctctgcattctaattttctagacttgggatcttattgtggagttaaacaaagcacccttaaagtagcaagcgagcaaaataaaagcaaggaaaatcagttggaacataacttatgtattttttaggattaagagtaatttaactgagtcaattcaatatgtttttaaaggtgtgattcttaaattctttatgattgtttagatttctatatcttggtaacatgaatacacacttaatgaaagatttcagtaatttttgatttgggaattaatcatagtgggaaaaactgtttag

SEQ ID NO: 13205 - DNA, 23292 bp, Human; identical to SEQ ID NO: 12100
  misc_feature (1)...(23292): n = A,T,C or G

SEQ ID NO: 13206 - DNA, 9399 bp, Human
ctatctgtcctccccactccagcttctattttatgaaaataattatattttaggcacttagagcattggtttagtgaacacattatatttactttcatatttagttatgtatttttaagttattccacacaaaatgacaaatgagggcaagagaaaaaaataccatgaaatatatggggacgcaccccccaaaaacgctcagcagtcagtcagaaattcttagaaagtggaaacaactgcgaagccctaccccaacccaatcaaaacatcccacccggaaaagagcgacttgtttcttttttctattggaaatgagtggtaaactgagttcggtttggcggtgttttcttagctgactctcggctacaatcaagccattttcggacacattcccatgtaggtaccaggggtgctctggaggaagctgtcgacgcctgttcagctaatttaggttttctttgtctaattactgtggagcttagggagaaggagccggctcagggcagtaaactgacactcggtctctgtgtgtggtatccaggcagggtttgatggaaaaagcctgcttccactcaacctcaggtcactgtctggggccagccccggcccacccccctcccacatacccctcccctccccacccgccctctctgcatctacagccccaccagcacactcagccaggagcagtcccccggcactccaggggcacacagggctcctgccgccccagggggcctgcctaggctgtgcggctgtgaaggctctttgcctggtgtctccctcctgattactgcacaacctccctttctcctgcctcctgcaactccccaggctccccagcaggcacacccgtgcacctcggtcctttcagcctagacgcagcggggtgcccagctctacctcctgtttggtccgctggtctgcagcaccttctttctgggcctcccccttcagcccttgggaggccccgccagctccggcctcctgctctcctcctccctctcccagctcctatccctggtcggactacatttccctgcacgtgtaatccaataactaactgtcgggtctcattggaagtgattgctcccgagggcacatctctctcagagcctgactcttacttagggaggaattagccacaactggggagaagtgttctcggacaggagttagctgagacctggcacagttttgggtgggcaatgttaagacggaggatgtaaacctagtgacagctgcacaccccttcaggactgactataaatatagccatctcgcttatctcagggtctttctttttctttctctttctttcttttcttccttccttcctttttcttttgcacttttttcttacagaacactaactggggtgcgggggtggggggaagaagtggaagcaaatgcaaccctaagtcccatgagatccaggtttccagagtctttgaaacttggcctaggtttctcagtgtaaatccctctgctcaaagttccgaaaacgtccacgatcgccagcggcccgcaaccctgcggcggcccccagtcgccctaacaattgtcggggagcctgcaggccctgccagaaagagagaggattggcacgttacctttgggcgtctggcaccccggcgtgtggctgagggcggcaaagtctaaacgaagttgacagatggagtcagtatcggccctggggagggcggccagggaggctccgagcagccgcacccgcagcagcaccactcggcccggcgggccaggaggaggaagggggcgcggaggggcggggctgggtcctgggatgggacgcggggcttgctgcggggggcaaacagaaagaatatttcatgaagtcagaggtggtcgagttttgcgaggggtgggggtcgtccccctggcagaaccggagtgagtctgtgatccctcaattggaaagagggtgagtgagggaaaggggaggaggccgcgagaggaatgaagagcgaggagaccctggagagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctccagggctggcggccactgccactcccacaaacagggaccccgaagctaggaggtctgagggcactgggaaaagcagatgctggggaaagccggcatcttattcgtgggagcagggatcagggtcttactgtcctcccagtatccctggccagcagccgaagcttcagaattgtctggctgctgtgagcgtggtgtaaagtcccctgccttcctgggctctttggggatccctgtgcaggagactgcaggtctcccgttcagagtctcacttagcttggagagaaggcatctggcctttggggaacttggtcaggaagctgtgtctagttccttttgtccctttttttccttgcgttcattttgctgtacttctgtcccgaagtaaatgtcagaatcagatatgttctgtatgttggggtgtctgcagggagatgtttgcagctgggcaagtgttaagaggagggggtgggagggacagagctggatcccaggatctttcactaaagggacatttgccagtggagggggtcaccaaactgttggagactcctccccttccctgcctccccccccgcccaacaatggacccacattgatgatacaggtcctgggtggcaggacctgaaggaccctgctaggactcccctgagaaatgcgcctgccctgtggatgccacttgtagtgtggctggtttacattgttctggttgcagattatgaaaaattattgacttgctgaaggcggtgaaaggtgggaggggacggtagggatggaagagggaatttgaatatttgaccaggttaatgtgaagaacagagataaacccttacattaacccctcgctcggagcacctagggctgcagattaaaatcccatgggcctgccagtcaaaggcaaggccccaagctactctctcacactggcctcccacagcaatgagacagtggcttggagggtgatgcatgctttatgtgttcctgagccggtgtgcagcgggagcacccggggagaaggaaagcccagaaatgggcaaaagatgttggttccctggacggtgaaatttcccaaataggccttttaaatgtgggtctcagaggttaaccaaacaaagacagtctcggcaggaccacaccggagaggattttagcctgacttaacccactgagaacagagtcttgttcaattttatgggaatttcaacaagtaaccaatacaggcggccttcccctcttatttttgtattcccttggaccggctgtcaatcacacacacacacacacacacacacacacacacacacacacacccctcggtgcactggccccttcccttccccgcctgcctgctcctctcccagcctgccagctgccctccctgctccccttcttctcctctcccggcagatccactcaacttgaacccggactctgaggcttagcagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagggggtgaaaactgcccagcaaagcaagccggcctctgtgcccctacccagcggcctcccgcggccggccttccctgggagcctcgcagaacccccgaccgagtctgggaacgcccgggggagacaatagctcgggcctgacgcccgacagggaccctctgcccttccttcctcgctgtcttgctcccgtccctataggatacccacccggccctgttgccatctccctggagcgccagcggtggaggcttcggaggagccggccggatgcaccgggaccccgcggggcctagttgggagcgcgccgcccactgaggcctgggggcccggcgaggcgcgggggtggccaaggcagtctccccggcacacagatcagcacatgtctacgcgcacacacccagcacgaccctccctcccccagcacaccccaagggccgcgccctccgctcctgggcctggtggccatggtccatgtgcccctgccggcgcaggggctgccctggagttctccattaagccctgcgagcacttcaggaaggagctcgggcttctgtcatcccgctcagcacatcaaagcgccgacggccgccttcgtgggcaggtgtgagcgctcgccctctctcctcccgagcctgctattttgtggtccaggacttgccatcagaacttgctttaacgcgacgagggaactcacctgtgtgcagagcgccgcgcacacatcggggctcgcgggacagggcagctgcgttagcgcagcgccgggtgtgttcgggtaggtgttgcgggcaaggaagtaggcagcggcccctgagcagccgcctcgctccggcattgcggggacacggcggggctgaggccacgagagcagggcccgagcccggcgggccgtgggtacggttttcttgcactgaaaaactgaatccggcccgaagcgacgtgcactttatggtccccacaccactcggttaactaagaaaagacccgggcgaatggacctaacgcagcccggtgccgagagggcccggtccagcagcctctggggcccagtgcgcagggcactgcgggccgattgcgccccggggccaggaggcgccgagaaagcaaaagcaaaagccggcggcgggtggaggtcaagcggcccggtgcaggccggggaccggggagccgccccgggagagcagggtccaggccttctctgtccccctccagcctggggctacctcagggactcctcgcgctgccagatgcttcggaccaaagggcatttctctgcgccctgaagtcccggcttctctagaggaagtctaagacgttcgggacccacgaagatgcctgcggaggggcaggagaagaggcgtgcttttctgccccatcccttcatcttgcgattgggttgttttctatcgtcccctttggcacagggagtcctctgcgctcgctgctgtgaccggcccagttagttgggaaacaaggctcagaaagaaggccgcagtggtgtttctggggtagggtgcttggccctccctgaagccagggctcagggcagcacaggccaggagctctgccgggagagacccggaaccagagtctgggtctagttgtccggtacctgtgctcattctgagattaaagtgcacgccccagcctcagagaataaaattggaattccaggacataagaatccccctcgagggggaacttgctctgtgtttgtgcgagcatcaaaacaaaacataatgattccaaagcaattctatgacgtgcagttggtgtgtttgagctacttctaaagctgggctttctctaccagctgtctagcaatttactaaaaggcacagcagcaccttttgtactctgaggcaaaataagacaccctgccatccactggatgactttgtttctgaagaggtttttttttctttcttctttcagtgggactgccccgttaccagcatcactctactccagtgtgtgacagaaaagatttcgtcctcaacttcaatgggatttcttctttccatccctcagctagcgggtcgtattatcaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagactcaggtgggaagatgtgccatgcgtaaggcatcaacgtgtatctgtgggatcttcgttgccttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataacaaatagttgttttaggggctgattttctcttcgggcaccctgagagcaatggatgccagtttctcctccccggcaggcagctgtgcaactctacccacaccccctccagtggtgtaactgacatggtgtggggtctgtgccttgagtaacacaggccaggttctgattgtgagtcttctcaggagaaaaacagtggaagaaacgttttctgttatttctttctttacttcaccccagctttttctggcaaaacaaaaaccagaaggtgaaaggaactagaaggaaaaccaggcaagataccgaccagggtttgattttgaggaaaccaattttgtgccccttctgttttctttcctgtgcccggggagtgttctgccctttgccctctctccctcccgactggcatgggttgacagatgtggggcacagtggtaagcccccctccagggttggatgcccaaagaacagcaccctgcttcttccctttgcacgttgcaattttgttatgggtggcggtcacatgctgtcagaaatggggttcagatctgaagaatgcagggggatccctgagctgcagggggcaggctcccagcagggggtttaacttccttggggagtttaatacagaagctggactccccacacgttgctctgtggctgcggcctgtcccaccctccaattcagagcctggctggccctgctcagcatcggcacatagcaagccggttcagcccttccttcctcccggcctcctctccccactcctcccttttaaccagggatttaacaagggaacccctcagcccctttttctgttcctgctagatttcccagtcaccagtgttacaggcagagctggtgacgctcccgatggaagagcaaaatgggccaactaggcaggaggactgaccttctgtcccagcagcccttcaccatcacgagccatgttggggacaatgggtctgagagaagcagagaaattatctgctccaatcatgctgtgcattttcctctccaattcagggctggagttttgtttttgttttttgctttttctttcttgattggaaaactcacctttgtttcttatcccttaaaaggtctttctcccagtcagtcaccagactcttggtattcgtagggaactgtttcacaccccagggtttttgtattctaagtgaatttcactgcaaagagcgtctcctgagtgaaacatcttgtttccgaaagtcttaaccatctttctaatctttaggtttccttcctatatcttctaaaattaagaagtgatttaaacattttttgtctctccattatcatatttgcagttaaataaggcctttttattttcttttatagtgagctactcgggggcctgctataaattatgaagtcagtttcagagtttgctccgaccacagtgctgtgtttacattccttccgaggcagccggcatggtcgtaatttatatcctaaacacttgaacgtaacttgtttatacagagaatgacaggacctcaaagacgaaaactgcgtctgcctgcctggccgcattgggaggcccagcgcgccccctggtggcgcgaggagatccgcccaaggcgactcaatgattccttcaagctgcgcaagaacttgacaaaatgacccgttttgtggtgccttccaatagagacatttttaagtatctcactttcataagttatggtttccagttttaggaaatactttgctttcttctttcttcttcttcctttttttttttttttttgagacagggtcgtggtctgttgcccaggctggagtgcaatggcacgatctcagctcactgcagcctccaccgcctggactcaagtgatcctcccgcctcagcctcctgagtagctgggaccacaggcacgcaccaccatgcctggctaattttttaatttttgtagagacggggtcttgcctcgttgcccaggcgtgggcttttttctattttactcttttcgcctact

SEQ ID NO: 13207 - DNA, 25762 bp, Human
  misc_feature (1)...(25762): n = A,T,C or G
agtggtggcagcgtgcctctctcccttttggggagaggcagcctcgagtgcggcttggccacacccactccccgcctccctccgggcatgaatgagcgagtgatgcaatcagccggcctcttgcgaatccagaaagctctccagaagccggctaggtccccgaggctcagtttcttttatggtcgtgctccccccaaccataaggaaatgggactggcaagccaggacctgccccttgccctgtgcagcggacaaggagctgcctagacccactgacctgaccctgctgagccctgagggttggactggagagctctggactggtaacatctccatgtccctgggagccctgggaagaggtgaagaatcacctcttcagtttgggtgaggagtggaagttccggaatttcaagtattttattttaggaatagcagcgaaaacactgactttcagacatttttcaaccagactttcctggtgtgtagtagccgtctccgctctggcatccacagaattgtagcggggtggttaatttctgagagataggcaggcggcagcccgtcccgcacctcaggacgtttccggtgtcattagttaattagcatggatgtctttcctcggggtctgttgcttacattgtaagattccacaggatttgttcagctggggaaaagccactggagtcctcaaggccttggctggccagacctttctgagcgttactcccaaggggaaagagagaagaggagcccacggcctttctgatgctctcaccttcctgcagtcttagtggtgcggtgccgggagggctgtgagatctgagctgtgtgggtggcccgtgctgggcctttgcccacttctggggtgtagacgttcccactggcagatttcaagctgctgacagcgacagataacctcgtgagcagaggagtgaagggtagtgcagcaggcagtgaggggtgtcgtggagtcagtgcctcgggattaatatgattttacttcattttaagttgtgggggtggctgtttccccaccagctcacagatccctgaatagtggctcagcgtgcccacatattgcaacagaaccccccaaaacacacacacacacgcacacacacacagtggctcagcgtgcctatatattgcaacagaacccccaacacacacacacacacacacacacacacacacacacacacacacacacagaggctcagagctgggtgccttacagggcccaggaggacgtgctggtgtctggagacctgtctgagcgtgcctgaccccacatctcagcgcctcctggggcaggcgttctggccatctgtgtggggtcactcaggcttctgaagcacacggtgctattttgggtttcatcgtatgcccccaaagcagcagggcagcagggtctgctctgctcaccacaggcccctgtggcccctcccaggctgccgtccccaggtgactggccaggtagttccgggaaagcgggacaccccacttctgttggaatccacagaagatcctctttgaggaaagggccccgccctcatggagtccggcagtcgggctgtgcgtgggtctcacagtcaggtcagggtgctgagtaggtacaaaaaggtgtaatgggcgccttccaagtggcagggtcaccttgctcacctgggtctctggaggcagtgaccccacttgaagtcctgactacaggtgggactccatggcctggtgtggtggggggtgaggaaaggtcccttgcagatcttaaggggcacctgggatccagcccttagacctgaaaggactgcgaagtttatcaaaacaggtctcagaaagtcagaacgtgccctaagggctggcaggggactggagctgtttaaggagcttgtttttctggtggacctggccctggggtgggggtggggtcgtcacctcccagcctacccctgagctggcgtctgtctgcccgtggaactcaccgctgccctctgtctccacagtgctgctcacggccgtgaactgctacagcgtgaaggccgccacccgggtccaggatgcctttgccgccgccaagctcctggccctggccctgatcatcctgctgggcttcgtccagatcgggaagggtgagtacgtcccccaggccccaccggcggcccctcgaggctttgcctgtgtgtccttcacagggcatgaggtcccgtccccgggtgcctcccagtccgcagctctgcagtgctgtacaacgtggagatttccctctgggaaaatcacccagcaagtgaaatccgacccagagggggacacaggagtgctcccgtgggacagcgtggccaccactgggaggggctctggcagtttttcttgttttttacgctgcgatgtctgtgaatcttgagagcccagctgatgcgttgtaacctcacctgggggcgatgtggaacattccaggcctggcaggggctatgcctgccatgcagacctcacccgagccatctcaccctgggtctgtcagagtcccacgtgctgtcgcccctcacccacccccgacggggccatgctcctggtcatgctgtgattcattcatcattccatgggcaggtgtgggattgtctctgtgtttctgtctgctttttaaagaagatgaggtaagcatggaaaacaaaacaaacgtggtaaccccatcactcagacgtgtccactgttagcattcgggaacaggtgagagcagtctggcgcacaggttttaaggctggctggcccagactttggtcttgtgctgtgtgatcttggggaaatcactgattctgagcctttttcccagctgctttttctcttggggctggtagaaggaataaagagagtgagtgtgaaacagcccccgcccctttgcacctgtgttctctgttgacgtggactgacacagttggtattttgctgggtgtctctggaccctttaacacacactccatagatctgtgttctgtgtctgcctgcagagcctccaccctttccacactgccattccgcggtgaggtcgggctggggtttcataagcagttcccatttgtgtggtcacagaccctgggacacactgtccttggcactggatcccacccgtggttgggtacagttgaagtggggggccctgttgcttgagtccagcagggatgcctctgtctgcagttccttctgagtttgtctccatccatgttggagccagcctaggagcagagcagttaggagctggcctccttctcttctctcccagagcctcaggtagagatgatcccagtcctggagctgtggagctttcgctgagtgcaggcacccggcggatgcacgctctggtgactcgcagtcaccgatggctgcagagaggctgcctggtcccacatggctgtaggggaggcaggtaggaccccagggctgcagaggacagggcaaggaccttgctcctagaggcaggaaggtcctcacccagcaagctgtgagctgccccgcccccatgcacggccaggccaaaacatgcagacacaaggacgctgcctcctcctgtgtggggccctgcctcagggctgggaggctctcctgtgtgcaccgtgccactggtgggctgtgaactgaacagtgccccgcagcacccagcacccagcacgcagctttagctgagcctccgccttgctcctggcgccccctgctggctgtacgtggcacttcgccttaggacaaagtctggctgcagctggggaggggtctccacaccaagcaggtaacctgggcctgcagggggatgcagtgccgggctatactgacctcaccacagcgaggcgagctccaggggctggggccagactgtctttatcaaatgtatcaatctgtacaaagtctgcagcaggtgttagttacctgcctcatcgtcgaggggaagtcccacttgattcccaggtggctctggaaggttgcccaggtcaatccttcaggagctcgagcccatcccccatgcatgtgtctgaccagggattctcagagtcgcccggggtaccagagccacccaagagctggcaggacagggctggcaggaagtcccaattctgaaccttcctgggacctcaggttccggcaccttactcaaggcaagacgagctcattccatggctcccgggcactcagaagttgcccagggaggtggttgggcctgagtgacattttacgggcaggagacaaatccatcctgtgcctcccagaagtgggcacggaaggggtgctttgctcgtgaaggcctttgcttggctgcgctcatcagatagccaggaaagatttaggaggggaacgtgatttttgtaaaaacaaatttcggtagggagagcaaagagcttttgttcgacttgaatacataataggtttataattccgttagctgttgaaagcgtcctcccaccgtgctccccccagcaattcccttctgagctttgggatacagtgcagtgtctgcagaattcctgtctcctgtttggcttcaacagatttattttgttaccagatgaatgccttgcttttagaagatacattgtgttgacccctttctcccaaagcagttgtccaactttataccccccagtggacgcaaagcccttgggcagctgccccctcccctcgctggcacctggcagcagcgcccccagatacttcaaggcagagactccggcctcaattttgcaacgactggcaagtggccctttccgggtctggagaatgcagcgaaaatctggcagagcaggcctggcccacgcacctgttcctgcctgtcccgcaccctgggtgccctgctccattggggctgaaaaggctcctccttgctgcccttggcccccaggtgggccctgtgctatggaaaggcactggccctagggtcccgtaggccttggctgaccgaacctgtttcctcctcatcagggaagtttgtaatcaccccttcccagttggccatccgcagaaccatcttctgtcccgtgtgccgcatctatgccgggtcccaatgagaacatggccccgcatccagagctcatggggggacctgagagccataggcacgtgaatgggagagtcgcagtggggaataagcggggccctggtgcagaccagaaaagcccttctgaggggttgggcctttcctgagatgcgggctgggaggggcagctggctgagtgacaggggcgactctgcaggggcctgagtggtcgggagcccttgcctcctccgcgtcttgggggagtcatggctgcccctaggctggggcatggggacacgcaggcttaggtgtcacatgaggttctgcagttagtcccagccttttcgaaagggagacagtactcatgagggttcagatctgacccaccgtcccatgagtccactcgcaggctgttgcctaaggagagggtggctgggccttcgcctgcagggcggagggtgggagcgagggcacaggctctgccgtcccagcccagcagcagcagcacgtccctcctggaggacacaatggggcgctttgtgctttgcttgggctgcagccgtcagcggcagaacaaactaatctctccttgaacagttacagattggatagttgggcagatttaaaaaaaaggttgcataaaaactttcttttccttctcctcccacattgtactgttggaggtcagtattcccctggagcaaatttgccctttcactctgtccacaaaaaggaaagaaagccgcagcctgccagggcggcgtgcctcttgctgtccttcaccccaggaggggaaaatgcttcccctgggcagggctcagaccccggctgaatggctttgctgagctgctgggccctgggtcccggtggccgagacccctggatgtgacctacacctatgagtagggcacttctggacggtcccgtgtcccaggcggtaaatacgtgtgtgccactgggctgtggggcaggggcctgcatttgtgtgtcacgtgacagttttgaaatgatggttttcctttggttcttcagctagtagggccccttagactcagagaagtggggtgccctgccccaggtcccacagccgtgagcagtgggcaggtccctccccacccccactgtgaccctgggtgcagtgtgcagggtcatgcgctgctggggggaggcccacacctctgttcccaaggtgcgttcgggtggacagcactgggcccatctgctcttgggaggttcacgtggggtgtcatgtgttacgggaaaagctgacgggacagttcctgagtaacacgtccatcctgagagggtggaggtctggaggacattccttttcagactggtctctgagcttcactgagcttccttgaaggcagccccctgagcccctcccgatgtccctcctgaggagcttcctggaggaagaggtgccgcctccctcatctggccctcatctggctgggggtgtgcggccctgtcttggtctcctcttcctgtgggtgggggcgtccagcccccagacgatgtttctgacaaaggccccctcagtggtcacagcacatgcccagctgctgggctgttctggtgagaaaaacgtttcacccacaccttggctgtctgtggctctggggtgtggaggggtcgcctcgtggactgagaagcccccctgggctgtggcttagagctgttccttcttctgggcctggcttcacctgagtgtgtgcgtggacccatagctgggcttctaggcgctcccagcagagctcagcccagcctgctctccgaaccccagatcaggactgtgggcttctagggtgccctcccggagagagggcaagggcaggtgctagatgtgcagctgccttgggattctagttttgccgccccccggccagggtgtctgagcctcggtgtcttcccctgggaaatgggctgtcctcccttgcagggaggaggccaggctcaccgcgtccccggcacgggagccactgccatgcagggtccaacagccccttttcctcacctcacgccctgactgccgctttctccgggggtgacagcaagagcggagcaggcctgggtgggtgggtctcagcttcagagggtctggtgccagggccctgctacctggatgccggcgggagagtcggtgagaggccccgccaggccagggaccctgatgccctgggcggggtgctcggcctcctggctcctagacaccccctcgctgtgtttccttgtgggagagtgagctgtctggggcctcctcttgtgtggacaaggatcctgtcagatcaggccccaccctgaggaccccacttacccttaatctgtagaggccccatgtccacgtacagccacaccggggttagggcttccacgtctgagttttgggggacaggatggagcttcgggccccgctctcctggcaggaaatagggcaagccccagggcctcaaagtgaatcccagctgggtacaggctgtgttaaccaagggaggagtcggccacagctcggcctcgagctgccaaagctcactttccagagaagcttccaggctggcctgcctgtgggggactccagggcatctctctgtgaggcatctcagacagtctcagggtcatgcagggacagacaggacattgcgctcaggagctcccagattggtgccaggctcgagtgtggctccactccggacaacctgggcctggagccagggctgcggcgttggctgccccaagggtgggtacttcgcgactcagggcacctcttttgggcctcgaagacctcgcagttgataaaggatgcttgacccgccgcttgctctgggagctcagtgtgtcctgggcctgccattcttctgtgccgtcggcctcgggaggatgacaggctggggaagctggggctctgccggtgccgtgtgctgggacagaatcaaaggacgggagcggggcttgttttcccgcggccttcacctcccggtgcccttcgtcagacgcatggacagaggccagggcagccacagccctgtgctggggacagttctcagggtctttccccgcctgtggagttggaaaaagcttttacttctggtgtgaggttggcagctctaagcaaagggcccactccttcatgagtttccaagaccgacagacactgctggtggtcaaaaagtgccatctggttgccgccagaacccccaaacccaaattcctgccccatcacggttcccaggcattagatggccagagcaaaacaggcatctgaaaagcggcgccgtggcctaggatgggcgtggactccgtggggtgggcgtggactctgcctggggtgggcgtggactcttcctggagtgggcatggactctggggtgggcgtggactctgtggggtgggcatggactctgcctggagtgggcatggactctggggtgggcgtggactctgtggggtgggcgtggactctgcctggagtgggcatggactctggggtgggcgtggactctgtggggtgggcatggactctggcctgggctctggactgaacccatgtggcggtcactgcacgacctccctgagcccacagggcagctagctccagggtgctgaccacatgggactcacagccccctcttagatgaggtgccattggctgtgcactcggctggtgactgagaagtggggtgtgagctgcagctgtcctgcccctgaccatgcctgatgcactgagaagccgggaggtctcccctgggtggcacggttggcccctcatgtgtggtgacagatgcctacagactggctttagcaacagacatgcagacggtcccggtcctggcagccagaggtccagacccaaggtgccaccttccccttccagctgcccttggctccaggcatcctgggctggctctggctctgtctcccctggatctgtctctgtgtcgctgaggacacttgtcgtcggtcttagtgcctactctaatccgggatgatctcatctcaaggtccttcgctaattgcacctgcggagaccgcatttgcagctaggacacatcccgcagctccactggacgtgaattttggggacactgttcagcacactccacctagagccccaaggggccagagtggttggaaggcggaaggccccagcacagtggaaagtccgcgcttgaggagtgactctcttgtccctgaggtgtttccagggctggggcaggggcccgtcagccctgaggttccgggatgccctccatctccacattcccatgttccccacgctgggcaggctcttctctccagggacactgcgttcatggggagacatcgtcctctgagtcaggagccagaggcttggagggttggccgcatcacagaggagggggaagatcccgttcccacgtgcgtttggccactgggggcgtccctgggccccgtcagcaggatggctttagccaccggcggagtctcccctccagcctcggggtggatggttcccatggccgcatctgcctgactcagggatcaaggccacttttccctgaaatcatctccccagggcctttggagcgctcgttcccaccgcaattaccccgctctcgggggaatcctgctgacagggctgctgtgccggggtcgccgcggcgtttgcagtttgccttccccccacccggggtttggctgtgcgtttgctttacatggcagctccaccagcccctgaggaagatgcctcttagggacaaggaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggccaacatggtgaaaccccatctctactaaaaatacaaaaattagccaggcgtggtggaactctgtctcaaaaaaaaaaaaaaaaaaaaaaaaagttactcaggccttagggctgccaatatctggctcctgactgaagacctcataccatgtcaagcctcggtatattgtccttagcaaaagcagccgccctctgtgtaggatcagccgcctttctgtcatgaggctggaggtcagctatgaggattgatgtgtctggcggggaccttggactgaggcctcctgtccatcagctcaggctgagtccgggggtggtcacagtgaatggggcacgtgtttctggcctccagggctcaccttcaccccctcccaccatgagtgccagatgggggaggcaggaccttgattctcaagcagcctggcaggtctgcattcccccacttgtaggacagatgctccccccagcagaagtaagtgggcgagacacagtagggctatgcagatgtgaagggtctgcacattccagaacattccatcagagagcagatgggagagaggccagaggggctgtgccgaggtgctgtgcaaagtgccctgtcctgagctgctctgagctgcccccgctccaggcctgcagagtcaagctccgcctgctgaccacctggtgaccagaatacatcacacgcaggcagtgggccctggagctccttctcaggagatcaaggcctcagcagggcagggtggcgggcagccctcagggaacccaccagcacccccagtgtaggctgaagatcaaaggccccagcacacctggcatctgggacagacagagctggaggcagagccgcaggcatccagcacgccacggggaagcaggtgcaaaacaggaactgggtccacccatcaggaagggaccccaccgtgggctctgccgtaggaaatctggtgccacctttgaagtgcgcactttgtttggggtaattgccaaggtcttatgggaacctcccttcacgggtcccctttgaaatttgctcacctcgtcactctgcggtgttccctggaccaccaaggtggttccccttcttgggcccccatggtgacctgtggtccaaggccacatgttgggacacagcagccccagggcccgtccctgcctggccctgtgagacgggctggtgactttccagcaggaaggatactgtcacacacggttctctaatgaactaacagtccacagcctgaccaagatttccacttgtgcctccagctgtatatgcacctggcaggtaggcaggaggggacccggctcctttgttccggtggtgtctttggtcttctttccaagttctccttcctgaagcgcagtggtctgtgagactgatgtctgggcaatatattccgggctcgaacacaccaggcccatttcacagaggaggcaacagccacagaaagggccagtgctgtcccagcagccacgtgaccttccggagacaccccttcccccaaaagacatgtcctcctggggaacctgtgaatgctggtggccttatttggaaaaagggtcttcgcagatgtgactgaagttcaagttttgaaatgaggtccttctggaatagggtggagcagtcacgaagtccagtgacgcgtgtcctcagagggcaaaggagagagctctgcacacagcacggggatcgttctcggccctggcagccctgctcctgcccctgccccggctgcagctggccacacactcagcacggtccaggacaaacctatgttcttgcccaggcctgtcctgccagccctggagggagggcagtctgttccgagctcctcgcaccccaagaagcagggccctagtggctctgggccttccttgttgccgtagccaggatgcaaaccgaggtctcctggctttatactgccttgacactcatgtcgtgaggtctcagggaaccttcttgaaggcaactggggctggttgacccctccatcctgacctcctgtagacaagcgtctgaggagccctcctgggcagtggtcagaactgcctgtgccctctcaggtgggcacagggcctctggcagggccacatccccctggttgtggttggaaccctgcaccctccatgtggctcagcaggtacataccatttgtcacagtgaaaagccttcactccagcatttttgtttgctatgtattttgctccaggaacattctagaactggtagcatgacctctgttcagcgctctctaacccagcattcctttctttggccctgccaggtgatgtgtccaatctagatcccaacttctcatttgaaggcaccaaactggatgtggggaacattgtgctggcattatacagcggcctctttgcctatggaggatggtaggttctggaatgtctgggtcccttggtctggggacatacagtccctgacgtgtccaggaatcccaaatctcccagccatcaaggggcagttaaagggagtggactgaccctccctttaactgccccttggcagttaaagagtggcaggtgaccctccagagtcacccacatcccgacgaagcgtggggaggccgcccgctgcagccctactctggctctagctccacgtcgcagtcttggcgaaggtggcaggtggaggcggctgagccctgcggcccctttcctccaggtccccagcctgactcctgcgctcaagcgggcctcacagggacctgagaatcaccccagtagggcgaacaggcagggaatgtgcgggagggcctggaaagggtagcagggaccccccggaacacgcaggaggctgagctccctcccactccaggtccgctttccagcccagcgagcagaccaccggggggcaggctcaccagctgccctgggatgctctctccccggtgatttattttccctgatgaggatcatataatttgaacgctgttctctaaattttaggaattacttgaatttcgtcacagaggaaatgatcaacccctacaggtacgtgcaagaatggatggagccgtcttttttcattattttaatgtgaggcaggaagcagccacattccactcgaagcctgttggtcggctcaggccagttcacagtcgggccgtgattggggcctctggggccagcaggatgtggggcgggtggcttctggccgtgtgtccttgagcacggtttctccagagaacgggtggcaagtgagggccccactcagggcgggacggtacagaggagctgcctgggctctcggctctggtccccggctgtgcagctcgtgggcagagccttagaattcagaccaggtggcctgacttaactctcctgagcccttgaggtcaccccgaagaatccccatttctcaggtggggaagctgaggccgcggccaaggcaccagccagggctgtgcagtgtcccgctccaggcacagcctcctgccgccagcctgtgttctcttgctgcttcccaccttccccgagaagcccagcacagaggctggagctactgcttgcgaggagcccacctggctcctgggcacagggtttggccttcagcccgggctgcgttgggtgacatgtcgtccctgttctttccagaaacctgcccctggccatcatcatctccctgcccatcgtgacgctggtgtacgtgctgaccaacctggcctacttcaccaccctgtccaccgagcagatgctgtcgtccgaggccgtggccgtggtgagccgctacccgccagcttccaccaggggcctgagaggctgtggccagcccgtcccttccagaccggagtggtgccccacatctctaagcctcccctacgcagagggggccccgcgtctctaagcctcccctacccggaggggtggagtggtggtctcccctcacagcgaccgcagaggaagtgtctggggatcatcctcaagctcagctgctgggggagtcaaaggggagaagggtttaaaatctgataccaagccacacccagaaccagctataagccagaatgcctggggagtccagggcagaggtcattttaaatctgagtacagaaagattggagtctgccacagagtggggttcgttagaaggcacggctgctgctggcttggcaggcgggaggccaggcccgggcggtgtcaccgggcagctcagccaggctggcctcgcagttcccgaggcttctcccactgccctcccagggctgggggaacagggagtgggtgctctggccagcttcctactgaacaagctctgactcccagcccgctgccggcagggcaccgtgctgagcctgtggaggaccccaggggggaaggcaagatccccacctgcaggccgtagcttgctccagggagtcccagaggagggggcaaatcaggaccagcaagggctccccaacaagcaggctgggcaggggtcactggaaagccctgtcctgggaagtccccccagaggccagaatccagcctgagaggtcctctgcagagggctcttgtgagcacagagggcgagggctggcccggtgcagagggctcccagtgagcacagggagggcgagggccggcccggtggggcccagctcactggttgtgcctgcctaggacttcgggaactatcacctgggcgtcatgtcctggatcatccccgtcttcgtgggcctgtcctgcttcggctccgtcaatgggtccctgttcacatcctccaggtgagcacagcccgacccaccacaggtgagggaggcccaggcctcatggccaggttcaacatgttccatgtctgtaaaaggtttgtctctgtgatactggggatgcataattgctcaaataggccaggcatggtggctcatacctgtaatcccagcactttaggaggccgaggtgagcagatcgcttgagctcaggagttcgagaccagcctgagcaatatggcaaaaccccgtttctacaaaaatatacaaaaattagccaggcgtggtggcacgtgcccgtagtcccagctacttggggggctgaggtggaaggattgcttgagaccagaagattgagactgcagtgagccgagatggtgccactgcactccagcctgggtgacaaagtgagaccatctcaaaaaaaaaaaaaaggcagcagcaagcccaaataatacagaaataaaggaagcatgaactttggccctcgcctccccactcctgcctggaggtgacacagctgtggtgtcctagatgccctgtggccgccgcttgaccccccgggctggagtgagcagtggctcccaagttgctgtccttgccgagttggttgggggcactgagaggcccacagccagcggctggaggggcctggttcccactgtggccagagaggcccagacaagccaggcacaggccctgccactccccagcctgcgtgtcccctgtccacgtgctgagttgtggggcggtggctgactctgccactcttgtctgtccacaggctcttcttcgtggggtcccgggaaggccacctgccctccatcctctccatgatccacccacagctcctcacccccgtgccgtccctcgtgttcacggtaagcctgctgcacggccctgtgccctacatccctgggggttgtccgggggctcccagagggaggctgccacagcttgcagctctgtctggggtgtggactgggtgacagctcaaatgtggcctcctgccgagctccgctgaatgccagagagcgctggaggggctttagattttattccaaaaataatatatggtggctgccacaaacgattcagaccatcggaaatgcgggaggcagaagctgacccggggtgctgctctgccagccgcctggctcactgcacctccgtgggcgcccactctgttcgtttctcagcggggtgcatcacacacagtttccttccgcttctcctgcatctttccgtgccagcccgcgtgactgcctttgttccctctggctgtgtcacacatcactccaaaatgtagtgttctaaaaggaaaagcacttattatctcacagtttccgtaagtcaggaattcagggagctggtgcctgaagctgtgttctcatcgtagggtgtgaccagggctggagaggccactcccacagtggcttcctccagggctgtgggctgcaggccccgcccctgagcacactgggctcccccaacaggctgcttcccccaaagccagtgagatacagcagaggaagctggggtctggcagctgtgggctggcctcagaggtcctggcccttgcttactactccttccctgagttagaagccagtcaggaagggcagcaagtcctggactctttggcagctgcacggtcctcgggagcacggctgtgccgggggttacagaaactgttttcttggtgaccactgggttaggtcaggttgtggccctcgcacacagagccacagtccagcagagcccagctgtgtatgtacactgtgttcttcacctgtccttaacccaaatgtggtctccatttcctcctctcctccctccttccctcctctcctccctccttccctcctccccgcctcttccctcctcctctcctccctccttccctcctttcctccttcaagaccttgcatgttgctcagatgaggtttctcctttaaaacaaaattccctggtgctcagctgggcccagccaggctggacagtccccggtggccaccacggccgtccacagccctgctcgtgggccccagggctcagccagccgcctctctcttccagtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgagcccggggcctcccgctcacccaggcacccttcacagaggcagggtccgtgggtcctaaggaccctgagttgggagccagcatcccagctcagcctctggacctgcccctgcctgcatgcacctgggtcgactaattccggtgatgacttgaccaccagctacgagggtgccaagtgtgactgcaggagccggggttcctcaaaggacagcagatggcacagagcttgtgctccgttgggtggagggaagcagataaggacactgcagtcataggtgggcggtggtgagccccggcaggggcggggcagagccgggcctggcgcagcattcaaagggccgtcggggctgtgctggcaggaggaatgcagggaacccggcccgaggagcgcctgggcccagctggactctcctggactctccccgtccccagcggctcattcagaggggtagctgttatccgtgggctgccttctccaaaaacggggccgtccagcagaggccatgctcttgcctggggcccagcaagtcccgccgccctggccctgacacagaacaagaggccagagcccctggtggctgctagccagcagcttttgtcactcagctggcctatggctgtcacagtagcccctgcttccctgcccggaccatctctccctctgtgttcccgaagcctgggggccccgggggtgcctgtgaatgctgttgaacgggctttaggctgggcgcggtggctcacgcctgtaatcccagcactttgggaggccgaggcgggcagatcacaaagtcaggagatagagaccatcctggctaacacggtgaaaccccgtctctactaaaaatacaaaaaaattagctgggcgtggtggcgggcgcctatagttgcagctactcgggaggtggaggcaggagaatggcatgaacctgggaggccgaggtcgcgccactgtactccagcctggacgacagagtgagactccgtctcaaacaaacaaaaaaaacaggggctttaaaatacagtcagcacaagaacccagatgctgccccaagagaaggctgcagagggcagggaggagccgccctacatgggcaccagcttgtgcctgctgtgccagcctggggcagtgcctagggcacagggcagtcactgcgcacagcgggggctcagcccccatggggacctgggcatggggtaggctctacccactgttgtgagcctgggcacgggttggcgtctgttccctggggacagggcagtcatgcagcccacactgatgggctgggacctgtggtcagccctgcatctcccagggtgccctgtccaagtatggattcaggacagctgagtcaatcccccagccatgccgagccgcaggttgcggcctgcaggctccttgcagccctgcctggcttctgtgccgggtggagctcatctgctgaaggtgacagtttaggctgcagcttcagggatgggcttttgctcagcgctgtccacagcggcgtctccaagagggtggtctcctggcttattagtgggtggccactgtctcctggaagcatcaggcccctgtgcgtcctggcggctcagggtttccaggcctgtgatgtgggaatggagccgtgaccttccctgcccgtgggaggcctcgggagacgaagctgtctccttccatccctcatcataagccgcctgagcccctggcaacatgcccagcactgtatgcagagtcgagggcgggacagcccggtgtgtgaggcagatggagtgcagatcgcatcttggtgacctggaagtcagcagccgtgggtgtggagggcccaggagggctgaggaacctcggggcatgggggagggaggctggacaggagagggctcacccaggccctgtcctctgccccaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatctgtgagtatctcgctggcccacagcccgtggtaccctctgccctgggcagcgaagggagttgagaggcgtcggccgtctccacccacatggggcgaagcgtgttgggtggcaggagggttcaggtcactgcagtgtccgccagtgacacgcagcccacatggttcagggataagacacacagcgcagcaccagctaatctctcaggacgagggattccggaaaaccaggctactgctgccaagtaacaaaatcctgctggctgccaccagcggacacagcagacttacccagaaaggcagaaagaggcagaggcaggcggatcacttgaggtcaggagttcaagaccagcctggccaacatggtgaaactctgtctctactaaaaatacacagatcagctgggtgtagtggcacacacctgtaatcccagctactcaggaggctgaggcaggagaatcacttgaacccgggagacggaggttgcagtgagccgagatcgcaccattgcactccagcctgggcgacagagcgagactcttctcaaaaaaaaaaaaaaaggcagaaggagaaacccgccccccggccctgtgtgcagcggcagccccaggggtgctttgtcaccaagctcaggaccccgtcctcagcgcctgcaaatgtggccaggctcgtagaaaaaggccggggtgcttgcgggcctacatgctgatccccatgtcactgggtggcttggagaattcccgggatggcagcaacacaggcagggagaccccccacccctaccccacactctgatcaccgccagggtcatggtagaacatttgcctcaagctttgcagtgggatctgcattaactgtcattcaggacaccaagagcttaaagcaaacccccgtctctatcctgaaagcagtccccctccacagagtgatgtctctgtagacagtcccaggcgcgacaggtcttccgaggacccgttagcagattggcccctccggccctgcctgctgtgaacagtccaggcatgtgtccaggtggtggcccgggtgtggacctgcaggaaggcctgtcatccccccgttgcactttgctgagacaccagggcctggttcgtgtgccccaggggccgcactctgcctccccagggttctgaagcaggcgaggggtgggccgagtgggatgtggcacttccgcatttcagttgaagacagcgcctcgggcacccggcacccacatgcgcaagtacacaagggaaggttccttaaaatcccagcgctgggcagcggcgctgggtttggtgacagcagggctgggggagccccagctcacgcccccgtgtcccacgggtgcctacccagcccccaggctaacacagctgtcttctctcctgacagtctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaccgctgatgttctgtgttcttttcttctgcgccaggttctgtgtataggaacgttcctggccccctcttggccacctcattccttcccaccttcacacattcattcattcattcaccgacagcccacttaggccgctgggtgggggtgagccatgggcgggttgcacacatgtgagcacgcacccctcgagggtgggggtgccgagccaagatatcggatctgcctcgggagtggggggcaggcagcctgcgcagggatgttcaggtggagaccaccggggaggagggggaaggttccagtcccagggagctgcaggggtgaagttgggaggggtttgggggtcacccgctgagaggatgcggggctccagctcctgggaggtcaggaaggaagcctttctccagcctgggatcagagcaggagaggaagcggcaccgattctgtgttcccaggacactcccgagcctctcagttaagggggcgagtccggggctcagagcatgagcccctcatccacctcccagcacggggtgggaaggcaaccatagggctccgtcctggatccagtgaaggctgctcctatctgcaggactcacgcagtcccagctgaacgggaggtgggggacaggccctgagtgggccccatagtctgagtcttatcctggagccaccgagtcccgcgaggagctgggagggctccagaaatacaaagtcactggagtgagcagtcagctccacagggtattagcaaagaggcctcctggctgcaggtctcctgggactgggggttgggcggcttttccctagtaggctgggcacccccctccccgcagccctttctttagggagaccttgcccagtgatggaccagggcattctggggtgcagctgggaacctttgcagcaaccagggtcacctagagccctggctcaggatctgtgtgagccccccactctgaccacccaggcaggaagggcccacccacctcccatgggttctggaaggattcgggcgcattgtagtaatgtcttcactgctgggaagttgaggcccaggcctctcagtgctgttcaaaggcaaattaatccaatagctcaccccctcacaattgagaactggctgccctctaagggagctggaatttggaaagcaatttttggagctggggaccttggatggccctgcgggaggtgcgtacccctttgcggacttgaccgttagggtgggcttgtcgagggacaggaaggagagaactcacaggctgccccacccccgacactggccatgtgaggtcaccggtgagacaggccccaacacacctgcaccagcatctggggactccctgggggcctgctgagtgatatccgagggtggggctgggagccacaggtgagccagccctgcaggtgctgctaccagcatggtgagcagcctcagcctcggcggccctcccaggtggcatttcagtgactgccagcccgcctggcccccagcccagctggctccttcgagatgcttggtgccaacatggagctcaaagagccttgggctcctggaaacagtgaaggttaagaaacccctgacccctgtgttctgcttgtgcagagaaacctcttcccatgtgacttgagggagactcagagatgcccccaccccgggtctacctagggcaaggcccagcccaggccctgagtccccttgacctcgccgatgaccggcagggatccatcagaacaaaatgcttgctgaccaaacccagctcggctgctctccctcccctaggcccaggacctggaccccctcagcctgggccagcctgtgacttcccactccctgagaccaggctggcccggggaacccctctatctactgcccctcaggccccgcgcccaactccccacacagattctagccttgttcacacccccataaaataaaaaacccaggctgggtgcagtggctcacacctgtaatcccaacactttgggaggccaaggca

SEQ ID NO: 13208 - DNA, 97989 bp, Human
  misc_feature (1)...(97989): n = A,T,C or G
accagtgctggccaggaaatagagaaccacaaacccaggcacactgaagggtgagaggtcaattgctccaggtgtttggaaagcaatttggcagcttccaataaagtccaagacgtagctggtccaatgatgccaccgcagacatttagagaacttctgtagaggggcacagggagacagcgctagaaagctcaatgaatcactgtaactgcacaaaacaaaacaaagccgaccgccctaaatgttcctcattgacagtgggtgtatgaggaggtgactgtcctcctggctgctggtactctggggagggagctttggtgcccaaggcaagagactgaggttgaactctgggactcccaggaggggctgatttttctgagagccccgtgagccaagagtggggaccatcctgattctctcggacaggggaagatctgagcagggctcctggctgattggaggctccgaatcgcacctcttctcctgtcctaatctcaggctccaggcctggcttgcagtttctggctcaccgcgctgcggtcaccggcccacactcccaggagcgaggaccctgggcagcctccacacccccatcagcccactgcaccggtctgctgccatttcccgcacgcatttcaggagggctggggacgccggcttctgcctgaggatttatggtccaggaaatgcattttaaatggatcccaggatgctcggatccaagaatcagactctctcttgtgcgtgggaaggggggcggagggtgagagtatgtctggagagagacctagaaacgcccgaatggcggtcccactttgctccccaaaagcgcgaccgttccccgagtgggggggcgctacctgttggccagggcgcagggcgcacggaattcgggtgactttgctccaagatacacgcgtgtgtcccgactctcactcaatttataggggagagggactcgccaaatccctgttttctggggtaagcccccctccccccactcttggacccaagctgcccggaaggaagaaggaagcattgtttgtcaccggagaaaaccacctgtggtttgcaaagggcctcagtcgagtcaggggcaggcggggcagatccgagcccggcgggaggggcgaggcgcgggggcgggcaggggcgagggtaggggcgctcagctggcaggtcctgctctgcaggcctcaccgcccagctcccgggagggggccgagggcgccctgagtgctgcgcgccttcccatgacgcagttacctgtgcctttaaatcccactccccggagggggcgggggcgccccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtggggacagtgcccctgtgccagctgaagggtgttgggggctttccaggggcagagccaggcggggcccagcagagcctccgtgcgtcggacacagcaggccggagacctgcgggaagggccaggctgggcccgcggccctggggaacccagcaagggcagagggggctgggagaagggcccctccccttgttggctttgccccccaccctggaggccgcccttcgatcaggccccagcttcgcttctggtgttcctgcggcgcccgagggccttcctcagccccgaatctgcccaagccgagagaaagggagtgatggggagcgctaggggcgggggatgccaacccgaaccaaaacagccaggcagtacacttctaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgtacgtgtgctctagtcctccccgcccgctcgctgcctccgagtctcatgaagaaagctcggaacacctgctccacggccacatccaggagtggcagggggctggagagtaattattattttggcttatgcaactgaaaagcagggttcgttattacccgaagaggaggaggagtctggggcagttaattatataatgctcctgcctgtcaaagccgtgcccagccccggtctcaggcggccttttctgtgccgttgttgttttcatggagcaggttggagagcttccctgaccctggggcgctgagggccgggcgggagcagacggtgctcccttggttccaggctgtgggcctgtgtgtgtgtgtgcgcgcgcgtgcaggcacagggaggcccgggcagcagatgtgggtggctgagacaggcaggcagcctggcgcttccagctgggctgtttggagcccaggggctgctatcacccccaggctctggccaggaggctctgcagacctgtcctccagaggtgctcctggctgagcctgctccaggaggactgtgcaggccgggctcacgcagggcatggggacgagaggagccagggctttcgttgtctctgaaactcctgagaatatctgggggtgaggctgagcaccccactctgcccacgctcctcagacatctccagagtcctgaggaatcatttctttcattcaacaaatactgatggaatgtttgctatgagccaggtgtgccaggctctgggaaaaccacactgagcaaagcagacagccaggtgtcctaggctttggaaaaaccacactgagcaaagcagacacagatctttgccctcacggagcttacatttgagggagaaggagcggcgattatgttgtgactttttagggaagaaaggatctgattctgtggctggccgtgtagtttaggatctgacgggttaaggggagagatgtttttctctataggtccacttccctgggctctccactccagccagacagctccctcagcatcctgctcccctaagcccttcccctccttgtggtcctgcctgatcatgtccattctacagatgaggccagtaaggcccgggctttgtgattcaggagtcccagcctttggctgcagggatccccgatctgtctgggaccaaacccccctcgttcttgcatcacattgccggaagaagcccagattgtcaacatcctctcaaggggtatgcggttcttagctctcccataagcaaagccaggcagggatgcagatggggagcttcatggccggctctcccttttggttggcaacatggcatgacaggaaatagaattgacccttctggtcttgaggactcgggcctggacatctgggccacttttctggagggctcccagcttcctgttgggaagggggtgattatggcactgagtgtccccaggcagcccatggaaggagcctgcagggtgtggggatcgccagaatggggcagagacctccatgcctccttcccagtcaactggtgggtggtgacagccatgtcgcagtgaggaaggagttaatggccccagctccactctgacttttcctttgcacaagaagtgggggaatattgggcagccatcagcgaagctctggaacctcagcccagctctgggcgctgacttggggaaatggcgattttcatgaatgatgcaccagcggccagcgtattccacatgtagctggaattggtgtggaatttcagctggggacacctgtgccaactcctcctcctccaggtgtgtcctccccttagggtactccctgattgagctgagtagctcctaccgtctgcatggtgaggcctgggggtgtggggtacaggcacacttgcttccagtcacaaccccagcttgcatcctgggcttgaatccctgccctacatgccctgttttgtgaccctggttggattacttaacctctctgagcttgtttcttcatctttacaaaaggttgataacaatacctgtaaggtgggtgaggattaattgagaatggtgtgcgtggctatgccaggaatatagtaagcatacattattatttaccgttagttttttcattacagtttccaggcaatgcatgtcacttacaatgatcattattagaaccaacatctggacaggagactggtgatcatgtaaatgatgttaaatagcaacattagatacttactgtctgccaagcatgtggcaagtgttaaatgaattacagcccttaattcttacacctctagagggtgattttcttgttattctcattttccacactgggaagtggaggctcccagtgggtgtgggttgggaggaaccagcaggcgtcacactcaggacagccatcccagagcctgggcctttgctaggtacgtcgctctctaaatgcccctgtgcaaaaacacctcctgttctttcctctcgtttatatctctcgttctcttgtgcgtacagtggcccagaattgcaggtgaatgcccatgcacagacgggcaaacccatacactgcccaggacccctggccccctgaggcccaccatgcatgccggtgctgcaccgcacaggtatagatctttccttcgggtgctgtgtacacagaacccctcgaatcgaaagttaccccctccaataagccctcctacaccctgaaagatatgagtcatctcacgcccaagcctctccccctcatactcaggtcccgttcaccggcccagattcctcaacccacacaaatcacacacacccacagtcggaattcagatccccccaggcgcctgcgcacacacacgcgcacaaaacacctgccacccggagacattttccaccccgtcccccagaacgcagccactgcgcccttgcggccttgcttgctctccactggccaaggactctgaatctccaccaggcctgtaaacggggagctcagatgacagaggcagtggtgtgcttcgtttccattttaaacacacgtttatgctgttagtgcccttttagggagaaaaatccctcatctcaacaaaataaactaccatggggcgtatgctttgtgcttggctatgactatgactatgcaacaagtaatttctttttcaaatgagtgcccaggttagaaggaatcaggttcattggtgcggagattatgccaacagaaactcatttcagaaacaagaagcaagccctgagcagttggagacgaaagcgttttctccgagattctctttccgctacttcggggggcgggtggtgaaaggctccgtaaggtgaaaagagaaaggaagaagcaaacagctatttttttgttgccagttatagctgagaaacaaatgtggctgaagggcacccctacccacgttggccgtgaggccgtttgatgggctttgtgtgaggaatcctgagatgagctggccggggagtgaggaccggcacccgcctacagcagcgatctggagtagtgagtgagcagccccagctgacacagagaaggagagagagaactctgaccccttctcttctgaggacacccagccggagagagcaagaaggggtggagtgtgggggtgggggcaggagcctctgctgttcctttccaagactttttcttcctgttttccccaagcctccacaactctaaatatgatgagctctcaactgtgagctaataatgttgaatgtaacgccctttgtgtccttagatgacaaaaagacttgtgagtactagcggagagggtgatgttggtgtgaattttccacattggtccgtgtctccgtggactggccgcttcccccgctggtagcttcctggctgtgagaggccatgcggtggatggagccaccgctgcactggggtcctggctcgaacttgagtaaggtgctgtcttccaagtctggagaggagaggagaagagaagagaggcagtcccttcagcaccttggagagcgctcccggctgcctgcctgggttgggtggacggctggactcactttcgctctaggcatcctcttcaagccaaaccatctctccttgccagtgaccgcctggtcccggaccctccagcacactcaaccaccagaagtgtgcctatgcctgtgccagatgtgggggccacgcctgcgatcccaacactttgggaggccgagatgggaggttcacttgagcccaggagtttgagaccagcctgggcaacattgtgagacccccgtctctacaaaaaatacaaaaattagccaggtgtggtgctgcacgcctgtggtcccaccactcaggaggctgaggtgagaggatcgcttgagccccggaggtcaaggctgcagtgagccaagatggtgccactgcactccagcctgctgacagagccagaccccatctcaaaagaaaaagaagaagtgtgcctggtcctactcagtcggtgcatggattccatgctccaggaagggctgccacttggcatgcctgcctatgttttcacccctaccctgtcagtccttcctgaagaagtgagtgtcttctgaggtaacatcctctgctggtcaactgggagagcagctcccagcttgtggaggtgggtttgggggtgagactttatttttttgtttttatttatttatttatctgttttgagatggagtctcaccctgtagcccaaggtggagtgcagtggagtgatcttggctcattgcaacctctgcctcctgggctcaagtcattctcatgcctcagcctcccgagtagctgggattacaggcatacaccaccacacctggctaatgttttgggttttagtagagacagtgttttgccatgttggccaggctggtcttgaactgaactcaggcgatctgcgtgcctcggcctcccaaagtgttgggattacaggtgtgagccactgtgcccggcctagggtgagactttagtaagatgtatagaagttgctctgaagtctaaggtgtattcctgccataggatatgtgtgttcacttctcttggagcataacaggggtcataggtgcacagccgaaggcaggcagaggaatgatttgtctgtaccagtcagtgaaactgtttcaccaccattctctttacatctgcctcaatgggtgagtcctctagaccaatggtccccaacctttttggcaccagggacctgtttcatggaagacaatttttctaccgcccagggttgagggatggttttgggatgattcaggcgcattctatttattgtgtgctttatttctattattattacattgtaatatatagtgaagtaataatacaactcaccatcatgtagaatcagtgggagccctgagtttgttttcctacaactagatggtctcatctgggggtgatgggagatagtgacagatcatcggacattagattatcataaggagtgtgcaaactaggtccctggcatgagcagtttccagtaggctctgcattcctatgagaatctaatgctgctgctgatctcacaggaggcagagctcaggcagtaatgcaagcgttggagagcggctgtaaatacagacgaagcttcacttgcttgcttactcactcgccactcacctcctgctgtgtggctgggttcctaacaggcaacgaaccagtaccagccacatttcacgggctcaacagccacatgggactagtcgccaccatattggacaatgtaaatccagaacattccatcagtgcagaaagctttattgggcaggcagcactggtctggagtgtaagttccatatgggaagcggtttgtgtccatgctggtcactgccatgtgcccagtgactaaaatggtgctggcacgtggtggtcaataaatatttgtggaatgaatgacctgtgcaagtaaatgcggtagtatttggtaattttgtttaccgtcattatttcgtatgcctgtttcattgcaagaccttagaattggacgtagttaaaggaaagtttttccgtgagaccctcatgtccacaggtcagtctccctttacaattagcattaaaacatgcctgttctaattccttgatcagttttgttttgtggttggctttgtcattgctccttaagagactgccagtgtttcatatgagaaagatgatggtgttgaatgcagtgaataatggagcgataccagcagtcatgactgggaggcatttttggaccacgatttaatgagtagcattcattgcaaagtgcaaagaaaggcccatggaaagatgagtaccctccagtctgcttaattcctcactatctttttactgctcccttttccttggcttgattcgttcagtcattggagaagcatttgccaagttcagaccgtgttcaaggcacaaagacagaaaagctcaggtccaacctcagtgaatcagccttaagtatttgctgagcattgagtatgtacgcagtacagagtttgtggtaacgtggaagattggaaaaaaagaaacaaacacataaaaatgaaaatgcaagaaataggatgtcctatgttctaccaggaagaataaggagtctgaacagggatgcaaaaccgagatatatggaataattcagggtttctcatgccacagtgggggtcctgaatgggagcaccacagggcagggacctgaggaggggcagggcaggtgtgtgtgtccctgaaggagcggcagaggcttctgggggtaggcagtgcctgagttgagtctggaagggcagtagggtgagagttgttatcccaagcctgaggctgcagatttgttcgaggccatgtctccctcagcctcagcttccccatctctatgatttagtcatgacatttttttccttctcaacatgtgccatctccctcctacctatgaatgtcacgggtattgttctggacccagggaaggctcgctggtgcaaatgctttccaaaaacaccgagagtcgctctctctgctgctggtggagtctgagttgggcaggacatgggcccgcctctgtctgctgctctatgccagtgcttcccaagcctgagtgttacaagaaccacctggaaggtgtgtcaagacacagatttccagccccacccctgagtctctgggcctgggatgccacccaagaatttatatttcttacaaatttcaggcgatgctgaggctgctgatctggggacctcacattaagaaccacagtcctgggcttgtgcctcctaagcctggctacacattcgagtcactaagaatgtccctgggagacggttagaaatgcagcgtgtcaggcctgcctgacctccagggtcaggatgtgtgtttggagatgctcaggtggctgcagtgcaggagatcctgctttggtgcactcactttaaccctagctgtgcatgagcttcatctaggttgctttagaaaatgcagatgcccgggccccacccacaggtgctgattgaggtcctctgggtacagcctgggcattgggattctttttattttaatttttttcagacgggggctggctccgtctgtcgtcctggagtgcaatagtgtgtgatcgtggctcactgcaacctctgcctcctggcctcaagccatcttcccacctcagcctcctgagtagctgggactgcaggcatgcacccccatgcccagctaagttttgttatttgttgtagagatggggttttgtcgtgtttcccagactggtctcaaactcctgagctcaagcgatccgcccaccttggcctcctgaagtgcttttacaggtgtgagcaactttttttacaggattacaggtgtgagcaactgcacctggcctgggattattttttaaacattccaggtgattctaacgttcagcgcaggttgaggaccactcatctggagcgtctgtagctggacatcacttgggagctttgatgactgacccatgccggggtccatccaagaccactgacactggaaactttaaggcgggggtctcagcctgagtatctggtcacagcaagcagggcctagagttgcagctgtagataagagtttttcacactctgggtcaagtggttcatgaaattaatatagtacattaaaatagactagaggccgggcgtggtggctcatgcctgtaatcccagcactttgggaggccgaggcgggcggaggccgaggaggtcaggagattgagaccatcctggctaacacagtgaaaccccgtctctactaaaaatacaaaaaaaatattagccgggcttggtggcgggcgggcacctgtagtcccagctactctggaggctgaggcaggagaatggcatgaacctgggaggcggagcttgcagtgagccaagatagcgccactgcagtccggcctgggtgaaagagtgagactccgtctcaaaaaaaataaagtaaaataaagtagactagaaattttccaagcacaatacctacgtttctttctttctcttttttttttnnnnnnnnnnnnnnnnnnnnnnnnnnnnnnnnnnnnnnnnnnnnnnnnnnnnnnnnnnnnnnnnnnnnnnnnnnnnnnnnctgtcgcctaggctggagtgcagtggcgcgatctcggctcactgcaagctccgcctgccggattcacgccattctcctgcctcagcctcccgagtagctgggactacaggtacccaccaccacgtccggctaattttttgtattttgtttagtagagacggggtttcaccgtgttagccaggatggtctcgatctcctgacctcgtgaaccgcccgcctcggcctcccaaagtgctggaattacaggtagcgtgaactcagctcactgcagcctctgcttcccgagttcaagccattctcctgcctctgcctcccgagtagctgggattacaggtgcccacgaccatgcctggctaatttttgtatttttggtagagacggggtttcaccatgttggccagactggtcttgaactcttgacctcaagtgatccgcccacctcagcctctcaaagtgctgggattacaggtgtgagccacctagcccagcctattgtgttgtttttgaatatatttttgatctgcagttggttgaatttgtggacttggaacctgaagctatagagggctgactgtgtatgataacctagaactgcaaagccagggaattcctttgaaagaaaaacactttttctttctaaaacatctattttgttccaagtattgtgctgggcattttatcatagacgttatatcttacgttccttaagataatgccttgagataaggcattccgctcccatttaaaagacaggaaaggtgaggctcacggggtcacactcgctgagatcacagcgctgcaaacttgtttctggccgcagaattgtttccggcgctccgagatgcctttcttgatggagccagcattccaggggcccacttgctttacagatgaggaaactgaggcccaccaagggaggggccctgccccaggtctcacagtgaagcaggggcagagaggtttcactcccagcaatttgtaagcttgggggactgccagcgtggtgtggacacagagctgcgtgacccctcccaggataaaagcaggtccctgcagatacgaggagccgcgtgtcccctcccaggataaaggcaggtccctgcacacaggagctacacgtcccctcccaggataaacacaggcccctgtatacaggaggagctgtgcgtcccctccaaggataaaggcaggtccctgtacacaggaggagctgtgcgtcccctccaaggataaaggcaggtccctgtacacaggaggagctgtgcgtcccctccaaggataaaggcaggtccctgtacacaggaggagctgtgcgtcccctccaaggataaaggcaggtccctgtacacaggaggagctgtgcgtcccctccaaggataaaggcaggtccctgtacacaggaggagctgtgcgtcccctcccaggataaaggcaggtccctgtacacaggaggagctgtgcgtcccctcccaggataagtgctggtccctgcacacacgagggtccgcgcgtcccccgcaggataaacgcaggtccatgcacacaggaggagctgcgtgtcctttcccaggataaaggcaggtctctgtacacgtgtggagctgtcttttccctcccaggataaacgctggtccctgcacacaagggggtctgcgcctccccgtcccaggataaaggcaggtccctgcacacgtgaggagccgcgcgtcccctcctgggataaactctggtccctgcacacacgaggagccacgcgtcccctcccgggataaacgctggtccctgcacacacgaggagccgcgtgtcctctcccaggataaacgctggtccctgcacacgtgaggagccgtgcgtcccttcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgtgaggagctgtgcgtcccttcccagaataaaggaaggtccctgcacacatgagggttggtggctctcctgagggttcacaggttcccggggacccatccacagatccccagataagaacctgtccatcctccccggggcctaagcgtgaccagattgatctcagtttgcccagtgagtagaaaaataggccgggatcagcagattcctatagacctggtggaggcctgggctggagtagacccaggcagagttggtctttcacctcgcccccttccggaggccccgtacccttggggtcagcatccaggcaacatgggatacccagaaccttctttcttgtcctgagcccttctctcccagctcggcatggacttgagtgacagctgctgtgtttctttcctgcccagtgagtggggccgggccctggagctttccctgttcatttgtttcgtctccttgtggggaaagcatggctcccccattttccagatgggaagcaggctcagagatgcaacagaagtgggaagtgatggagcagggactccatagctccagtcacgagtctcaaactctgtgcgcatctgggtcgcctgacccggcctccctgacccgggctgcccagaagggagcccaggaatgccggggagggtcacacagccagggccattcaatgcaggtggtgctgggaccacgccttgagaagctccagtcgccttccctcctctgcaatgaggcattgctagggggaggcgagtgggggaagagaccgggtctgttggggtcagccccgggcacagcacccgacagcagaggagacctccggaaatcatggctggatgggtcaatgagtggtcaatcaggcgagctctgagcgacaggaggggccggtggtgtggagagagggaagaagagcctgcaggagggagacggtgcgtgcaggggcaccacggccagagcctgcttggtgttcagagagccctgtggctgccgcagttgggagaagggcacggggtctgagcacagacagcttccaggccccagggttgggggactttgaattttctccagggcccgggaacgacattgtctgatttaagcagaacagcaacgcaatctggttttgtgtgtgtgtgtgtgtgtgtgtgtgtgtgtgtgtgtgtgtgtattatttttttttttttgagacagagtcttgttctattgcccaggcgggagagcagtggcgcgatctcagctcactacaggctccacctcctgggttcacgccgttctcctgcctcagcctcccgagtagctgggactacaggcgcccgccaccacgcctggttaagtttttgtattttttttttttttgtatttttagtaaagacagggtttcaccgtgttagccaggatggtcttgatctcctgacctcgtgatccgcccacctcggccttccaaagtgctgggattacaggtgtgagccactgtgcccggccaggttttgtatttttgtaattacactttttattttgagatcaccgtagattcccaggcagtggtgaggaatagatcagagatccggtgtccccctcatgtggtctctcccgaggtggcatcctgtgcaactgatgacatgtcggaaccggatattgacgtggacacagtcaggatggggagcacccgcgccccagggtcccttgtgttgcccttttgtagccatacccgctgccctggcagcctctgagctgttctccattccttcagtttcgtcgtttccaaaatgctctgtaaacggaaaagtacagttcgtcattttggggctggctttcgtcactcagcctcatttgctggagattcttaggtgttgcctatatcaatagttcgttccaggctgggctccgtggctcacgcctgtaatcccagcactttgagaggcctaggcgggtggatcacctgaggtcaggagttcgagaccagcctggccaacatggtgaaaccccgtctttactaaaaatgtaaaattagccgggtgcggtggtgcgtacctgtaatcacagctactcggaggctgaggcaggagaatcacttgagcctgggaggcggaggttgcagtgagccgagattgcgccgttgcactccagcctgggtgacagagtgagactctgtctcaaaaaacaaacaaacaacaaaccaaaaaaccaaataaaatagtcctttctttcttattgctgggcggtgtcccacggtgtggatgggccgtttgtttaaccatctgtcccttgaagggcatctggggtgtctccagcgtgggatgtcgtgaatttaaaaagctgctgccaactctcggtccaggttttcctgtgcacagatgtcttcgctttcccccagtggatgccaggagagctggtgctgggccgtgtggaagttgtatggctgagttcacgtggtcactctggtgctggcagggcagggaaatggggggccagagaggaagctgggggtcatgggagggatgccacctctagggaggggtgcctgtgtccaaggagtggagatagtggctgggtctggtgggggctgtggaggtaggggggctgcatggtagggcagaggccaggagtctgggactgggtggtcctgtctttgagggaatttggagaaggagcaggtgcaggtgcaggggctgagagtcacctgtgaaacatgctcagcagagaagctgtgcgcagccggggcaggggtgcgtccatggtggggatggtgtgtctgggtggaaggggcggggcatctcccactcccggtggcattgaatagtgggaggggagtggctgggcgcggtggctcatgcctgtaatcccagcactttgggagactgaggtgggcggatcacttgagttcaggagtttgagaccagcctgggcatcataacgaagccccgtctctacagaaaatacaaaaattagctggggcatggtagcctgcgcctgcagtcccagccactccggaggctgaggtgggagaatcacttcagcccgggaggtgcaggttgcagtgagttgagattgggccactgcactctagcctgggcgacataatgagacgctgtctcaaaaaaataaataaataaataataaaacttggaaataaggcaaaaaatattatttaaagaaaacagaaagtgggaggggagaaatgcacaggatggagcctaggggagccccaggactcgagaagtgggcagaggaagaggaggcaggaggagggagggaggccgggcagcagctgggggaggagggcgtggacaggccgggaaaaggagcaaaggcaggatgaggacacaacactggcctgtgcctggccttgtggcaaacacctcatcccttaggccattggccatcgtccctgctgtcctacagccccgagaggccaggtacgtccatgtgtcgtgcccattttacagacggtggagctcaggcctgggagacagactgacagtgttcggcactaactccaccccagcctttttccacctggccacactgtttactcgttcccgccagcagcatgggggctctggtgtttctgcgtcctcatccgcacctgtcatcgcctgtctttttggttgcagccacttctgggatggatttcctggaggctggtgctgagtctctctaggtgcttgtcggcccattggtacatctttggagcaatgcctgttcagatccttgcccatttaaaaattgggttatttcaggccgggcgcagtgctcacacctgtaattccagcactttgggaggccgaggtgggcagatcacctgaggccaggagtttgagaccagcctggccaacatggcaaaactgcatctctactaaaaatgggaaaatgagctgggcgtgatggcaggcgcctgtaatcccagctactcggaagctgaggcaggagaatcactcgaacctgggaggcagaggttgcagtgagccaggattgcaccactgcactctagcctgggcaacagagtaagactctgtctcaaaaaaaaaaaaagggggggcactgcgcaccagcctgggcaacatggcaaaaccccatttctataaaaaatgcaaaaaattagctgggcatggtggtgcctgtagtcccagctatgaggaaggctgaagcaggagtatcacttgagctcaggaaatcaaggctgccgtgagctatgatcacgccactgcattccagcctgggtgacagagcgagaccctgtcttaagaaaaaaaaaaaaaaagaaggattatttgtcttcttactgttgagttgtgacattttcgtaggctgtagacaccactgtgagccaccggctcccctgcaccccagcccacctggctgcaggctgcctgctccgttggaggttggacttctgagataaactgcgctgggtgtctgtctcttggctccagagtaccaggcacagtgccatgcacacagtaggtgctcagtaagcggcgacaggacaaagccaggatctcagtctgcggcttggaggggtctggggtccggctgtcactatctggctctgcttaccagctccggtcctcggacaccacgacggctgcaggcagagggaggagccacggagtctggggggatgttgggccacacaagtatctactgagcgccgactgtgtgctaggcaacaagctggccctggggacagtggtgaacaaagagccctaggacttcttggttgggggaataggacccgtcagtcagccctgcacagcttcctgcggggcacggatggggcgcaaggaaggggctggagatgccttctagggagtgaggctggtgagcgggttggggaggaaccatggggcctcccagacttcaggaggcgcatctgtgagcaccagggacagaaggaacagggccaccctgggacccagtgcgcaaggagcccaagggccctcacacgtcacccttgggtgtgccagagccagtccagttgttaagaaaaacaagagccggaggtaaaccccttgggaaacagaggtcccagcccacagtactgcgtgggagggagaagtgtgggagtcacctgggctctggggtccctcaggccagcaatggggactgggatcccagcgcaggctgagcctgggtggctatgtccacactgcagagacctatcgtgagcaagtttatggtgcattcctgtgtggaagagtacagcagaggccaggggggtggggctgcagcgacagtgaccaggagtcacccataggggcagggtcctggtgtcatgggccagagcgggccagagcggggacggggggcaaagggaaggagcatttgagcctggatgggggtgtggttagcagagaggtgggaggggagggagagagagagagaaggagagagagggagagaaggagagaagagagggagagggggaggggaagaaggagaaaagggagaggggtgggctgtgaggagagggaggggaagggctgcagagggggaacgtcagtcctgccatgggggggacgtgcgttgttcctcgcccctcccttccaggttttgatggtgctgtttcctgcgtttacaccacagctctttttgcgtctttccttggattccacacagcagccctgtgaggcgctgtcctcctgctgcccggaggaggagactgaggccagagatgcggcaaatttcccaaggccacacggttctgctgttggggcggcactgggcctccctgcccgcctgcctcagtctggccctgtgaagaggtctcttggaactgttaggagcattcgaaagaaactgggcccctgggctgggtacggtggctcgcgcctataatcccagcactttgggaggctgaggcctgagcacttgaggtcaggagtttgagaccagcttggccaacatggtggaaccccatctctaccaaaaaatacaaaaatcagccaggcatggtggcgggcgcctgtagtcccagctactcaggaggctgagacaggagaattgcttgagcccgggaggcggaggttgcagtgagccgaaatcgtgccactgcactccagcctgggcaacagagcgagactctgtctcaaaaggaaaaagaaaaagaaactggtcccctggagcgcaggggtcagcagctaacttctcgccctggcagctggacccgacttggcccagagtgccagggccagtgcccccatctgctctgtgtcgggaggggctgctggcaggaggaggtggccactccaaaatcctatagacggagtccgggggagggggttcgggacaggaacagcccagacctgggatccgcggctgcgcaaggggcttcagggtggtctgggcctggttctgagccctgtgaatccaaggccacaggactgggcctgggggcttctgaatccccaccagtgccttcttgctctcaggagcgttggccaaccccccaggccccagggcttcccctcgtgattctcctctgagagaaacacacccacctacagccgccagccaggagcaattgctgtgcaaacacccgggactgtctcagacggtggatgcaggcagccaagcccccggaaggctccggttgaagggccgggtttattcctccctgcaatgagggtggacactcccccaggaaccacggggcaagagggtgttgggaagagccccactagggtttggggtttgggtgggtggtggggaggggacagtctagggacgtagggctcactagaccaagtgctgttggaaagggggcgattctcctgtgggtgcgttggtcactgtcgcctgtagacatgggagacctgcaccaaaataatgcggagatgggtcaagaagcagccgcccctccccttagtcgagaggggggatggttggtgatcgtgggtggcacagtgacctgtttctatctcactctactgtgatctcagagtgaccttgtctggggtcactggggtgttctgggagatggtttatatccaacagaagaacgacgcagcctggcaggagctccaggtgtcaggggggggcccctttggggtggaggggatgcctcagagccagccgcatgccaccccacaagctacctctctgccgccgtctgccccagagctgcctgccttccgaggcctcagctggtcctgtgcgtccctgcgtctccaggactcttgggtgatggctcaggggaagtttccagaaagcccagccatttcctcctctcctcctgggcttgggtctgaggtcagcttcccagggggcacccaagcctccgtgagcaaggacagagagtggctggagtgagaacgggtgctgctgacctttggcggtgggagggtgtctccagctgtgttcccatttctcagtgactaccaggtgctgtggcccttggctgcagaggggcgtgcaggcagcctctccttcctgtgaagcagcagctgtggcagggccgggaagtagagctcccctctgtgaggctgtggctggggtaggaggagagctctcccttctgcgaggctgtggctgggatggaagtctgccagaggcgggctcagaagaagttccatgaggaactgagggctgggacctgcaggaggagctgagggtgcatggggtctgggggagccccagagatggtcagggtctcctcctgataaatcagaccccccccccgccccaccctgccgctgagaggcctggtcctgctctaaacctggagtggatggggagcgtgggctggggctggggggctggggaggtggtgtagccagtgccctgccccaactcagcctctggtcacccttccagggctggcaaggcattgggggtatgagagggccctggggtcccagggtctcagaggacttgccttctctgcgatggccgctactacctgggtcccacaggggggtaagttcagagggggacctggtggaggtcggctgtgggcaggggagccacaggagtgtccaggcccctcccaggccagccccacagattctgaggcagcagtgggggcctcaatggaggagtccactctgcccaccccggatactgcccagccagcctgggttccagcgtgggccaagctctcgtcctggtctcctgggagctgtgtggtcctgcaaggacctcagcaccttccttgctttgagcatccctcccccaaggcctggctgacactcggagccagtatccatagagggctgcaggggcaggcgagggtggacactgatgtccttggctcattcctccctggctggctgctctgatgtccagcagggtgggcgtgaggctcatggggggctccccagccagggcaggacctggggtaaccctatcctgggatgtttgctcccgctgtgtgggggacatgccgtttccatgagtgacagagtcaccgatgtggccagtaccactgtgggcttgaggcatcttctagtttaaggaaatgttaaatttcaagtaaagcttagtgaaaataaggatgcaatttcattccccaacaaaacaacctctatttccttctgtgaaccccttgggagctgcagaccccgagttccggaccccctcacctcactctcctccttcggagccaaagtggtgcctgaaatctgaggccccatctctgagtcctgcactggtcctggcccgaacactcccccacaacgcatgggccacaaggaccctctgggcagattttggggtgtctttggaggtttaggggcaaagcttgaaaactgtggggtcctccctggggaccacatgcccagctgtggggtcccccgaggccgcagagcaagctttctggaagatcctcctcctttgagagccaccatggagcccccataatgggaatggagggtgttgccattaaacatggccttggcgttgcccagaagtctaggtgtgtccctgtcagctgggaggggacagggtaactgtgcggccctccccagggctgaggctggggcagcctccagaggccaggttgtcgctgtcactccccaaatggagggtccccctcattccctgattgcagaaaaagggctccagtaagtctggcttttaaaaaatacagctttgctgacatatgtttcacacaccgtacaattcacccatttaaactgtacagtccagtggtttctagaatattcagagttgtgtcactctcaccataatcaattttagaacattttcatcgtctcaagaagaaaccctctagctagctaccccttccccattcccacggctccccacccctggtgaccgagactccattttctgtctttgtgggtttgctgctcctgacgtttcgcatgcgtggagtcatacgctgagaggccttttgtgtgtcgcttctgttgcccagcgttgttttcagggttcacccgcgtgggagctgcatgagtccacttcttcgtatcgctgagtaatattccactgcggggcaccgcgttttgtgtgaatctgccaccactcaggatggctcatgggtggaaacagcgctaaagctggcagagctttggccggtgtggacaagccctgggtccaacttttgggctgtttccacctgggggctatcctgagtcgtgctgctgtgaccatttgcgtcctttcgtttcctcctgggtggagattgtggggtggcctggctgggtcgctctgggcccaactctctgagaagagctgttgaacacataccccacagctttttttagtttttatttatttcattttattttttgagacagagtttcactcttgttgcccaggctggagtgcagtagcgtgatcttggctcactgcaacctccacctctcgggttcaagggattctcctgcctcagcctccgaagtagctgggattataggcatgcgccaccatgcccggctaattttgtatttttagtagagacagggtatcaacatgttggccaggctggtctcgaactcctgacctcaagtgatccacctgccttggcctcccaaagtgctgggattacaggcgtgagctgcctcacctggccttattttatatactttttaagacggagtctcactctgtgagccagcacacctggcccatggcttcttttaaaaagagacttctggaagctgagaagtcttttccagggctccacctggcgactgaccactgggcatggtgaggtctgcgtttggaggaagtggggtgacagtgacagctgtgactattggagcacacagtcggtgctgggcaggtgggtcattcctgaaccctcagtgtttccctcctcgggggtcctggccagtcactctcctcctccacaccagcccccagcagctcgcaggctgcctgggcccagccccatcatcagccgctgggcacccacctgagaggtctgaaccctgcccttggtgctgcacggtcacttgccattttcgcagaggggccccctgagcaggaggagcagggccagcatgcacactgcagccaaggtcccaagaaggaagtggcgaggaggaggaggaggactggccccacctgttgccctatgtctcacagcgcagactgggggagacgtgaggatctaacaggggttcctggggggccttcatcaagctgtaatgaatgttgtgccaaacccctgtcaacaccagtgggtacagcacagggttcaagggctgaagaagtgacccagggctagcaaaggagacccggggtttactgcgagccgtggggtggggagggaagtgcagggacgggagaaccgcagcggcttgtagacagcgcaaagttcctatggcatgttcaccccataccctcccctgatgacctccacctgccaaccttcattcaacccaaaactcagggcctcaagcccctgcacagcgcacgttccacgggacaggccaggggctcagaagttcctcatagccaaggaggcaatctccagattggccactcctggattccttagctcaggttgttcttggagtatgcgtaagttactgctatcgggggtgtttaccctccaacaggtgtttggtgggggaggagcctccttgggggtgccaagagcaacagcggccggggtctcatgtctgtggggccactcccattgctttgtgcttagtaactgggtcttcaaggcagccctgtggggtgggaatcatttttatcctgtgatatttcattgtgcacacgtgcagactgaggttgcttaactaccccaggccgcacagttatcaccatggagctgggatttgtaccctggtggcttagcacagagcctgagcacacaactcccacccgcctgcctctctccgaccgcgagtcctccaggaggactggggctctcctcccagcaccaccacggccattgagcccagtgcccaggagaccgaggcctgtgaggtttcacctggggcccggagacaggctccaagtggtgtgggggcccctgtgcccaggttttccccgaggtgccggctcatagctacacatgcccatgggcctgcctgagcccggtgctccaagccacaccccgagtgggcggcctccctgccacgcagtcctcggcctgaggccgccacactcagagccactcagcctatggggtggtgcatgtccagaaccctgacccttgggaaggttgggatggttggagatgcagatgttccaaggggaagtggcgggagcgggtgctggctgggaccaagggattctcaagagaagacgtgagcttcactcaggcacagctcttcagcagcaagagtgttggtcctaaaagatcatgtaaatagaggagggcatggtggctcatgcctgtaatcccagcactttggggagggcaaggtggaaggatctcttgaggccaggagttcaagaccagcctggacaacatagtgaagccccatctctatttattaaaaaaaagttttttaaaagataattttaaaaggtggttgattctgaaataagaatcacctgggaagctcttaaaagcctcaagcccgggcctgccccagccccgctgaatcagtgtctctgggccggggggcgaggccagtcattagttgccaaagttctccaggtgattccaactcaagcctctttgccctagagccgtggctcagcttgaggagcattagggcccctggaggttgttaaacccacgttgtggggccccagcccccagttcctgatgcagctgttggggtgagctgaaaatctgctgcagagcctgcatttcagggttcccaggtggcgccaccagcttgagggggtcttggcgctattgtaacgataacagcagcggtctccagaaccttctgtaggcctctgcatgctcacaggttagaccactgagaccacccatggattttatgtagtagacacacagggtgggcctcgtgcccagtgttgtctaacatgctttgtaagtgcagacccgttcctcccagtgcctttggaggtggagattgtggtccttgttttacaggcagggacagtgaagggactgtgaccgctgttggtgccaggcatctggctgcagctcccaggctctcatccctttgctgtgctcctttgcagcttggagggaatgattttttatccccatcttacagtatggggaaggtgaggctcagagaagtcaaggacttctgtctggggtcacgtggctaggaagctaacagccaggatccgagctcagatttgcccgacttccacccatgccggtgggcgggttttctccttggagaggggccagtcctgccccgaggtgccatctctgcacaggtaacagcatcagccaggcaccctgcaggccaccccgcccctcgcaggggtttccactaaccctgctgtctgccaggccagcctgtgggccccaccacctcctgggtgagcgttcccaacatcagagctatgcagcaggcagtgaggggatcatgggtctggcaggggcaggactgggagggacacccttatgtgctgtgtcctgttcctgcctcccctgttcacgccccacagaggagggaggaagctggggttaagggcaagggacagttcctgctctcccaggccccacaaggcatgcaagaggctaaaaatcagaagccagcaggacgcccaggtctcctgagcctgtgcgtctgatctgctcacctgggagacgatggtgctggcatgggcgggtcagaaggagcagcaggacccttccacggcccaggacaagccagccctcaggggccagagcccccatgctgggcacagggctgccaccttgggcggtgccctccctagctgccgcacttcagagtgagcccccatccctggcgtctgccctcctgagtgagtgagggaggggccgggtggggccggatcgtgatcagagccggagctggccttcgtgagtgatggccttgcctgctctgttgcccggtgacagtaaagaatattcctacagagtgtgggttttggaagcagacatgcctgtaggggtcctggctcagacgcttccctgacgttagcacctgggcaagtggcttaacctcatcactcggtgttggcatctgtaaaatgggcacaataacatgctaatgtctccctcgcggggctgtgcgagaatcgattcagtggcccgtggaaacccctagcgtggcccggatgtgtggtgagtggccttggcggcgtcagccttcatgggaggtgggagagctttgccgtcctgggtgaggtcggggtaagagaaagcagagtcggtccccagcaggtgtggctgggaggatgctcagtcactcccaatgttcattgggagtcactgtgctcccagtggacagagtgtcaggtagggtctacagatgagccccacttcttagccttgccctgggtccacaaatcagccagagttactgggtgtggggcttcctcaatgtcagggatgggggtgaacagaagggctgggtccggagtctccaaggctccttccaggctccagggctaacgctgtggggggggcccaggtctccacctcttgttgctgtgtggccttgggcaagtgactcacttctctgagcctctgtgtgtcatggggaagtgactccatgcctgctgctgtctcggtatttcacaagtgctcagcaaatgccagcagaccgtgtccttcagacgcggcagctggggttcctgactgctgggctactgctgcggtggctcatgaaggtttttctgtccccactacaaaacaaaaggcagctgatgcaggagttttagtaaagataatgtatattttagtaaagataacgtatatttgatttaaaagaatgctctttattctgagatttggtccatcccatctttgtgggtttttttttttttaatttggatgtgaaaaagacattccctttatttgtaattgcccaaagtcggaagcagcgaagatgccattaaatagggaagtggataagcaaacagcggtgacgacgcggagcagccttcaatgcctggtgctcagcgggataagcccgtgtgaagaggccacatcccgtggggttccaactagatggcgttctggaagaggtggaactctggagacagtgacaagatcattggttgcccagggttgggggggagggagggacagacaggcggagcccgggggatttgtagggcagtcatactactctgagatactctaatggcgagtatatgtccggatgcctttgtgcacacccatggaaggcgtggaccctgatgaaaaccatggctctggttaataatgtatctgtcttggcccatcaattgcgacagatgtaccacaagatgctaatatcaggggaagtggggggcgaggggatacagtatatgggaactctctgtactttccacttatttttctctaaagctaaaactgctctaaagtattttttaaaaagaaaaagttaaaaaaagaccacatgaacccatgtggagagtggaagaagcaaagtcaaaacattgcccagagtccatgctggaagccagttggggcgtggctgctccactcagttgactgtctgagtcttgtccccacagcacagattggtggaccttcagcccccacactggaggcactggccttccgaatcccttctcacctgagtggggtcaagacgcacctgggtcctatttgctgcccacctctggggccagctgctgttcttggcacctcccaccctagggggatggtgtctgcaaacggtgcttttggcctctggcatgtccaccctgccacaatcatcttcctcaccctcatctgcagaccttctgacaccacctctgctgacccctctccccttgtccttctggggagatcacgaacctgccccttcctggcattccccagccagtcctccctggggagcaggactgtgcatcgaggccaggctcaggtcttcacccacacccacgttgacaacgtacgagtcccctctgagccttagtttctgtggctggaaaaatgaggttaatatcactattgtgagaatcttctcataaacgcatctttccttcccctcctccttaaaatttttaatccttattgagctattatgtgcccatagtttaaggtgacatttggtgctaaaaacaaaatagagcttggagcaaaaatcatgtgtgtcttcagagactgaccaccatgtttttaagtgggtgtgtttgccgcttcctgagctcatggtcacttttagccattatctgttgactcctactgtagtagatggagattttcaatcccttagacccccattctccccactcccagctatctcaatattgctatattgcattttttgttgttaaatccatactcagtgtttttcattatgactatgtaagtattgcttactgctgagccaggcaatggagtctgattctgtacacttctcatgcataacttgagttagtaattgtctcgctttttttcagttgcaattttctttaaatcactggttcttttttcaccttccaactgctcagtgaaacacctctcaaatgcagcttgcacttgagcaaacctgccagattcagtaatacacacaaatgtacaaatacgtttgtttattgattgattgccttcttcccaattcttcccccattttcctgggtatttccttcacttctcctgtgtttgatcttctcatgtcttctttcatggtttcctccctcatttgggtggagcacatcctggagtagcttcctaagaaaggatgcatggaagatatagtttctgtggcttgattatttgataaattggtatgcatagtatgctaggttgaaaatcatttctgctcataatttggggcggtgggggtgcagtttcccactgacttctaggttcagtgttgctcttgagaagcccatgctgttctgattctcagtccttcatttgtgatctgtttttatgtttctctggaagcatttagggtctttgtcatttgagttctgaatttcatgccactgtatcttggttgggtgtctctcccctcattgtgtggtatctgtgagccctccagtctggacgctcacacccttccattccaggagactttcctgtttaaatctttgcccattttccttccctgctttctagaactcctgctgtttagagttcgggtgttctggatgagtcctttaattttcttactgttttgcctacctacctctttttttgatctagtttctgaaagattttcttgatttttatcttccagcttatttaccaaaatatttcttttagctattatacttttaatttccagaagctctttatccctggtctttcctttttaattgcattttattctcattttgtattttatctctgaggatttaaattctggtccctcgatgtcttctcccacctgctgcattttctgattccccctcttttttcccacttatttgtaagttttggtcttttttgtccctgccaaggcttctccttgtgtctgaggaccgttgactgttcatatattaaagtgaggtacgaaaaagctgagtggaaacttgtgtgtgtggcagccttcgcttctggctacagtctgttttttcagaggaattttccacctctctcctggataaagtaatcctccctgtttgggtggggtagcaagcagggtttttggttcagaatgagcactttcccagtgcctgctgaagcattggcgaaaagacgaaaaaaagagcacttccctggcagtcctcccccaccctcctctgcctggtgggcttgtctgattgttggcctagaaacttttcttcctgggttctgcagaaggagagaaaactctcttcctttcattcattatttatatttctcagcaatctggctttttatcctttttcttggtttgtcctaactttaagagatggagtcttgctctgccacccaggctggagtgcagtggcacgatcaccgcagcctcaatctcctgggctccagcccctcctgggctgaagcagctggactacaggtgtgcaccactaaacacactaatttcaacaaaattttggctgggtgcagcgactcacgcctctaatcccagcactttgggaggccaagacgggtggatcacttgaggtcaggaattcgacaccagcctagccaacatggtgaaactttgtctctattaaaaacacaaaaattagccgggcatggaggtgtgcacttgtaatcccagctactccagaggctgaaacagcagaattgcttgaacctgggaggtggaagttgcagtgagctgagatcatgccactgcactccagcctgcacgacagagctggactctgtctcaaaaaaaaaaaaaaaattttggtagagacagggtcttgctgtgttgcccaggctggtctggaactctggggctcaagcagtccttctgcctcagcctcccaaagggctgggattataggtgtgagcctccacgcttctcctgtccttttacttcattatttatatagttaatcacctcgctagagactgagaattctgtgtcctcaggctgccatcacaaaataccacagacagcatggcttaaaccacagtttatttccttgcagttctaaggctggaaggtcagggtcaaggtgctgggagagttgattgttctttgttttcgtgggcttgtccctctgtatgcctctgagtcccttcatagaaagacaccaggcctattggatgaggacccccagtgccttcatttttaactcagccacctctttaaagaccttatctatctccaaacaaggtgacattctaaggtggtagaggatgccgggggtgggggtgggtaggactgcagcatatgcattttggagaaacgcaattaagcccatagtgaattccggcagacataactattcagaactccactaagattaaccaaaaaaaaaaatttatatatatatatattaaatgatgggcggggcgcggtggctcacacctgtaattccagtgctttgggaggccgaggcaggcggagtacctgagggcagtttgagaccagcctggccaacatggtgaaaccctgtctctagtaaaaatacaaagattagctgggtgtggtggcgggcgcctgtagtaccagctactcgggagtctgaggcaggagaatcgcttaaacctgggaggcggaggttgcagggagccaagatcacacactgcactccagcctgggcgacagaatgagactccattgcgaaaaataaaaaaaatctggtgttggtagtaacgatgtaggggacatggtctctcttatagtcttttctgagggtaatttctgaaaaaccataaccccaaacccttgcttttgaccaagcaatttcattctaggaatttatcctaaggataaattttaatgtcatatgaagattagctgtgaaaacggaggagcgacccgaataccttgcggcataggattagcttgtaatttatgtgcttgtgaaacggccgtgcaatgaatggggctccgtgcagccggggacaaagtgggtgcagagaggcaggagggacaggcacggggcatgggggccacccgtggagaaagccctggagctttgtgaatgccgtctgttggccagcgcagggctctcactgtcacgttggacctgtgcccagggtctggtccctgatctgtgagggtcccagagggggcacaacaggcgaagaccccaaagacaggggtctgttccggggcatcctgggcagagagtgggtataggggacagaaacccagccaaagcggctcaagtggaagatgggtgctggtcgatatgggccagcctgaggggtgtcagagccgggaatggggaggccatcggaagcccacaggagccacttctgagttccctcagggtggaggcctggccgccttcccagtggtgcctgtttcttcctttctctgcgggttggcttctctgcgtccctgcctccaggtgggaaggggtccctgcaggcttcgtctcctcccagccgcagagccaccaccttgggctcccctgccccaggcccaggctggtggatctaattgggatttggtaagctgtgacgggaggggggctctggcccgtgcccacccatgggaaacgggccctataggaggcaggtgaggcgggccagagtgaatcagtggtccagtccagaacggaggctgtgacccgccagggtgggagaggacgggctttggggttgggcctcagccccgagtgggcaggcacagcatgggactggctgagagacgctctgtgtgggcttcggatcagctcagcgtaggtttcagtcccgctctagctgggtgacactggggttattttacctgtctctgcctcagtttccttctttaagtggacacagtaagagtgctgagctcccggggtagtgtgtggatgaaaggtgacctccgcctgcatggagccatggaaatgtttccccttttccctccactggactctgggacagtagtgggagcctgggtgggggcttttgcctgccagaactcatgggtcggggccgcacatgagtgagtgtctcctgggcagggctgtggccatgagctcaggtctttagtgggctccttgctcctcccagcaaagcgttcaccttgccccaccctgggacctctcaggtgctctttggaggtgttgacctggggcatctgtccatggccctgaggaggtggagcacctggtgagggctgcgctctctccagctgggaccccgggctccgaaactaaagttttgggaagagtgtcagctgacgggtggggcttcagaggaggaaaagaaacaagggtgtgagatgtgcaggccctggtgagagacaggcagcagcaagagcctgccagccatacttacccacaaggccggctgaggggctgtgctggcccagggctctggctttcggacccagacaatgctgctgaccaagcaggccaggcgctgagtgactgtcccagcggatctccgagcagggtcccttgagcattaggaatgcagcttctcaggccatgccagcctggcagaacaggaagggaggggtacagccctgtggggacgcagctgtggctcgagtgacacctgctggcggcctcatctcatccgctctctgcgagtctgtggtggttctagtcggcgtttcacgggcaaggtttagggggtttgttcctcacctggggtccacccacgtcttccgacttcctctctcggtgtttgggccatcggtgggtgaggtggctgcagcagagccgggggctcctgtgtgcggaggcagcaccgacatccactgcagccacaccctcctgagagggtctggaaggaagcagggcaccctgcgaacccacctgcctctggggtgtcttccggggccccagggccagggcaactggagcagacaggacattatctagctctgggggccgtgctgaccgagccagaccctcgcggcggcccacagagatgggcagcttgcggggcagctttgtccccccgacactgggtcctgtcttcatgcacacaagccgcctgttctgcaggtgaccagttaggttcgatgggacaggctttgggaatcagcggcttgggtttgccccccacagccttggatcttgaccttgggagaggcctccaccacgtgccctggggtggggtgggggcgggggcgtcctgcatctgcgccgttcggctcagttgccctcagccgcggttggccgccaagcactagggtgttgctggcacagccaaggaactgagcccagactttttgtttacttaatcaagcataaatgcaaagggctgggggtggccgagctgatggtgcaggcgtgtgtgctcaatagctccatcacagtggctgtcgctttattgagcaaccgagggagcgagggagaggagcaactgcggcgagcgtggaggcccagcccgcagagctcccgtctgggggaagccctgtccctcactgcctgttcccggcgctttggtgccctctgctgtggggtgatgaggtcaggctacgcaggcagtcacggcagaactgaaggccgtgtgctttcgtgtagccaaaccccttttcttattgatatcagttataaaatcagagctatgttcccaccaggggcaaaaatccaacaccgtgcagttgcaaacacggggcaggaaagactccggcgaccctcattacactgtgccgggaggcatggccagagctccgtcagttcatgcgtcgcttaaacctagaggtgggtgcgattgtcaccctatcttacaggtgtggaaactaactcagctccgagatgtgactgaccttccccggccatagtacgcgcagcgcagtggggcctggacgcggctgcctggtttcaggtccacacgctccccagcactgccggccaggctccagcatgacgggggtcaggcctccacaaggccctgtcggccacgggagtttgctgcgagatcctgggtccctgactgtgttctcaaagcccctaggatttgaccagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcccgctcctccccggccaccatccatctgtctctggatttacctgttcatgttatgggggggagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatgcttgaaggccattccgcctcgtggtgccctgggcgaatgtcgagggaaagcagactccctgtgcccccggggttggcttcttgctcaaggattccagatgctggcctcctgggtgttgttcccatgccgagctccagttgggggtgtgaccagcaccctgtgcgggggctgctggtgttctgtgttgtcagagcagtgctgttttgtgtttttctttaaaaaaaaaatttttttttgagatggggtttcactcttgttgcccagactggagtgcagtggcacaatcttggctcactgcagcagcctctgcctcctgggttcaagcaattctcctgcctctgcctccccagtagctgggactacaggtgcccgccaccatgccctgctaatttttatagttttagtgaagatgaggtttccccatattggccaggctggtctcgaactcttgacctcaggtgatctacctgcctggcctcccaaagtgctgagattacaggcatgagccaccacacccggcctccttttaaaattttaatttttaatgagatggggtctcactatgttgcccaggctggctttgaactcctggcctcaaatgattctcctgtctcagctgtgttttgtgtttgctccagccctttgctggtgaacagacgcgttcactggacacctaagtgcctggaccgtggagcacagggtgggggtgctgttcatggccggaacgccagaggctactggggagacacaggagcgaccaccatgatccacagaccaggactgtacagagcacttgaaggggcggcctcaagaattgtgccggaacagtgaacatgagggctcctggctcccctctgaggacaagggttaggtaggaggggacagggcagggctgaggtgggtcggcttggttcatggcagggcttggggagtgaggagagtgaggagtaccgggacccggggtccctgctctgctcacctgctgagaatgagccagtgttggcctctggtctccatgtctgtagagaggcttctctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacaaatctctcaggatgtgaagtgtggcccccagcctggtgcctttgcagtgggcccaggacggagggtagccttggcacctggggaggacaggtgaacctggatccagactctgcctcaggtgacagccctgggttctaacgctgccccttccgcttcctggctgtgtgttcctagggcggccacagcccctctccagcctcagttgcctcacctgggaagagaggtgcagggcttttgcgatgatcataatagttaccatcaatcgagcattagcgactttccagcaccttaaggcagttaccctgtgatctgcacagccgccctcccctcgttgcagatgaggagactgagtcagagagaggttaacccagacattcccaaggttgtagattgagaaagtgttgagttgggattcgaactcaagtctgtctgaggcctcctagccccttcctgaccccagagccttccgcacctcatggctccaccagaccctgcatgaagctcctggtgggcaaactgggcaccttcactttaaacgttgagggaaaaatacacataacctacagtgtcccgtctcagtcatcttcacgtgtgccgttctgtggcattaagcacattcacgctgttcaaccgtcaccagaacttttccatctccagaactttctcatcttcccaaaccgaaactctgtcccactaaatgctcactgcctgtcctccctcctgtcctccctcctggcctccctcctggcctcccgcctgtcctcccgcctgtcctccctcctgtcctccctcctggcccctcgcaccctccgttctactttctgtgtctatgagtctgatgactccagggaccccaggagagtagaatcccacaggatttgtcccttccagcctggcttattccactgcatgacggcctcaaggctcatccaggaagcagcaggtgcccggctttccttcctttttaaggctgaggaatattccactgcatggggggaccacgtcattttatccccgatgccttcacttttcagctcttgttcccatctgtatctgtaagctggagcatcccttgatggaggagggatctcagggagtgggtgagcctctcctctttccagggtcatcctccactttgcgggggcagcccaccttcctggagttccagctgagggggggcccaatttaacaagcactttgggaggttgaggtgggcggatcatgaggtccagagattgagaccatcctggccaacatggtgaaaccctgtctctactaaaaacagaaaaaaattagctgggtgtggtggtgcatgcctgtagtcccagctactcaggaggctgaggcaggagaatcgattgaacctgggaggcaaaggttacagtgagctgagatcgcgctactgcactctagcctggcgacagagcaagactccatctcaaaaaaaaaagggttgtccggttacctgtgcatgccaggtaatcgacaaatgctttttatttttatttatgtatttgtttagagacagagtcttgctctgtcgcccaggctggagtgcagtggcatgatctgtgctcactgtaacctccacctcccaggttcaagtgatcctcctgcctcagcctcttgagtacctgggattacaggcacccatcaccatgcctagctagtttttttgtatttttagtagagacaggatttcactatgttggccagcgtggtctctaactcctgacttcaggtgatctgctcgcctcggcctcccaaagtgctgggattacaagcatgagccaccccacccagccaacaaacgctttttaaatataagtatgtcccatgcagcgtgtcccctaaagaacgatgtgttgttcatctgaaactcagatgttaccaggcgtcctgtgtttgatgtgacaaccctgtccacagccctggcacggaaggggcagtcgctgagggtgcagtcttggggtgagggtccctgtgatggcagcctgtgtccagcttggactggccatgggaaggccactgtgtgggcgggtctggccttggtaaagggccaccccctgagacccaccgagcctagttccagtttcctcctcacaaccccagcctggaagggcgttcgggtgtggagcaagccacagggtttccccccagtgtggttcgcattggggtgccgggtggttccgagtcagctgccccctctgcctcctccccgtgcccatcacaactgcccccagtgctgggacctctgggcaagaggctgaggctgacactctggaaaggtgtgcagtggtgttgtggggtccctggggtccggtccacatacatccctgcttgcccggctcttggcatcctgtaggagaaggtgccacagcctagtgggtgggagggcaggagccccatcactggagtcggaggttgcttttgatgttgatggcagtgaggttgcttctgatgttgatggcagtgaggttgtttccgacgttgatggcagtggacttgcctccaggttagctgcctccccaagcagctttgggggtacagaatgaccgaccagtgtgggatcccaaacatcctatccccttgcctgaaagtgggacgaggctgaagctgacctctcgctgagaccacctcattcggccccgtcctctgctgccacgtccttcttcctggtaccccccttctccagccccaaataagtcacgttcacaggatccccagctcaggctctgctcctggagaagctgccctcagaggctgcgttgccgattcctttttcaacggagaggctgcagcgtgtggcaggtgccaccatctcttggagtgaggcagcctcaggggctctgtccggggctgcagcctgattggtgatctttgcacgccccttctctgccctggctgggccatatgccacatggggcgtgaggggcctgcaacacaagtccctctgggggctcgtgatgtggttgagctggaagatacattctggaacatctaagaccccagccactgtcctgagtctggatgccgcgggtgccgggcatgggggctctgggcccgggcactggggtgcttggaggtgctgtggaggaggggtggggctggcttggagcccatgggattcgattggagggtgggagtgtgagagaggagagagcgtgaacagagccttggacagaaaagcctggaaggatcaggaccctttggggggtggcgggtgaaggtggcggggtgtggggataccctggggacggacaggtcacttgaggctacaggactttgaattccacacttagtttggatcccaccctctggtgtggggcgtgtgagtggagggggcctggctagggaaagggggggggcagtggggagtggagggctgcttcgctccgagagatggcggcacctgccacccgctgcagcctctccgtttaaaaagtgactggcagaacaggagcagctgctgccagctcctgtccattttgtcctctgaaaagagaggtcggggtggccaggtcctcatttttcaggagacagaagagagctgaatttttatgtcaaatctcttggttttgagttgttagcaggtaattccaatgttttatgaaaacagcggtgggacgaataaaacctacgtatcagtaagtctcggcctccaggcctctggtctgcagcctgtgccaccgtgagttggaagagtggtggacggactctgttctccccgcaaaagccctttccagggtggcacatccacgccgttagtgcccggctgcagggagaagctcaaatgacaaatgaggcttgaggtttgccgcgttgggcgtcgtgctgaggcccagccgtcctcacggtgacctttggcatgaggagtcctggttccactctacagacgaggacactgagggccagcggggcccagaaacttccctgagtcacagctcacagagcaagacatgggcccaggtctgctgaccgggtttcctttttattttattgtggtaagagaaatacagaatgtaccacgttagctacttttaagtatacaattcagtggtattaattaccttcacggtgttaggtagctgtcatcactgtttacctccaaggctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtcctcactctgcaccacagactctgatgcctcccttctccctccccgatttccaagagagaacaagatctagccatgagaagcaggatggaggtgtcttcaaaaacagccactggtgatagaagttgtaggaaggtaccatggtctgtctgcctccacgcaaacctcaccaggtttcatcaagatagcacaccaggagtggtgtggctcatgactgtaatcacagcacttctggaggctgaggcaggatcacttgagcccatgagttagaaaccagcctggccaacataatgagactgccatctctacaaataatttacaaagtagtggagcatggtggtgcacgcctgtagtcccagctgcgcaggaggctgaggcaggaggatcgcctgagcccaggggttcctggctgtcgtgagctgtgatggtctcactgcactccagcctgggcaacacagcgagaacctgtctcaaaaaacacaaaacaacaggaagctcagacaggactgtggctgcttcaaccctgtccgtggccaggctgtgccccctcctctgtcgctgggcactcacccctctctcattttctccccagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggtaggagggcgagggggcggggggcccttcttggtgcccagaaggtgtttgtgagcccagtctgttcagtcctgctgtcgctcaaggccttgggctaggcccagtttgaggcctacactggtgtttctcaaactatgcccccatggaaccctagggttccctggaggttctcagaggtgactgtggtcaggattggtgcagaggaatggttgatttgtgggggtgtagaggcctacagcctccttaaactgagcagtgtctctttgttctatatgctgatgtttagtgtaaaatattggtgaataaagaaggtggtctgttccgttagtacaatgcattggagtgctgctgtgctagctagtaggggtgacaccaccaggtgggggtggcaggtccagcactgcagggctgtgggaggtggctaggagctgcctcagctacccagacctgcgatctagattcttccgggaccctgggagatggcagcagttgggaggccaattccgagtgcctggcaaggggctcatgcaggcctggtgctttgggggcagccgctgttctgaatcggctgcatgacttacggaatttggggtccagtggggcctctaggccctaaggaatgggtccagaggtgactgtgggtgggatcgacgtggcttttgggtacctttaggggtgggtgcaggatggggcctttagggctggaggaaggtgcccagggtctggctcctgtggaggtgagtgtgtgagccaggggctggtccccgccaagctgtggctggcaggagccacctgctgcaggttggaggaagttcccctgtggaaagccacgggccccacaggtaggcatttgggttctaaagtaactgaggttactaaagggctttgtcaagacttgggaaggcatttcagaaaacccagagcctttgctttccaccggcatttgctttcctgggccagacgagggcccttggggtagcccggagagtcttggggcagggatctgggagctgcgggggagtccatgggctgcccaggcaggaggcttcccagggcacgttcccctgcgtctttctggatggctttgtgttctcagccaggggcagacctggagttcctccaggaaagctcccagcctgggtgcggctcagcccttcccgacctgtcgctaattaaagttcagcccatttggttctgattttcagtgacctttgatctatagtgaaaaacaaaaatggtggctgcggtttgttggcagaatatgttgctcgcgacttctattgttttagagggaatcaagatcgattccaagaagctgaaagaaacatggaattactacctgacaccgaggtccaaactcgctgtttgcccctccctgctccctcagaaatgttcaggcagggaaataaacagcagcccacgtgtgactactcatctggggttttaagaacaaattagaatcagtagttattttttccatcataaatgtaatacttgttccacaggaaaataaataacactgagaagggagaaagcagcattagctctggtctgatggatcggccgagcgctctccttggcattttggtgaatttctttcctctgtgttttgtttttcgaccctttctattttgtatagttgcttttttgaccctagtggacaagaagcagttttgggggctgggggacagcggcgtcacggaattgaggaagctcgtggcagcttccgtgtgacctgcagattggttcatgagttcattggttcatgagttctcagcagctcgaggacttagtggacagtgccctgcaggactgagcttatttcacagccttggcactgggtggatgtctgtaggactggggggacctgcgacctgagatagttttcagacgaattcccctagacattaagagaagcgggttcccattaaggagcccaggtggcatggacagggctgggggcagcacaggtgaggagctgctccaaggcaggttgtcagcctctctggacctcaacttctaatctctgaaggcctgtgaagcttaggtggtaacagctcccttcctggggcatccaacctcttcctggggttttggggggcccaggggctctgtggagcattgctgggggagatgcctacgtataagtgggcatcatgctggggtgaaagcccaggggctgggccgggagggcgagacctgagacccatgcaaaggagccggggccagggtggggtgggcacggctcctactgagtccccagcccttgggacgctggccagccagccttggcatggccagcatccctgtgtctcctggggaggcattttacttaatggacagaaggacagacagacgggtggagggagtgagagggaaaggatgggtttgcaggctggtgcagctgtgaaactgacggagcccaccccctgccaaccccccgacagcctttgaggcccagcagcccatgctccctggcaggttgcggcttgccttctgcactggcggagtccgagctgactccgtcccttcgcccgagcgggcgtcgcggggagggaggtggttcctgcttccgcatgcgcacaactggggtcttggatcgtagctcctttgtgagaaagggactggctcacccgccatgtcctgctgtccacacacacggctctgcacaccactcacggcctcctcaccgctgtgcacagccagcacgtccatgcgcacctgtggagccagggtgtacggctgcacaggtgcgcctaggtggaggtctccaggtcactggaacttaaagtgtccaagagaggaggtgtcaggcctcaaaggggcactaggaactggcgtctcacccttgcctctgagacccgcagacccacatccagcctgggctgtcgtggctgagtgccccaggccggtcgcctcccctctctgggctgggttccctgctgaaggggggcggggctccctgctccctgtagtggcctcggcgtggggccgggcctgtggttgcaccatctccattggtgtcatcctcccccagccctgctgtgacaggcatgggaggcaggtgtgtttgtgagctcactggtgcgacccttggaggtgggaggctacacagtatttttggtcatcagaggatggaggatgagcctgcattctgggctgcagggcctggagctgtgctttctcaatggacttagaatttggggaaaaaaaaaaggaaaaaaaggagggaagagagtctgccgccctggagagtgaagctgatgaatggctggctcaggcgcccacagccccagggccaaccctccactggagcatgagagcggccgcaccacgtgggctgaggagtgactggccccgggcgggctcctgccactatcacagtcgagagatgcgagggagttgtagggcagctggcactgtcctcacccgccccggccggcagggcttgtcaggccgcgtgaagtgagaaacggtttgcggtgtcctccgcggagtgccgggcccttccccggagagcagctctgcagggaagggaagtgggttttcctggaaaacggggcgggaggtgtggagctcggagagactgaggtcctgcactgctaaggggactggccccggccctgggctgggagagggggagctgggactcagcccagggtggagtcaccatgggttctaaggcacaggatggataccctcctcggccatgtgacatcattgtttgggatgcgcccagtgttcggagccttcgaggctctccaggtgcctggagggcttgtagaaatggtggtcaggccccacgccccagactttgtctcatcatgtctaggtgggggccccagcacctgcatgctgacctggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccagcatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactttggtaattctcacggtatttcaagctttttcatgattatatctgttcatggtgatctgtgatcagtggtctttgaggttactagtgtggttattttgggatgccacacatcgcacccatataagacagtgaacttaataaatgctctgtgttctgaccaatcctccaaccagccgctcccccatccctctctctcctctggtctccctattccctgagacacaacagtattaaaattaggccagttaataacactccaatggtctctaagtgttcatgtgaaagaagagtctcacatctctcactttaaatcaaaagctggaaatgataaagcgtagagaggaaggtgtgtcaaaagccgagacaggcctcatgcaccaggcagcctagttttgaatgtaaaggaaaagtaattgaagaaaattaaagtgttactccagtgaatacatgaatgataagggagtgaaacaatgttattgctgatatggagaaaattttagggtctgaagagaagatcaaactaaccacaagcctgatccagagcaaggctcaactctaatgctgtgaaggctgagagaggtgaggaagctgcagaagagctggaaacgagcagaggctggttcatcaggtttaaggaaagaagccgcttccagaacataaagtgcaaggtgagggagcaggttacccagaagatctggctaagattgttgatgaaggtggctacactaaacagattttcagtgtcgatggaacagctttctattggaaggagattccatctaggactttcatgctaggaagaagctaatggctggatttgaaggacaggctgactctcttgttaggggccagcacagctggaaatgttaacttgaagccagtgttcattgaacattccaaaaatcctagggcccataagaattgtgtaaaatccactctgtgctctagaaatggaacaacaaagacctggatggctgcacggcttacagcatggtttccagaatagttttaagcccagtgttgtgatctactgctcagaaaaagattccttttaaaatattactactcaccccggagcgcccatggagatgtacaggaagatgaatgttgtttgcgtgcctgctaacataacatccagcatgcagctgtggatcaaggactaattttgactttgaggtcttattatttaagaaatacatttagtaaggctgccatagatagtgatttctctgatggatctgggcaaagtccattgaaaaccttctggaaaggattcaccattctagatcccattaagaacattcgtgattcaaggttggaggtcaaaacatccacattaacaagaatttagaagaagttgattccagccctcatggacggctttaggggctcaagacttcagtggaggaaggactgcagatgtggtggaaatagcaagagaactggaattagaagcggagcctgccgatgggactgcattgctgcaagctcacgaccacactcgaaagactgaggagttgctgcttaggggtgaaacgagaaaatggtttcttgcgatggaatctactcctggcgaagatgctgcagacattgttgaagtgacagcaaagatttagaatgttccttcaatttagttgataaaacagcagcagagtttgaggggattgactccagtttccaatgaagctctaccgtgagtcaaatgctatcaaatagcatcacatgctacagagaaatcttttgtgaaaggaagagttcattgatgcagccaacattgttgtcgttttttttttgttttgttttgagatggagtctcgctctgttgcccaggctggagtgcagtggcacgatcttggctcactgcaagctccgcctcccaggttcacgccattctcctgcctcagcctcccaagtagctgggactacaggcgcccaccaccgtgcccagctaatttttttgtatttttagtagagatggggtttcaccgtattagctaggatggtctcgatctcctgacctcgagatccgcccacctcggcctcccaaaatgctgggattacaggcgtgagccaccgcgcccagcctgttagaagttgccgcctcagccttcggcactcaccacgctgatcacccacagccaagccaagatcctccattgaaggctcagattattgttcacattttttagcaacaaagtattttaaaattaagatttgcaattttttaagatataatgctatagcacgcttaatagactacaatatagtagaaacataacttttttctttttcgtgacagggtcttactctgccgtccaggccggagcgcagtggtgccatcacgactcactgcaaccttcacgtcccgggctcaagtgatcctcctgcttccgccttccgagtagcgtgtggggagggtgcacgcagctgggctaggatggcctggctggggtcagcccccgtctgtcctggaggccaggcaggtgcggagcttacggaggtggccacctagatgatggtgcctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagggttctccagtgagtgagggatccctgctggccatgcctggagctgagggtggagggaggcccagcaggaagccccacaggtaggccccagtgagggtgcattatctacaggaaagttgcctgggacactctagtgggccgtctaggaaatgcagcctttaaggacctgaaatggagggggatatttttagtttttaaaatttatttctcattaaaattataacacagcctcgtaaaaatattaaaacagcgagacagatgtgtcaggggttatgtatatgaaggaggtagcacagttctcatcacgggtgtgcttagtgtccccctaaagttcatgccagttaatgtgatcgtgactgtaattggaaatagggtcgttgcagatataattaagatgaggtccttctggagtcgagtgggactggtgtccttagaggagaagagacacggacacacagaatgccacgtgggacagaggcctgctgtctacacctgtgcagaggagacaacaaggagagtggggcatgacccctgcccacgacactcgcctccaggaaggcagccagctgcccatctttggtgcggtcatctctgcaggcaacagaatggcagagtggcagtctgatcactctactccattgtgtgagagtctccaggatgaagaccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttttccccctttatgtgggcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtccgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaggaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacccccgccagggcccttgggctgcatattcgaggcgcgcagcctgccaggccctccggcctccctgcgtggccaccagggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcaccaccacgcccagctaacatttttatgtcttgtagagatggggtctcactgtgttgaccaggctggtctccaactcctggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaacgagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcagtggagcctcgatagtgggtctcttgggggattattggcaagctgcaccccttgaaagttaaccgatcggggtgcatggcgtgaacttcccttcctgagctggtcagcccagtgtatgctgtgagccaggagccctgagggcgtctctgcccacctatctcagagcacactctgtgttgcaggtgccgtgacacctattttacagcccaggaaacagagtctttcatgctgttccttccagccgaaccctcagctggagtcactccagaagccgcaggcaggagagttcccacaaaggactggatgcacaccttcctgagacggggggtgggttaggattccagcaaaggaagctctaaacaccagagtggccagtccatggcatttgttgggggacttacagagggggcttcagcttcctgtgggaatggggagatgagccacgttctgccccggtatgtctgcaacgacgggatcagattacggagttcatatgagggtgaaggaactcggctcagggccgggcccagtttccaggcttgatcttgcagtgtttgggggcaacaccctgaataaatgaatcagtcagtgcctgggaacattcgaggccctggcttgggttcaagcctgcaggaaaaacgtgcagctggcgggtcaggggcagttaggacagaggacgaggaggaacgggggcccctacgtgccatgggcatgtgctcgtctctctcctggtgtccgcctttctcctctgccttgtggctcagcttggactgccataacaaaatacgatagagtgggtggcagaaatgcattttctccccgttctgaaaactggacagtccaaatgcatggtgcctgtggtgttccgacaggggatcactcctcgggctccttctcgctgtgttcacggggctttccttggtgcatggagaggatctccctctcctcctcttcttataaggtcaccagtcccatcagattagggccccacccatatggcctcatttaaccttaattacctccttaaaggccctatctccacatataggcccttgtcatagcggaggcttcacataggaacctgagggggactcagcctggagcacctggtgtgttaggaggaggccaggccagcgctgagcaccctgcctgtgggtgagccctgcttctcaagcaacagtaataaataaaaaggaggaggccaaactgaccagacctaaaaaaacagtatcttaaggtctgacacctgccacggcatgaatgagccagagaaagtgatgctgagtgaaggaagcctgtcacaaaaggacaaatgtggcatgtgaaatctctagaacagggagattcatggggacagggagtggactgggttaccaggggctggggtgggaacaacggggagtggcttcttcatgggtgtagggtttctgttgagggcgacgacagtaccctgcaagtggaccggtgaccgatgcacagcgttgaatgtactgaatgccactgaactgtgaactttaaaactgttaaagtggcaagttttatgttatattaaaaaaatcatatatagaaaggatgttgtattaaacgagaaaaactcatttctctcaagtaccagtcactcattgtggagactgctcttgaggtcactgtgcccaggcctcttctgtcttgagccagtccatctctggggtgtgaccctagcttacccccatgaccacaggaagaccatgagctggtcctttaaggatgcaacctgggagttgccccgaggactgtgctcacattctgttggccaaaactcggttacgtgaccacacctagctgcaagggaggctgggaaatgtagtccttagtctgggggcatgtgcctggctgacaatggggcttcagtgctgtgggagaggaggagctggtggctgccaggggatggacagctgtctctaccaacctggcctcacagtggtcacgctccaggacataaatgtcccctctgcagcaaagacttcctgggtgtggaggggactgggggcccacaccctggtcttcacaagatggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccgcttctccccctctctttttccctttctcttttcctccctctctgtccctccctctcttttcctctctatctccctatctgctttgctctctgtctctctgtcctatttttctccatcactctttgtccttgtctctttttctcgttctctgtcactccgtttctgcttttgttcccccttctctctctctccccaacccccctgtttctctatctcttcacctgtgaattcctgaaacagacccagggcatgatgtcgtggagggcaggccccagaggcgtccaggtgacaccgtgtgggcatttgtaaagcaggaggccccagcaggtggagcaggaggactcacccccctgcagtgggtggtcaagaagagctgcctttcctaagcccctctctcctccagccacccctcacctggggcctgctgagagggacaaggtggattggggcttgctgtggggctggtgctgaggcaggggtgggtggccccccagcccctatttcctcctctccaaacccagccatcccagttaattatttgcccagcagggcagcttgactggctggtgtcttgctgagcaataagcagctgaataagggtgcaattgctggaggcggggtcgcagctgcagacctgggcggtcacttagtctgggacagctgcagcggccacagcgaaagccatgcagcctgccccatgcctggctttgtcgcgacggctgctggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaagatcaagccactgcactccagcctgggtgacagagtaagactgtctcaaaaaaaaaaaagaaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggccctgctccgtcccttctgggcccgttgagctctgctgtgaaggggattcctttccttgtccctgtcactcctagtgtgggggtcgggggtaccaagccccagccctgccacctggaaaccctgggaaagcagcgtcacctccctgtgcctcagtttcctcatctgtaaaggggagctgaggacaggacctgcctccgagcctggggagagacggcagtgcacagggactagctgtgcgtctcagtaatacggagagaactttgcaggccaatggcgtccctctgagaaagactctccctggattctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagaccagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatccaagtggatctctcatagcctatcatggttcctccaagactcagttttctcatctgtccagtggaatgacaatggtacaggctgtgagaatcccttatctgaaatgactgggatcagaagtgtttcggatcttggctttaagttgtagaatatttgtatgcacataatgagatatcgtgaggatgggacccaagtctaaacacgaaatttataatacataagtttctggaggctccagggagaatgtgttccttgcctttcccagcttccagaggccgcctgcgttccttggctcgaggtccctcctccaccttcagagccagcggggcagcctctcctctcctctccgacctcctgcctccctcttacaaggacccttgtggttcggggtcatctgattatccacccagataatccagggtcatctctctctttcctgatccttaactcagtcatatctgcaaagtcccttttgccacataaggggacacattcacagacgggttctggggatcaaaacagggacatctttgagggctgtgtttctgctgaccacgctctcctctgggcctgccctttgcatctgcagatagcagtggactctctttagggggagcaaagcctcccgctctgagcatgggctggactttgggggtccaggactggggaggggtcgacattgtaggtcaccaccatgtgtgactgtccagggaggctgggggatgaaacagccgagggtctgactgggggagagccgagaacacaccccactttatccggaaggccagccatgtctgctcagagacgaagagtcacgggacagccctgtccaagagcaaagacccgtccaagagcagggtcagcacctcggagagttccccgcaggccgccacggggcggggagagaattcatggggcttcgacttagaaggggaacatacaatgctgtggttttcactgcctctgggtgcaactcagcatttccccaattacgaagccagggccttggcccccagcaggaagcctggggtatttcattgcctcacactcacgtcccatctgctgaggggcacgtacgccaccactactcctgagtggcagttgattttacgctcacagattcgtcctgttatttagtatgttaattcaggcggctatgcatggttgtctcacaaatttgatttttaaggaatttaacatttcaaaatacttggtttcccttgtaacccctcaccttttattttctgtacctacggtcatccctcaagagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgtgtctgattttttttttttagcaccgtcagcataagggcctgggtttattttgtggttgtttatagtggaattgggtgtattgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttgaagttaaaatgtagctcagaccctcctcagcccccacgcagggttgcaacctcttccgtctgtctccctgtgaaatccaccttccagggggcagcctgggacctgggatggccctccctacctgaaacctttcaggccttccactgcctgcagggaaaagcaccggctcctttcacggacttccagcaccccttcggggctgctgctgcctggttggtaagccctgagctcactaatctcagccgtcacatgctgttgggcaccagcctgtctctttggaccataaaaacgccatgttgggttggcaggataagtcggcaagttttgatccagggctacagatttcctggttgtattgtttcaaggttaatttctttctttttttttttgagatggagtcgcgccctgtcacccaggctggagtgcagtggcacaatctcggctcactgcaacttccgcctcccaggttcaagcaattctcctgcctcagcctcccaagtagttgggactacaggcctgtgccacgtgtccagctaatttttgtatctttagtagagacaaggcttcaccacgttggtcaggctggtctcaaactcctgacctcaagtgctccacctgccttggcctcccaaactactgggattataggcatgtgccactgtgcctggccaaggttaatttcttgatagagttggacagtcggttttgctacaaagcttgttttgaaaatgagagttggttccagcatgattgatatatcagggaacagtttcaagataacacaagtttcccgttttcctttgtgagatttcacccaccagaagcactgggtgaacacagccactgcccccagctggcctgatgcacctgtgttcacataggaacacataggatgcatacgcacctcacacagccccagccgccccagggaccccatcctcgtcagggcacaacttccccgtctccactgccccgtctctgccactctgcaccagctctccagcccacctccctcggtaaacttacagcgttttcaagcccaagtgccgtgttaatgtgtctctgaaccccttgacatgtgaagctgtgctgccgtttttattagggtttctgtctgttttgagtgccctttccctaaccccattccccaacaagccctgtggttttgactgtgcggttttgcatgcagtgatttctaggaatgcagacgtcgagttgtggtggaatcgactcttctgtgctcatgtgagggaatggccttgttttgaggaaatatgcgctgaagtactcaggggttaaaaatcatatggccagctgggcgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaaatcatatggccagtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggtcggtgctccttgaacggataaacaggaaccatccggccctcttccttgccggagctcatccctttgactccagggagggaggtcatgagcaccacagtctttatgggggagatcactggcctgcccctgggcggagaagccaaactagaaccttctccccagggtgagctcacaggcttttcccatccgggacccctgagccgattggctgcccgggacctgctgttatatcgggggctcccattgcaaagcccctgcgtgggctggcttccccgggtttggtttctccccattgtgcagggtcttggggtagggtctgagccaggtcaccctggagaaccgacagcaccggcccagccccgctgtgacctgctgaccccggaccccgcactttgcttagtgctttaggtctgtaggagtaatctttggagaatcgtgattctgggacccgagctctgagggaacaacctcctctgagcctcccaaggccccccaacattgtggggtgagccccacctcacagatgctgagacaggcctagaggcgtggcgctcccagccccatgccccacatagctctaaggcctggcctcacttgcaggtgagggtcctaggaagctgggggtgggagcaggcctaggagaggcactcaacaaccacggctcagcatggtctagaactgccccctcttcctcccggctgccccgagtctggcttccgtcagacccagcctccttccccagcccatccctctccctctttgatgaggccgatggggcaaagacctttgcttcccagaatgttctgtccctggttggaacactggtccctgggacacagccctgtcctcagctttgaagtcagttcccatcgctgccccccaggtagctggctggcttctgccaacctcagcctggtcgcagctggcacctcctcaccaggtactaaaccagggtgtgcagaggcccgctcgatccatggggcagatcagcaaatggtagtgcaggatgccccatcatatgtgaatatcaggtaaataacaggtacttctttttttctcttttttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggagcttggcagggctgggatctgaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtggtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcacgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcggctgctggatctggaggccggagccggcacatgcgtctgacagcagcgctgctgtctcttgtttttcgtggtccatgtttgggggttacatctgggcctgtcccttctctgtgtagcctgaaggcagttcccaggcttgtgtccctcacctctccgcagacgccctttccagatcctgttcaaatcctggccctactcacgggaacttgggtgagtcagttcccttcactgagccttcatgcctccctgttaaggagaagcttcactcggcatggcgtggcccgtcacactcatcctgcatctgttacaccaaatgcagtttcctcttctataaatgggagaaaatcacctgtccttgccaagggtccggtgggaattaaatgagctgagccagggcacgggtggagcttgctgagtgttaggtcgtgtgcctgctcttcttggcggagtctggccagatacctcatctggttccattgctgtcagtctctaaatggggcctttcctgcccagctcccagccctggtgctcacaccatcacaggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcagtggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagccggccggcctctctcggtgagggccggactgcacatggggctcagaggccgtgggtgtgcctgcccgcctgtgtcagctccagccgtgggggcgggggtaatccgaggctgcgtcccgaggctgtgggagctctgccttcatccttccattcacaggtagggacacaggcgtggggattccacggtgcccttgaggcagctgtttcctagacccccaaggccctgacggagactcccccacccctcaggagcagagggtgaggcggggtctgcaccggccgatgtgggcaactgttgcaccctcggagcccagcagcgagggtgggggtctgtggggagtcagccgcagccaccagcattgctggaatgtgtcagaatggtggtgcctcctgcaaacaaccttagcctctgttcatcctgtcaccagggtcctgggagaagcaaacccacgtgtggcctctgcagggtgggtggggaggttctcccggccaggcctgactgacgcccctgctgctccctgtggtccagcctggacttgccaccgattattctatcaatggcactgcactgggcaccaggatccaagcagtggactgcgggacaggacctgtccctgtgagcggcctgtccctctccccaggcccagcctcctgttggttatccttccaagcccatgcctgggctgtgcgatccacctttcctccaggcactcttcaggcaaatctctggagcacccactgggtgccacacactgcggatgggacgcagggtaccgcacagccccggtcctcagggacccggcggggacagcactggtgaaaaaccacggaagtacattgatgtgtcacttcaacaggggcctacgcaggggcctgccctgtgccaggccctgtcgttggtttgtggggtgaagaccctgttcctatggtgtggacgtggtagagatccaggggctctggcagcttgtatgggggaatggggacgggaggggggtcaggaatgggcttctcgagagaagtgacatttggtcagaggcccaagagcgggaattgatcctggccctccctgaatcagtgtggtgtgacccctcccgccaaggtgagggtagcaaggtgcctggggctggaatcctggggctgtggcccgtacagtcgcccgggacccatgcccagcagggccctgcacccggagtttaacactgaggtccccaccttgaaattcctaatcattgagtctttgtaacttgtgttagggagtccagcgagacaatggggtatgtgcggggtctttggagcttcagcccatgcacagacacgtctctctgttcctcgactcctagcatgctctcacctgcctgccccagagaccaagccccacctggccccttcgtcaccccgaggtggcgactgggttgtgctgaaggagggaggcccacacgccaccactgccctctgacccgtcaggggccccgagggcctggttggtcagggctgggcactccacccaccccggatgacagcaccaggctcatgtgccaggtgactcagccagggccactcaccagcgccacctggtatgtcctgggtggcggccgctgtgcctgctcctatccaccatggttgggcactggctgggaagagaggtgaccaccaggccctaatagcaggagtcacccacacaacccttgtacccagccctggggtccaggccgcctgcaccggctcagttctgcgcctgagctcccagctctggggtccaggccacctgcaccggctcagccctgcacccgggctcccagtgctggggtcccccaccccttggtgttgccgcatcctccctgggcccaagattcctggagctggagaacccccttcctccctgaggcatggagactgggctggtcctgagcccactccaggcacaggggacacacctgcttccttcttaactgagtagagcagagttattttgaagatcggttttcagcaggacagtaaaaaggcgaactgggagattgttcatgcagcagcttctaaaaccagtttttagataaatgcaccttcgtctgtggggggtggccgcacccagcctcgcttcaggtgcctgacggggtacgtgctgcgttcagtcccaggcaggtgtagggctgggcaggtggagatgcggtgccctcgctcaaccggggtctaggctcctcgccgggcggggttcacctgctatccccagtgtgtgggggcgggggtgtggggtgagggagaagagtggggcactgagtctaaacataggctgtggcctgtaggtgaggggaggcggcagcaaggagggggagatcaactcctgaagagactccgtttctaacacgccgggagccctgcgctttgtcatggaaactggcaagagtccctctccatccctccctactcccagaaacaagatggtcccaggctaacgggcttctctctggcctggccctgctcccagacccccgctgagggtggtaaacaccccagccgcgcccttggcaggggttccgtcccaggggcctccctgttctcactgtgagggtgggcatgatgggcagctttgcggagcctcctcagcacagagccgcacatgacgggggtggacagactgtggccccacagccgtccatcactttcatcctgtattgggggagaacggggcttgcttgaggtctgtcctggatattcgtaatgctggcattgacggggccagtgaaggctctgattggtgcgggtgacgaggacacagtcgcagcaggcgtagaccaccagagcagggtgtccacgtggctggccacgtttagttgataaaagtggcatctataaatgggtggtggtgcggaatgggtggttgattaaatggtattgggccgctcaggtggccattggggaaaggtaaagctggatccctacctcataccaaaattattctaggtggataaaaagtttaaatgtaggccaggcagtggcttgtgcctataatctcagcactttgggaggccgacatgggcacatcacctaaggtcaggagttcaagaccagcttggccaacatggtgaaatgccatctctactaaaaatacaaaaaattacctttgcgtggtagcacgtgcacgtaatcccggctacttgggaggttgaggcaggagaatcgcttaaacccaggaggcggaggttgcagtgggccgagatcgcaccgttgcactccagactgggcgacacagtgcgactctgtcattaaaaaaaaaaaaagtttaaatgtaaaacataataaaagctggtttccttactgcataaaacacttctacaaatcgacaagaaaaaaaaatcaaccgcactcttaataacagaaatgtaaattaaaactacaaggagataatgctgggtttcacttgtcttgggagagatttaaaaaaaaaaactgatctactgaattacagaagatgcgaggaaacagaccccctcgtgctttgctcgtgggggtgtaaatgtcctccctggagagaaaattgtgaatctctagcaaagttcagaccccaggaacatttaaactgcagctttaattcaacagcggcacttctggaagtatcttctgaagatggatttgtgtgtgaaatatcaaatatacaaggttgttattagactgtgaattctaataggagaacatggaagacagccttcatgtccatcagcatgggcggacttcatgtgttctggaacggtcattaaaacaagaggctgggcacggtggctcacacctgtaatcccagtactttgggaggctgaggcgagaggatcacctgaggtcaggagttcgagaccagcctgaccaacatggcgaaaccctgtctctactaaaaatataaaaatgagctgggtgtgatggcgggcacctgtaatcccagctacttgggaggctgaggcagaagaatcgcttgaacctgggaggcagaggttgcagtgagctgagattgtgccactgtactccagtctgggtgacacagcgagactctgtctcaaaaaaataaaatataaataaataatttaaaaattatttaataaataaatagaataagaaagctgtgtttgctgatatggaacaatctccaagatacagtgttaagttaaaaaaaaaaacaaaaacaggccaggcgcagtggctcacgcctgtaatcccaacactttcggaggccgaggcaggtggatcacgaggtcaggagatcgagaccatcctggctaacacggtgaaaccccgtctctactaaaaatacaaaaaattagccaggcgtggtggcgggcgcctgtagtcccagctactcgggagtgtgaggcaggagaatggcgtgaacccgggaggtggagcttgcagtgagccgagatcgcgccactgactccagcctggacgacagagcgagactccgtctcaaaaaaaaacaaaaacaaaaaaaagcaggggcagaactgtgtgtggtgggccaacacttgtgtccaggtttctagcatgtgagagtgtttgaaaactggagcctgtcctgtgacggagtcttgtgcagacatgaaaaacaagagatatcctagtgagctcccaaacagggacacccatgacagagtaaaagcagaaacaagtcacaggaaaaaatatgtagagcataaccccatttgtgcggcaaaaataaggtgtgtatgtcgatcactgcatgggagaggaagcgaaagagaaccactcagaatgaagagtcattttctgtgggaagctggacacatgtggaagggtttgaaggaggagttttactttcattctgtacattgtaaaattttttctaaagaacttgtgttttacttttgtatatttttatttatttatttattttgagatggagtcttgctctgtcgcccaggctggaatgcagtggcgcgatcttgtctcgctgcaacctctgcctcttgggttcaagccattctcctgcctcagcctcctgagtagctgggactacaggcgcctgccaccatgcccggctaatttttgtatttttagtagagatggggggtttcaccatgttggccaggctggtcttgaactcctgacctcaggtgatccaccagcctcggcctcccaaagtgctgggattacacgtgtgagccacagcgcctggccaacttttgtatattttaaaaataaaatatccagccacaatccctgagaatagctaggcagtggaaggatgatttctaccaccccatgccccaccccccagctggcagaagctttcaccccccgcccctcccccgccgtttccccgactcgctgacccctcctctgcccctgggccttttgcatcctggagctctcttccccttgccaactcctcctgcctcccaggcctcagccacgcctgcttcctttgggctgatgctgagcaccaacccagagtgtcggtgctgctcattgctccagtgaccccgtccagaccagcctccccgtccagccttcctcttgctcctgggcaggacctgccctgtgctttgaggccctggggcctgcacatatccagcatgtgggtgtgccctgtctgtgtgtaccaggtaagcgggcagatgagcccagcagacactgctgcagccggaggctgccggcagcccgcagtggcacagccgtgctgtgggagggcctttctgtgtctggggctgtgttttccacactccccctctggcttttactgttttgctccgggagtgtggctttctagagttttgtctgattttatagcagagtttctgttaactcaaaaagggactccacagtgaaggtttaaaggtggtcccagctgcagcaggaagcaggtgtggggtgcctgctgcccaggccctgttccccagcactgcttctgacccaggaggggctggggagaggaccactattcctcacctttcatacacccactcccatcctatttcgcaccccttcctccaggctgcctgcacctctgccctgctggcctttcgctctgtaattcctttctgaaagaaatgttttccatgaaacaacaacagcaagaagaaagcagatcagctgttggcaggagctgggaggagggatggggagggcagctgatggatatggggtttctgtcgcaggcgacgaaagtgctgtaaagttagatcacgatggtggtgacccgcctcagtaaatgtgctaaaaaccagtgaattatactctcaacaggagtgtaattgctgtcttcttagaacgtgtggccatggaaatgtgctctttttatgtgtttacctttgtatcagccgtcttctcaatgagaccagaatccctatcagagcaaggaccttgtttgtgtctcccttttcctctatgtcctaatatacaacagtgtgtttagcttgtagcagacactcaatttaacaacatctttttgaacgagtggatccataaatgcattaagtggctctgtgacttcagactcttcttcaggtttacggtatataaatatatcatttacggtaccttcatttatggtatataggtgatattttagccggggtgcagtggttcacacctgtaatctcagcaccttgggaggcagacgcaggtggatcacgaggtcaagagatcgagatcatcttggccaacgtggtgaaaccccgtctctcctaaaaatacaaaaattagtcaggcatggtggtgcgcgcctgtaatcccagctacatgggtgcctgaggcagcagaatcccttgaacctgggaggcggagctcgcagtgagctgagatcacaccactgtactccagcttgggtgacagagcaagactccatctcaaaaaaaaaattgttatctcagccaggcacagtggctcacacctgtaatctcagcactttgggaggctgaggcaagtggatcacatgaggtcaggagttcaagtccagcctgaccaacatggcgaaaccccgtctctactaaaaatacaaaaattaggccaggcgcggtggcgcacgcctgtaatcccagcacttggggaggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacacaaaaaaaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttctacaagggtcctccttactaaaccccctgcacaggtgaggaaactgaggcccagagattatgcagcctgcccaggtaaagcagctggtgaacgtggacagcgtggcccccgtcataccttctcgccagctgacggtgctgtccagggagtctggaaagcagagatccaaaggaattggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaagactgtggtgagcagtgattgtgccactgcactccagcctgggtgacaaagggagaccctgtctctaaaaaataagattataaaccagccaggcgtggtggctcacatctgtaatcccagcactttgggaggctgaggcggttggatcacctgagggttttgagaccagcctggccaacatgacaaaaccctgtctctactaaaagtagaaaaattagccgggcttggtggcacatacctgtagtcccagctacttgggaggctgaggaaggagaatttcttgaacctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctcgtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggactgcaggaccgtgagaaaaggagtgagtgttaagtccacctagttagtggtcattcattaccgtagcccgggacacttacgtgaacttcagacctcaaatcctccccatcttgcagccccaggcgcagacctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataaagagaggggtcacctggatctggaatgttctctggctttccaggctgctctgatcgcagacctcctgtctttaacaacccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccagagccttagtccgggtggccaccatctgggaggcccggccgtgtcctctcttaccccagttctccaggcactggccaggggccccctcagcacacatgtcatagttggtccctccctgcccatggcccttcagaggcccccagctggtcttgggaggagggtgcctgtgtgggccagctttcagcacagcccccgccctctgctccagccttgggtgcaccccaaccccacccagctgaccagcctgttggggggcctgtggaccccgcctctaagcctgggtcttcctctgggcacccgttggggacagggcagccacacacccagcccagggtgtggtctccccacccagctgcctcccttgcaaaggcagggttgccttggcaatgacacctgaggaggagacgcttgccctgggtgcgctgtttccctgtcttcagtaagggaggaggctggcttcctctggcggagggaggcagcagctctcctttgccttggaacccgctttgctccagtgatccctgagccaccacattggtaagactggctggagctgaaggtccgagtgtggcttcaggactggtgacgatggccagggatgaagggctgcggcgtgtggaggggctgcgcccggaaggaagcggtgtggacccagaaggaagcggagccctggtgggcagcctggctgtgctctggcccaggaaccgggccttttcttgcctcttgcctctgactcagagcggcttgtgggagcctcgcatgcagggccaggcagggcaagaacgatcgcgaccttttcctccagggaaggttgcaagaaaggcgggatctgtaacgtgactaggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtggtggggggcattgtggtcgaggtctgaacagccggggaagtgaaagaccccgtcctctccgggagcttacgggagtgggagagacattgacgaaatattacccatcgcaggagtcaggtgcacacagtgatgatagttccgggaggtcaggtgcgcgcggtgatgacagttccggaaggtcaggtgcacgcggtgatgacagttccgggaggtcaggtgcacgcggtgatgacagttccgggaggtcaggtgcgcgcggtgatgacagttccagaaggtcacgtgcgcgcggtcgtgacagttccagaaggtcaggtgcgcacggtgatgacagttccgggaggtcaggtgcgcgcggtcgtgacagttccgggaggtcaggtgcgcgcggtggtgacagttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccctctgcttgtggcggggggtcatgcagaaaactttgagtacagtttcaggagatgcacggaccacccaagggcctggaatcggagcccccacaagacagggggtgtgctctctgggccagcgtttggagcactctctggctcttggagccctggtggggcattcccagcagcttgcttcatttcctggacacgtgttcttggctgtggtttatattactctctgtatgtaaatgtcataggttttttttcttctagtaaaattgttcctagttagcacagtggaatcttgaaacaagaaagccatctttcatgaacagtgtgtggtttccaggcttagcccatggagttggagtgacaggtatggcagagatggggggtcaggctgcgtagaaggtgtttgcgccccctaggtgcaggtgttaatcctcaccaccagggcgatggtgctaggatgtggggcctttgggaggtgatggggctgaggactgagcctcatagtggggattagtgccctgatgaaagaggcctcagagagcaccctcgcttcttctaccatgtgagcacccagcaggaaggtgctgtccaggacccagaaagtgggtcctctgcagacaccaaatctgctggcaccttgatcttggacttccagcctccggaactgggggaaagcaatgtctgctattgatgagccgcccaagctgcggtgctttgttgcagccccaacaggctaagtcaggaaccgtgaacaggagacctcccagggagtctgctcggaggggggatttgtcgtgggggaattggtcattgtgcctcagtttccccattgttggggaagtggtgcccatggccactggcaggcccccccgggggccagcacaccaggtaggaagaaatgcaagccccaggctgctgagatgcacagagccccacattctgccttcgggacgtctgtctagtcccttgtcttacaaagggtgggcaggtcccctgcaggactcagcagagggagagacacagtcagggagcggccagaggggtgacgtgcccggctgcccacaggtacaatggctccttcgtgtcacacatgggtgtcggcgtcatctttcggctgggtgagggaactgcccagctgcccaagccctgggttcccaagtcagagttgctgggattactgggcagggaggtggtcccgcaacccacaccggggcagtggcaggaagcacagacacacacagcacagcgggccggcaccgccggggtgggttgtctgggcttggactctttctgtgcacatgctgatgtttgttgataataagaacagaaacattttctttttttttttttgagatggagtcttgctctgtcacccaggctggagtgcaatggcgtgatctccgctcactgcaacttccgcctcccaggttcaagcaattctccttcctcagcctcctgagtagctgggattacaggcacgtgccacaacacccggctaatttttgtaatttttagtagagacggagtttcaccatgttgtgcaggctggtcttgaactcctgacctcatgatctgcccgcctcagcctcccaaagtgctgggattacaggcgtgagccactgtgcccagcccctccccttttttttttccttgagacagagtcttgctctattacccaagctggagtgcagtgacgcgatctcagctcactgcaacctccacctcccagattcaagcaatcctcctgcctcagtgtcccgagtagctgggaccacagatgcgtgccatcacacccagctaattttgtatttttggcagagacaggcttttgccatgttgcccaggctggtcgtgaacgcctgagctcaagcgatcttcctgccttggcctcccaaagtgctgggattacaggcgtgagccaccatgccctgcccagaggtgttttcaagcatgtcctgtgcactgggcctggttggttgatgctcagtgatgtttattgaatgaatgaatgaatgaacgaacaagatccagaagtctgagggtaaacatggggtgccagcatcttgtcttagcccagcccgttgttggggggttggcagagtacctcaacccagacccctgtcacctgtgccccctgccccccctcacgctcctccctgtctcccccaggacctcccactctcgggcaaaggccgaggcagccctcacagcagctcagaaagcccaggaggaggcgcggatcgccaggatcactgccaaagagttctccccttccttccagcaccgggaaaacggtgagtctcgccgggcctgatactggcatcgtggggagggggtgcgtggatggctgggcagtcctggcagcagatgtgtcctccagagcgggtaggcttagatgggctcagccccagctgctcccctgcccggtgtcttcctctcccgccgaaggtgcttgtttgtgccaaggcctggcctggctccccgggacacaggacatgtgtcttggcaggtctctcccattcccacagtccttggggcaccgcgtgttgcttgccggctgtccctgacggtgaattcccacctgcccagcctgtgctgtctgctgcccgccctcccccagtgttgttctagaaccttctgggatgatggaactatctgctgggtccagcgtggcagccattagctgggtgtgtctgcggtcctggctcttgacctgcctctgatgtgaactaacttaccattaaacacacccagtggctgctgggttggacagcgtcacaaatggcagctcccgctgtgcccctcggaaagagctggaagctgctgcctgatttaggaacctcgtcctcccttcgagggggggatcatgggtgatacggcccagtgacagtggcgggggcgtggagggtgtggggtgggtggcggagaggccgtggccagctgcctcccatctcctacctcatcttggaggaagcttcctctgcaccaggaggccccagagaatggggttaggagcgcgccccctcaacccgagctctgaccggtgagcggtattcggatgaggctctgcgcgctggaggtccgcacctgacaccacagccctgaacttgctcgcaacgcctgccactctggccaccaggacaggatgaggagcccagcctgggggctgcggggctgggcgctcccctgactggaacgcgagaccacatcatctctagaggtgaccgtccgccaccactccaagaccttgccttcactgggcgagtgccgggccctgcagagcctgcagctgcagcctggaggtcaggaggacgagcccccgcacccccaccgccttgggcagcttctattccactgcgtcccctccactctcctggcccctccagacacacgcaccccaaagtgtccaagtgggagggcaatgggccacgtgcccctgtggccattggcatcctccatggtctcgccctcaggccctgagtttccttctccctggggcccctccttgcctcgcccacgaccagctgcctgggctgggaggcggtggggcgcacacttgggggcacacgtgtagcgtgcacgtgcatgtggggagtgggtgcagtgctgcgggatggacgaacggaacagggatgctggagaggaagccagtgccgtcgggggcacctgccagaaccctggctgggccactccacgcagaatgcacgtaggacggcatgggattccacgtaccaaccctggcccatggtcgcctcagctccagccctgcctgcgactcacattccactgcctgcggcctgttttgtttcctctcagagcctcagttccatgtgtgaaaggaaggggaccagacagggaacattgaagcctccatcctgtgccaaatcccccaagagacgcatccaccggaagctcccaacgtgacttatttgggaggagggtctgtgcaggtgtcattatggaacagactttgagacaagatcagcctggattggggtgagtcctagatccacgcggcgtccttagaagagacagaagaggaggagacaggggcggatggagtgatgtcagagatcactggagactccgtggctggagggtggctggagcggagaccctggaaggaagcagcactcccgacacctggatcacggcttctaacttccagaaacacgagtttgccttttgggtgtttctacccccacccccgcgtggtgctttactgctccagtcccaagaaatgggtgcaggctcccccaccctgagaattccagttaagactctggagtcggagatgcttcctggagggctcagtcctggagtcagaggagatgcttcctggagggctcagtcctggagtcagagatacttcctggagggctcagttctggattcagaggagatgcttcccagagggctcagtcctggagtcagagatgcttcctggagggctcagttctggattcagaggagatgcttcccagagggctcagtcctggagtcagagatgcttcctggagggctcaatcctggagtcagagatgtttcccggagggctcagtcctggagtcagagatgcttcctcgagggctcagtcctggagtcagagatgcttcctggagggctcagtcctggacttggagatacttcctggagggctcagtcctggattcagaggagatgcttcccagagggctcagtcctggagtcagagatgcttcctggagggctcagtcctggattcagaggagatgcttcctggagggctcaggtccctgcaggaggggccttgggctgaccttttaagtcctgaagctgcctcctccgacagttcttgtcttcatgatacagatgcgggcccctgtgggggccgctgtgatggagagacggggccgctgctgcctcactggtgggagtccagtcctcgagggtctggccaagttggcctcacctcctgctgctgcaccttggagcctggctcactctgagcacctcggtccgatctgccacctctttgggtggcgccccggagccttctctgagcagcatcttccctggagggggcgttgggaccgtgtgttttttacaagcgctgggactggcatgagatttgatccaagcatttcttgtttccgccttggatgcattcaggatcagtgttcccagaccaggcaccccggggccttctcggctgctggggaggggtggggctgggggaagctgtccaggtccttcctcagtcgtcctcacagccaggagctgaggtcaccaatgacagatgacagaacagagcctccaagaggggaacagggttgccagagcgctcaggcaggatgtggtggaatcaggatttaaaacgaggctctgaagcctgggccatgccggcttctagagaagcaaaccatccagcgcttcggctgcagagagtggctggcgccagcctcttgctgcctgtctgggaggtccctggcagcctcccagcccgagaactctgaccgtcagggttctgcccaaggccacgtgaaggcaggaccatgaaggagcctggccatgcggtgtccagtgcccaggccacttccggtgccatccgcccccgccccagaggcaggaggactgagcgtcggaggctgcaggacgcaggtggcttgaaggcacaggaaggagctgcaggggcttcacgaggacccgccctgcatcctcaccacgaggcttctaggaacgttacctgctcagcagctcattctagctgagggtgccctcctgctggtggtgctgggagtcggggcccctctagcgtggggtctcctgggccagccaggcctgatctcggcagcagtgggtggacgacctggtgggaaaggccggggcgccatcgggggatggggggggccttgatcccagcctgctaggtccatagcgtctaaggcacaggaatgccagccccttggaagtcccatcctggccaaggaggaggtacgatgtgggtgatccgtgggcatgattgggggcctctgatggggccagggctgccctccacacaggaccctcacggggagagaggtggtggggctgggcgtcaggtgggtacgtggatgtcagcacagttctacacagaccttctctggcccattccctgctctgctcgggggacacccaaccagcccagccctgtttctggggagtgaccacagagaagcagtcattgagacctcagagtggcccacccacacccccgtgtgacaggaactcagacttgggagggctggccacccacccagagctacccagctgtgccccaagccccaggccagggccatggcctcgctctgctcagcactgcctcttagaccagcaaggaggaggacacagcagcccagcctggtggcgtcgcagcgtgccccgaatctgcttgctaacgtctctttacaaacggagggactatctggtgccacaccgagggtagccatgtctcccagaccttctcctgccaaaaggtcagactggggtacaggcgtctcccagaccttctcctgccaaaaggtcagactggggtacaggccaggagaatgtccgagcgtgagagactctaagatgggcagtggctcttggtgtccgagctggtctcatgaggtggccgccccgggtagagctctgagacctccgtcctcagagggaagactccccaaattcccacagagctctgcaccattttggctcgggcaggacggggatgctgggggcgggggtcccactgttctgtgctgagcctaggacgctacttgagatgaacgtgtaactgttccccggagggtaagaagcgccgcgttcttgggtttctcctaatggaataaagtcgggcatggctcccgtgtccctgcgttggcaggaaatgagatcccagtcaatgttcttggttctcacctcctgctgggggctcacggagctccggagaagtctcggggctagtcctacaatgctgcccctccctatccaggcctccgggtgggggctgatggggactgagccaccggcagacgacagggactctgctggctgcagagctggcccctgggtcctgtggtgacctccccttccggggagccccgccctaggacttgaagccccagcagcctcgaaaggtggggagggaagtcggctcctgggctctcacgctggccccggcactggctgtttctcagcaagactgtcccagcaccctgagacacagtcccaggcgggtaggggtggttggcggccttgttgtgacagctcggcctccccagacaggtggtcagctagggtgaggggcttcctcttaccctcaggacaggcgagtcagggttggtgggacctgagtccacaccccagcgtcctcacgcactttccgagccttgggtctcccttgtagcctgggagctgctgtccgcccttcctgtggtgcctgggcctagccagtctccctccaagtgtctgtggggtggggaccacgggggtcccacagagggctttgggatccacggtccccactcccctcccttgcctgcagcctttcggtgagtgggaagcgcctctgctgccctgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacggtgagtgggcggccaccaggctggtcccagtggaggcaacatccacctctctgctgacctggtgtttcctgagggtttccagcaaggtcactgctcccctgttcctctccaggggtggagtagggtgggggtacagccgggagtggtggccctcaggtcgctgggaccctcccctaggaagccaggtggggcaggtgtcatacctctttccgtgagaggctgcccccaggttgtccagaaagcacacgaaactcttggtttccaggcagcatgggatccttgcgctccccgcaacgtgctcaaccccagctgctccaagagtctgtgcccctggtcagtagccttgggccgtgagatgaccgcttgagtgtcctgtgtcctggataggaacccagaggcgaaacagctgggggcaaggctggccctggggctgggagtcaggtctggggttggggggagctgccagtccaggtttctctcacccatggggggtgttggggttggagccggctcccacgtgaggcccgctgtgtgcaactcaccgtcagcctcacccagcacccccccccccaaattcgttcctccagggcaggcagcttggagggaagaacagcgtccccctgggctagactcggcgcgaggctgggggtcccaggctagactcggtgtgcgaggctgggggtcctggtgcctcacacagggctggcctccccttgaagggaccttcactctgcaaatcccaccctgctcccttgaccagtgctgcaggaatgaagggctttgggaatgaagggctgtgggacggtggctacataggatctgcgcacggccaggccctcaccccagcagggctctgctcgctcgtggctgccaggcagtgcgtggtgctgaacagaagtgctgcaagccagtctgcccctcgggtgtgaggacgcaggggggtgtccgcagggggcgctcagggcgtgtgggccgggcaggggggaccattggtaggtttattgtcgacgctgcggcaggggtcggtgtctgtccctgcccctgacctaggggagctgtggttttctcctcctgccagccccacccccagaggggtcaccgcgtgacacccctttgaaggggcacgtcctgccgggcggcaatgcctgtttctgcctctccttggaaccactgcggacgtctgtctgtcctgttgggttcctaagatgcctccccgttccccaaagcccacagagaacagcccctatgctcctgctgggaccaaaataccagctcacacttacaacttgattttccccatcgcagccggagatgtgtgcgtggctgtgcgcgcgcggttattttaggaacagccaagcagtgggcagggtgggaggtgtagggacgggttctatttttagcctgcttaatgcactgacacttttgggtgcttttaaatgaacctccctgggggtcaatgcacaagctggggacaagtgccaagctggcctctgggatgagttagcgacacgcagggtgctacatgctgccctggtcctgcccggtctccagctggggctaatctggaggtcccgtcagctgcagcatcatgtcccacccaccctggaggatgccagctgagctccttggaagtggccaccctggggtacctggtgctggtgcaaacaaggtttccctccctgtctccctccccgtctccctccccacagctttggagctgtgttttctgccaggtctgtgaggggagatggtgtgtagaggcgcggtcaatcctaagcactgttccaggccctgttggtgggaagcaggaggggcccgtgccagccggcatccatgtcaggggacaggtgtcagggcagtcgggtgccaggctgggctgagtgccttcagtgccaccccctcacaggggtacagctctctgcagtgtctcccctgggccaccagcagggtctggggtgctgtcttctggccatccccctccaccattcccaacatgctgcagagctcacacgccagaggccctgggtcccactggccacagatgggcctgggattctagcccacatagggtcccactggccacagatgggcctgggattctggcccgtgtagggccctggcaattcagggtaaagtcccttaggatggaagcacaggttctccctaccgctctactggtgaaggaactctggccctggctgtttccctcttggtgaaatgatggatatgacctgatggtggggtccagggttggaggatggctggggagacagaagcttccctcctgcgggcagccacgccctcgcccacagcgtccgtacctgcttcccggcccagagcacgggctggactgtggcagaagaggtgccactgaccaccccactctgtcctgctaccccactacaggctgactagcatccggcccttcctcctcgctggggtgggggaactttgcaccaggggtggcatcagtgggcagggctgggcccttggctgttctctgccccctgcaggctggcccggcccaaccaagttgtcatggggcccaagactcacaatacacctgcctgaggccacgatgccacggaaagctgggctcagggcagcttgctttctctctggctgagtggaggcccttgctgtgtccacaactccacttccatctgcgcctcaggtccctgataggctgggaggttgcggagggtgtgggcctggtgctgctgtggctgcaggtgccccctaggcagcacctcaccctctgaggaccctcctctctgagctgcatcccaaggacagtttacaaagccctttgctgactggggttcagcttatctgttgagcaaactttttctttaaaaagtttcttggccaggcacggtggctcacacctataatcccagcactttgagaggccgaggcaggtggatcacctgaggttatcagttcgagaccagcctggccaccagggtgaaatcctgtctccacttaaaaatacaaaaattagccgggcatggtggcacacgcctgtaattccagctactcaggaggctgaggcacaagaatttccagaacccgcaggaggcagaggctgctgtgaactgagatcatgccactgcactccagcctgggcaacagagcgagactccatctcaaaagtttctcaagccagtgtctctagggcctgagggctccaatccccagtgtgaggtgaggcgctcgggcctgggagctgatgcccagcatacagtcgggggtgcccctgccaggtgtggtgcagagcacggcgggggtgtgtgagacctgaggatagcgtctggatgtttctctcacgttaacgggaatgagataggctcattggctgctcatccccaaatccaaatggaaaaccgccattcgggccaggcagaggcaagtactcccacccgttgccgctgccgtgttgagcccaccgtgccgagtggtgttggcaggagcctcccgaggaagctgtgccaacgcaggagtggtcagagcctgtccaggccacagacggggctacgatgagcactgctgcccagggcatgttgggggcagctcctggagaccacagggaggggaggtgggcacccaggtgtgggcagaactggaccaggaggaggaggggcagcagcttgctcaaggcacagggcctcagccacagggtggcgggctgggaaggggcgagggtgtggtgggttctgagtgccccatgcaacggctgttttgggccacgtgctcaagcaggcacccagggaagaccagcctaggtgctggcgtgaggcccttcaacatcagctacgatgctgcttcatcaggagcacagcctggggaaagaatgaaactgacccaggagacaaaagggtccccgggccagacggtcaagcaggaggctgcttcgctgccgcgggatgtggcatccaggctaggcaaggggacggcaggctgccatccccagagggagttctccgggcaaggccgtgaccccactggggctctgagtttgcatccttcctgtgtgtcaagagcagagccggccactgccagcccatagctcccatggtgcggccctggagagctgacttcatgcgggatgtctgctgttctttgcgtagctttactgagacagaaagcgtgtactgttcacttcaggtggccacagtgtacaagtcagggattttagtgtattcccagttatacagccatcacccccaattctatctagatcagctccatcaccttaaacctcagggccattgagcaggcacttgctgtcccctcctcccccagctcccggactctgctttctgcctggtgcccagcttctcacgcagcatgcactgctcctgcgctttctctgtggcagccgcggttgcacggcccatgtcttccccgctgtgtgttcatcctccactggacagctggctctgcttccactccgtggctgttgtgaatcctgctgccgggagtgtgtgcacacacaaggttttgagtggaggcttgactttgccctcttagatttaggcctgggagtggaactgctgggtccccggtgttctcatcaattctcttccagtctctgggagaggagccagcagcagctgcttcgttgtgggtggggggaagggggaggcccgttgttcgggctcccctccttaatgcaggcctgagcagccctcacctggtgccacatgagctactcagtcttaacagaccaccccatcatgtctttgaaatttgaccagaggccagacttgggggcttaaaggagtccatggaaaaccagtctgttaacagggagggggaggagagtagccatccctgaggaatgtgcatcctgggaccttcaggacaagccctggtccatctgtgtcgcacagcagcaggatgtctgcgtggtaggaagtggagggctccgggggctctgaacagctccttaccacagtggggtctacatctccttccaggtggctgcgagatgcagggcgtggtgggggtggggagaggcaggggcaagtgtcctctggaagcagactgtgggcaagactggagtgggtgtcccagccattcctgggctggggccaccgtccaggaggcgtccattccctgtgcagcaggtactgtatctgtagggcagcacccacccctgccgtcctgggagcttcccagaggggccacgctccctctcacccctgcctggtgtgagcagaacacagcagagtgcaggactgcaagaatcactgcagaagggcgcccccggaaaaggctctgttgtgagacgtgtcctacctggccccggcaagcacagggaaggtggcagcttggtccgagtgcccaggctgtgcggctgaagggggagtctggcacttggggctccggcggaggctgaggacttgtgagccacttcagggaggtggtggcagcagcattcaggaccataacctaaatccaaggcagctcgcaattggacacagtcctccagagccagttggcgtgaggggtttgttgaggaaggtgtggtgagggggggttttgttgaggacactgtgctcacggactttgggagtcctctgagttccagggcctctctgctgggctgcatctgacactggccatggcagccatgcgggcccttctgagattctgaggtcccagttccacagggcaggagaagcctgctgactggcacaaaggccacacgcaccgagacgtttgcttgcagggaggcctgggtggttctctccaaggggaccctgggagagctggtactcagggtgtcggggccacaagggaattccaagggaattccaggaccagcaacctcagacgtacaggcagctggggcttctctcccgcgtctggacttcacggagctcaggttctggtgggcctttggtgtccaagcgtttctaacatcctcccgtacgcttccacccccgagggtctgctagcttggtgaaaagacgtgggtgggaggcgtggtggcccaggcagagccccccgcagctgtcgctcacctcttcccctcgctctcttccagggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaaattcagttttattgttttccgttacatgttcactccctgttccttctcgccgcctggtctggtgggggcataggagagggagggaggactgaaggtcatacatttctgataatgtcgctttctaaagggctgtgacatttttgtacatcttttccatcttttagtagcaagtggttgctgcagaccagaagtgaaccaaataaagactcctgctctgtgcagctctcagactcctgctctgtgcagctctcacaaagatcacagctgcttttgtacattccagtaactgcatgacacaaaacggtacctgtgagcaggaaacacattcacaccatgagacatgcacagaggcaggtgtccctgagcgaagttgtgcagagatctaggcctaggggcagtcagctcctgccgcaacacaacctagaaaaccaaggcgagaacggccccttgccttccagcagcgagggcagagggcaaagccacttccctgtgaattccaggaggattcaaccaaggctaaaatgccccgggtctgagagaatcgaatctttaattggtttccacatggggtgattaaggagaaggctgcttcccgc

SEQ ID NO: 13209 - DNA, 198942 bp, Human
  misc_feature (1)...(198942): n = A,T,C or G
atttgagctttagcataatctggtgaggtccccactgttacagatgaggaaacagggagggtatagagaggggagtcacagcaatgggatgaggaggggtaaatgagatgatgaaaatgcagtccctatcaggacagcataggggcagaggggccctccatgcacagggatgcagctgtccctgcccctcctctgcccatctcctgtacttcaggccccaaccatgcttcactgacaatttcacttcctcccacacactgcaggcatctgtgcctgcaggccttggctccttgtcctctcaccccgtatccttctctgtccgctcagaagccgcctcttccagcggggtctccaagatccagctgagattgatgtggtgcctcctccacactgtcctggggaatcctccgcctttttaggtcatgttataattaaggatttgcacatcagaatgctgctctaggcccaccactcaatgaggaaaccaggctgcatagctgaaatccagttcaagaaacagccacttctcccggggcatgcctgactgattaacacacagaaggacgattgcactgaatgactggcgtgctcaatacatccccaacctaactcctgagggtggttttcctctttggaagtcttgattccccacttgctttgagcagccacattcccaccaccgtgcatgtcagggccggacgtttccacgtgcgtttcacattccaggttcctggaatgtctgccgtactccacaccttttattttattgtgtgctttttactaaacgtactttgctaacttttcggtctctcttttgtggactgagccctaccttgcctcctggacgttctgcattcaccaagcctgtccctggctctggcccagactctgcactgctctctgcttctgggagcaaactgttctagccaaaattgaaggtgcttctctggcgtctgaggcaacatggccatgtgatgaactgattcccacaacctcctggtgtgcatgaggcccttgccttctcagtactgtccttgagccagcctggggctggaatacaggacatgtcccctcagccagtgctgaatgagcaggacagagtaacgactaagaggcaaattctttttcttccaaacccacagccctcgcctttgttctaggctacaggacagcccacactcatttacagcacgccacttggggctggctgttttctatttgagcttcagaataagtctgcaggacagtcagagtggggtcaatattccattttgcagtggtagaagttgcagctcagagaataaagtgacttgcctgaggacacacagttaaaaagtggaggagttggccagacatggtggcttacgcctctaattccagcactttgggaggctgaggtgggcagatcacctgaggtaaggaggtcaagaccagcctggccaacatggtgaaacacagtctctactaaaaatacaaaaatcagccaggcgtggtggcacacgcctatagttccagctacttgggaggctgaggcaggagaattgcttgaacccaggtgcggaggttgcagtgagcagagattgcatcagtgcactccagcccgggcaacagagcaagattcggtcaaaaaaaaaaaaaaaagtggaagagtcaggggcagagctgtatgcaggcttctgagtcaaagtcagccacctctccattctgttccaagcattagggaggtatcctaggttaatggcagtcaccctgctccaggctttgttaccagagaaaaataaaaagatgctaagaaaaaaaaaaaaaattccaccccctgggtggcaatcctggagaggacagatttccctttttggactgtttcattgctgtaataacttaggagcagagaaaaaaatgttgccccgttgcctgttcaggcatgatcaaattgccacacttcctgtcaggaactcccgccctccttccagtggactctgcctcctcactcacggaaatgccttggcagagtctggggtccctggactgagccatcagctgggtcactgagacccatggcaaggaaacaaaataggaattccaaggaactgggcctagttcccctcacagatgacaccagccacgccgggcctccagggccagggagggcactgctggagtgtgaccacctgaggagtggggtgccaggtggaaggagaagaaaggtaactacggacagcttttctgcatggctggcgggctgtggggaaggcaggcctgggtggcagccgtgtgacagtgctcagccccagcctggcagcgtgtagctgggggatctggggctttgaggcagggaggcctcagtttgagttgcacttctccatctgtgtgactttggcatgctctctccaagccccagctgactgggccaacagcgtctctggtagactgggtgtgtacatggaatgaggctatggtggcaggctgccctgccccgcacttgcatggtggtgtccctcttctcaccctccccagggcatggcacgggcagcagcaccgtcggtcagtgggcaccctctgcccgtgcagtgagtggggagcgggtggagggcacaggcgggccacacaggcagggggctccggggagcacagctgaggcaggagaagatggcccccacctgcccttcaccagcctctggcaggggcacttcacaccaggtgctcccaatctgatggggtgcagaccagggaggagtttgtgtcctctaaggtcatcggggctgggagcaaagaaggcacagagcacagaaacgatgcccagcacagcccaggggctcagaagaagtggtatctgtgccgagactcagaggataggtttaaagagaaagagtgatagagaacaggcgtttcatctgaaatgtgattctgttccatcagggatccccattcagctcaagctcctctcactgcagaaaaatattctggtactacatttcaattggcggcacccatccccaaggcttataaatgttccctcttgcccccgcatgtgatcagcagcctctacggagcacctcctctgcagcaggctcctcaacaacatatgtggccagtgctgctattaagatcccatttcacaggtgggcaagctgagccccagaaaagtcaagtcacttgctcagactcctacagctgaggggactggccctggaggtaaagctgatatcacttggctcaaagccccaaagctctatctcgtggctggtggcactagaggagacaaacgagattggcagagcaggtaagtggccatcaagagacccgcattcccttccagacgggatttgactgatatgggtccctgaaccacggatccatatgtcttcttcactgttgcacccccacagctttgtcagggcctggcgcctacaacacacacacacacacacacacacacactcacaaatatgtcaaatgatggcaaagaaggtgccttccggagcacctggcccctgtccacttggcctatattccctgaccagctgaggacagccatccctcctgccctggctcatgccagcttgtcagcctttgccagggatccaggtgtttctgccctatggccctgtactggtggtggctgtccttagatggggctgcagggcaggacaacaccaaggcaggcgccctgttctctgtgccaaaccttgcatctctacgtctgcaggtccttgtcctgaggcttggaccagcccctgtagtttgacgcctcagactggaacagtatgtgcatgtaagcgtgtgtgcacatctgtctggctgtcggcagtctcaggcccttggacaacggcactcaggtgacgggtcagcaggggacagtgcagtggtgactagaggggcactgcagccaggccacctggacttcagtccccatcctagacagcaccagccacgctccctgcccctctttcttcacctgtaatacaggacataacagcactgatctaaggactcagagacaatgcgcagaaaagtgcttagaatcacgcctggctgatagcgcttggagtctggctttgcttttttctgtctgggtcggacactcgccaacttcgctgaaaggatcgtgtggagctgcccagagcagctgctgaaaactgcgtttcaggaatcctcacgcaacccggaaggaacgcaagggcgtggccgctaaacctgagggcgcccggcctgcgcacgcggacctggactggaaccctacttgcaggtccccaacttgcgtctcttctctctgtctctaccccagccaaggacaaagacttctcctccggaaggcctcccccagctgagggaacgttccaggtcttccctcggccctggctgcgcgcccggtgccggctctgacgtggtttcctctcccctcaggactggtcctgctcgctcctcgtggcctccctcgcgggcgccttcggctcctccttcctctacggctacaacctgtcggtggtgaatgcccccaccccggtgagtgcgcgccaaggcccggcagagggcgctgcggccctgcggaaaccttcgggtgcgcaagggccctgggctccagcgccccctcctgttgcgctcgcggcgcgggacaccgcggggacagagattagcccccactcgggggagaggggaggcacagagacagacaatgatgacacggggacaggggcgggggatgacagttcttgcggctggagggcgggtgtcctgggagaacgttgggagactagatgagagggggcttcggaagtcccggggtggggtggggggcgatcctctggcccctaatgccggggaaagaaccaggaggggccttatgcatggaaacttggacattttcttgatttgttttgttgttgttgttatctatctatctatctatctatctatctatctatctatctatcatctttgagatggagtctcactctgtcaccaggctggagtgcagtggtgcgatctcggctcactgcaaccgccgcctcccacgttcaagtgattcttctgcctcagcctcccgagtaactggggctacaggcatgcaccaccacacccgactaatttttgtatttgtagaggtggtgttccgccatattggctaggctggtctggaactcccagcctcaagcgatccgcccaccttggcctcccaaagtgctgggattataggcttgagccactgtgcccggcctggtgttgttgactttaaattacaaccagaggccactcaggtatctgctggataagacccatctttggcttgtgttttactctgaaatcagatccaggtgcaattctcccaggccctcttcacattgtgcctctggtttgcagttaaaggttgggtactgcctacctaggctgtaaggtttagatgctatcctgtgggtgctggctttggctttgacctaccaccacccacaggcaagggcaggttggaggcttgagggaagctttcctgcaggaagtgatgcctgactaagtttggaaggtggagtgatggatggggggccgggatgtaggacacatctggggaaatgcggggagctccaggttcttggagcacaggccgttttggagacacggatataggacacatctggggaaatgcggggagctccaggttcttggagcacaggccgttttggggacacggatgtaggacacatctggggaaatgcggggagctccaggttcttggagcacaagctgttttgggggcagacaggaagcaggctgaggacagccctgggtgccttccaggcttttccttgcttgggagtccagcatccttgtgtacaaaacataggggaagcctgggtcagtgagtttcaaaggttcccatgagccctggaattttgcagaggtgcctcacggatctaagcactatttgcgcaggtcagttctatgtttaaaaagtctgttaattatttgacattgttcatttctgttgctaaaaactgtttgaaaaccagggggcctagatggcttcagtaagcactgccaacagtcagtgatctttgattttgtcattgtgacgtcattccaagatggggatctggcttgtcgatatttgtctttgaaagagggctaggaatttggactcttgcttcatcttgaaagttcatcaaaacatccaggtgagaggtgggggagaacctttgcactcatggcttgtggagcagagttatgtgaaacttacacctgggatagaatgatatgggttcaagcactgactatgggaacatgaggacggaggaatcccattactcacttattcattcagcaagcattgttgagagtttataatgtatccaactctggggatcagggaagacagcctggaggaggtggtatttgagctgagtcatgagggatgtgtagaatttccacaggtgtcaaagggaggtggggagctgaagcacacacacagaggcctggctgtgcccacatggtggcatattaggaagttagtagcgtgtgatgtgccagtacctagggggaatgcagagctgggatgaaagaagaggtggaaaagcaggatggagtcaaaagaagagggcctaagatcttaggctgaggagtaggattttagtcttgggcagtagggagccatggcagattcatgggggtgggggtttgcaactcacatttttttaattaaaatttatttttctttaaccatgacacaccctcaggaggtcctgagaacacgtgcctccttatttatttacttatttaatatgctcactgttttttagaaaaacaactttggtgtcagtgagaaggacaggaggggccagagcttagaggtatttaatgggaaagaccatggtaagccaaacagagagagtttaacgtgccctccctccatttcgggaaaggagatttctgaagatctacacagccagggtggcctttacctttcttaagatgagtgacacatattatggcagcatcagtaagagcacagatggaaaaagccctcatgaggtgccggccctcctccatgtacttttcatgcgttaatcagctcagtgcaccctcatgacagccctgtgaggtatggatcatcattatccccattttacagatgacaaaactgaggcacactgttcactgactttcccacagtcacataatgagtggagccagagtttggccctgggcgggcttctggtttcccaggcatcagacacattttcagtcatttttaaaacagatcctttctgtgccaggcagtgttaggccatgggacttcttgtttgggatatcggagctctacctctgtggccagtatgcgcagcaaggtgttcagtcttgagacatcacaaggcgctttttagcctggtgtcctttgaacctcgagaccacggctcgtcatgcatactttagaggagcccagagcaagcaccccgaggaggccttgagtccaggactgagccatctgcccagatccacggcctgggaagtgtcatccccagttgggtagctacttcccagcatgtgctctctgcctttgaagaggagcagagactgtgatggccagctcatcaactctgccaaaatgtactgcatgccaggcgcattccattctcagaaatacagagacgtcagtgtctttggctgtaacaaaacagcacagcctggggtcttcagcaagacatttattttcccatacttctccaacctggaaatccaaaatcaaagtgccggtggattcgttgtctggcaaggaccttccttctggcttgcagacggcctctttctcactgcctgtacatggcagagggaggaagagtgcaagggagcaagatactcatcccaccatgaggccgcccccatgacctctgctaaccccagtaacctcccaaaggcctcatctccaaataccatcacatcggggttagggcttcaacatgccctatccttgcaacaaaaatgtcatgcaacatttttggaggggacacaattcaggtcaaggtagttaattactgatgttaccttcatttcatgaacaaagaaacagaagctcagtttaagcaacttgcccaggttcacacagccaggaggtggcagtgttggaattcaaacccaggtctgtctgaatccaagatccgtgccatgctctctgcccctccttcctgcccctgaccactaatggcaggcgccaacagtccagccatggggggagtttggcatgatcaatgaaggcaaagaggaacaaggggagatgggaggagccacagcaagcccagggctacttacctgtccatctaccaaccaaaagacagagcaaggtttcactgcaacaaccctaggggctcaagcataaggtggatgatgctgccatcgtgttacaagcaggcacctgtgattgtctgaatcctgtcccaacccctccctccctcggggttctcatagagcaattctcataaaggacctgatctaactgagaaaccgaagacagctttattattagctagaatcattccccaaactcttcccctccctatggggtttggggtcatgtaacctcttcctgctctgcctaaaggtcctgatgttttatgtttacttgtgctgctttgtgagaagagaggggtagctgttcaggcaatccttcagtgcccttccctgggtgttgaccttgctgtatctggggtagaaagatgaaaacgacacacatccatgtcctcgaggtgccccaagaccagcagcagtgacagaggctcaataaataatcaccagtgaggcaggctgcatggagccacaggacagctgaaggactgtattctacctggggaggtcagtggggcctcactggggcttgaaagagagagctcaaggctttctgggaatggtggagacctaagggtagctggatgtggggtccagtggggtggagaggtagaggctggaaaggggagctgaagccagatcagaaaggttgcagaggccagaacaggagcatgatccagcaccacccaggctatgagcaggctgagggccaaggctcgccctgggaggcccttccgaggtggaaactgccctgagtgtgagctgagcaggcctgcacagaatcccagctcagaatcctgcagagaatcccaggcaccatgtaggtgcctctgtaaagggctggtgtcgagccccttgtgaggtcgctgcgaaatgaaaggagatgtgatgctggaggagctcagcccagcgtccagcgatcacctcgaattctctcttctccttgcagtgggcttagaaacgggtgagtgaggcagccccagaaccagggagaccaggaacagagcagagcctctaaggaatggaatctaacacaggctggaaggacccaagcctggcaggggtttagggtgtgagagctaggcttcacctggggtgctgggctctcgagaaggagaaagaaacccttggaacagaagaggtgcagatattagtgctgctttggagtgcggggagggtatctgctcacagagatgatgaacaaaggctgccaccagggggtggtgtgtggatgctgccccatgggaaggtgtgctgcctttagcactggcccaggcttgtaagtcctcggcccagccagcttcgcctttccagctgttagataactgggggcccaggtgatcggggcacagactccaggcagtgggcatttaccttcagggcaggcagcttgcactgttagaacaatccatgcagtagctgccgttggccctgctgccacccagcctcaaccttaaaaacgctcagtgctcctctctcctcagatatttggaaactttctgtaatgccgaaaatgaaaataactcgcctctgggcaccagctctgcacttgacccaggttcagaattgtgtgcacactggatccttgttataatattgcaaggcagctatcactaacccccttttaaaggcgaggaaactgaggctgagggaacccaatacatccaagtttcaggggtgggacacttcctaaacattcccactggcttctcctcaacacagtcacctggatgtgcctcctggccacccaactttccaagaatccccaggatctgactacttttcatgcctcatttggaagagaacacctgcacctcgtgcatccacaagggtccttggccagcttggtggatgggatgtgaacagaggtgctgataggccacatgaggcctggtttatggcagcatccctggttatggcagcactgaagaaagatcttcagtcctttcttcccccagatggcagagaactattaaacgcacactggactttgcatgaactggcaagaggttcttattgtccttagctgttgaaaatcagggttatctgtgctgtgctggtgcgttgatcaccaagatgaacaccacagtagctaggctctattcattctctacactaaaccctaactgggttcactgtttccactctggttcctacagtttagtctccacccaaaggccaaagggatccttgacaaatgaagcaagatcatattgtccctccgctcaaaacccactatatctagaaagcaagccagactgtggtgacttacacggtacctggggccgtgacacatgacacatgacagatgtgaccactctgtcatcatcatttcccccctcactccctcttctccatttacacaaacttctccccacttgctgcccctcaaacacaccgcacgctggaacctcagagcctttgtgcgtgctgctcctgctggctgcagtgctcttcccttgattttcctgtgcactctcctttgattacttcttgcctctgctcagacgtcccctcctcagaaatgtcttccctgaccagcctatccaaaatggcacccctccatcacgctttagccctcaccgaatttatttctcctcatggtatttaacactacctgagatatgacatattcctttacttcttgtcctccttcccttcactttagaaaggtccttgcttctgcagtgccagcacctagaacaatgtctgacacattgtaagcatttataaaaaatatttgctaaatgagcaaatggataaatttaaatttaaagtgagtccaaggcaagtccttaggtctcttcactctcaaacaaattgccagctgtgagtctgtcctatggaaaacttctgggaccacctccaccatgttcacagatggggacttggacactggtctgtctaattcctgaatatcccttctttctgttccactaggctgatctgctgcattctgtgaatcagcaaacgttctgtgaaggtccagcaaatgttctgtggaggtccagatagtgcgtggtttttctttgttggccatatggtctctgttgcaactactgaactctgctatgtagagataaagcagttatagatgatatgtaaatgaatgggtgagggtatgtgccaataacattttatttacgaaacagatggtggtctagggtttcccttgctggccaattgttggctaacccctgtgctagaggttttagaaaagggaggaggctcttgtagattccttgtgtcattagtacctctgggcagagggctggctggctgaataattaatccacagcctatgctgcatagcatctaaataggagcacctaaatcttcctgaagatgtttgctttctaatctcctttcttttgttcatgtattgctgattgtctaggctttgtcctttctgtttccagtgactagctccaattggcatagttgtatctttctgtctatccatctacttacttacctgtctgtctaaaacatcctgaagttattgtaaaagactgccaaatttagggctaatttgcataccaatcaaatgtagcctgaattttcagacagtcatgcatgcaaatgtgctaatctgaatccttgaaaatggcttcagatttatgccattgtaatcgttgacctttagtaggaaaatgttgcagtgcctggaacctgcttcattatactgctagaatcatctgggatgattgccagagttgtgctgaaagatgtcctcttggtacctgtgagcacccagtgtctagaatccacctgagaggttgttaagggctggatggagacccacagactggagtggggggttctgagccccaagggacattctctggggactgaaatgggcagacagggctgatacaggcctgggtgggatggtggtgcctgggcaaagcatgagtcaaagctcctcttgctcatgggtgttgtccacagagcctacaggaagattctggaagcaatgttctaaagaaatgcaaggtctgtggcagggccgacagtatggagcccagacttcagtccaaaagggcccaaccaagacaaaaaacaagccaaagggtgaggggttcaagagtagctgatccatgagaagcaactattgaggtgatggacctggatggattcctgacctgggactcacgcacttcctatgattgtaggaggatcccacattgcaatgagcccaagagaacagtcagcctaggcagaacgaccactgggggatggacattaagaaaagtcgccaagaaaaaaggaccaaagttgagataatgaatgtgttgaataggagttatgaatgaaaataaaaattagaaagcaaacagggaatgcagtggttgggggaacagaaggtgaggtgggcgggacagttcagggctaatcaaaagggtagacagtgaacttggtgcctgtttgtgcagtttctggcctgtagcttgggggaaatgcttggaggcttggcaaaagtatagcagtcaggattgtacagatcaaagtgtcacctaaaacaatactgttcatttgtttccctggcgtctatcaaagtacctcgcacacagcttcgccatgactcctgatgctaactagccatttaggccaaacttcacaggttaagagcacagccgttcacaagactggccttacttcagacaccagcgacaggctcaggggttccgtgaacatatggtaacacatttgggggttctcactaccccttctggtttgataatttgctcaaatgactcacagaactcaggaagtgctatgcttagaattacagctttattatagcaaaaaggatacgaatcagaataagccacaagaagagatcacagggcaaggtctggaaggattccagctctggtgttctctctcctcccacagagtgttgtctaccagggaagctcacccaagcttcagtgttccaaatttttattggggtttcatcatgtagatgtgattgatcaaatcattggccataaggttgaactcaatctttggtcctcctctcttccctggaggtagggctgatgtcacttggctcaaagccccaaccctctatcacatggctggtctttcttgcatggccaacccccatcctgagttatcttgttaacatacactatcaagggattctgagaggtctgccatgaataactcaagaaatcccaagaattcacaggctacatcccaagaaccagggacaaaggccagccaaactttattatacaattgtctactgtgtatataagatttacattacacaaatgcatattataaacagaaaatactcaaaaaatgtttgtaaaatgaattagtgagtgagagaaggaaggagtgagaaagaatgaatgagaacttaactttaggagtctaactcattggccccacaccatccaatataaattaggacttacttgaaacaacactggcagccacacaaataatactgaatggcttggctttgataagaaattactcacttttccagtggtttttgagttagccatgttttgtcttcttgggaggggagacacagactcttgtccttcatggtgttagtatttaagcccagggtttctgtagagcaattaagttgactcaatgcatttcccagcataaatggtatattctattattttctcctgtctgctccttccctaaaggcagataaacaaatgataataaaaagcaaaatcaacatttccctctataagggtagagctgcccagttagccacagatgttagaacctgatcaaacaagattcaagtgaaccaacagagagagaacccaaaagcaagttctggtgctttcagttaatcccaccccataatgccatcttagcaggctgctctgggaacccaggcgctcttagagaaagaagcatgtcgcctggcaggtgcctctggtgtggcctgagacccattctcaaggaaaccaggagggaatgatgagcagagactgtgtcaaacgacataagttctggttggggtgagggggaggcatagcagggctcaagactttggtggaagagggctgagattacaggaggaccctgtgcattgtgtcactgcagaaacaacgggcaattatgtctatgaaatgggtatctctgaatcccagagttttgtcccctcaccccccgctcttttcagttttactcttgcttttgtctcactttatctcagtaactataaaagcaacagacttccattaggaaaaaaaaaaaaaaaaaccaccgcacagaaatttgataatgaagctacacatacaaacattcttctgtgagtgagagatgatctctctcatttgtataccagccccacatggcagatttatgctgataaccctgtattacaaataagggagagattgagtgactggcctaaggctacctagctaatagatggtacacttgggcctgaacacagtcaaaacccagactccatccagaggccgcttttaatgtgtcatctaaatccactcttttttctgaagatcatcatatatactgtttaatactctcttttttggcttactatttatttgtaagcacctttctatgctattggaagttctgcatcaccaggatgtttaacagcagtgtggagctgcctcctgtgatgtcctatcttcctaatgtgggcctctgaggttgtttccaatttttctctaatatgagatgctgctgcattgtttaaattgggatctgtgagtcattgtttggtttggtttgatttgatcagagccagcacagctgctgactgatgagggcccagggaccttttccagcctggggcgttggtgtccaggtgtcccaggctgtgagtgccaactccccccgcaccatgccctggaggtcccagcgattagagctggacagcctgcctctttgatatagaattttctcatttcataaagtttctccaagaaaaatgcctttgttgagccaaatggggaaaggaactcggtcccatcaaatctccaggaagctcagcttagtgcagtgggggcagtggttgctgcagccagagagctggggatagctgatccagcaagatgggaggtagggaaacttggagggctgtgttggagttgcacagctggtgtgaacaaaccagacaagtgaaactagaagcaccctatttctgacccataggggaagaccctgaaatttattgagcacctgctgtatgctgacatcatgctcgggacttcacacacctcatttcatccttctggcggcctcatctacaagctaggggttcttattcccattctataaatgagttattccagaattgatgttgcagacggggcccctgctacctcaagcatccagaagtgaattgactggtaatgaaaacaatttgcccttttcattccggccaaccggaggatatgcaaaaaggagagcaaaatatcatctcaagtctgcgaaaatgcactgttccctgtaaacacagctatgcaacctctcaaaagaatgttccagcaggaggaaggctcaggactgtgattgaataagaataatattgggagtgcattcacttctctgcttctgcctggggccaaatagacaatgaaacttaccttctttatgtttcatctaattaaacccaagcatttggctgccccctcactgcaaaggtggctgaggggaaacccaggaggctctgaaagccttacttgcctggctgttgcttgtaattgatgtttcctctttcatcatgtttcatttcattctgaaagctaactgtgggaacaaaatagtctcaggtgtctggaggcacaggagcctctttcccagtgagtcagccaggctcctctgggagaatcacttggggaggaggaaaaaacaccacaaacctgcaaacctaatgctcaagtcaagccaaaatgggagctgagttttttccttaggacaagggaggtgtactggggtcacccaacaccaccttcaggtaggataattcactggcatgagtcacaggcgttggcacaggaatgcggtagtactcacagctatgactgatcacagtggtggaacacaatgctaagtcagcaaaggaaaaaggtgcaggggtgaagtccagaggaaaccaggggcaagctccaaagaactcttctagcagagcctcacgggacgcgcttcatccccacagcaacgagttgtgacaactcttgtgaaatttgtctaacaaggaaactcattagagacttggagtccagggtttttctcggggggtggtcacataggcactctctgcttggcaagcagaaaattccagattcccagaaagaaagcagatataaaccacactgagacagcataaaccacactgtttgcacagtttaggtacactgagtcactcttaccagatctgggaacggtggcaacccttccaacatccaagttcccagatgcaagcccgggacttaccctgcagcaggtttttctaggaagagaagtctcaggcgtgctgtgagagctcttttctacacaggaggccttacgtcggggagccaggcgacattaggtagcactgctgggattgtggaattttgttcttgtggggccctaacttcagagggcctggttcaacaatgggtacttttttaaggacttctggactgcattcttccctgtgccagtgtgttcagtggtgcagactgtctttataaagccctaaggcattgtggcatgacttcctctcttatgcaatggtgtgtgtactctggcccagctaccaagtgttacttccgtgtatttttacaggactcctgagaatcgttccaagtgagttcacgggaggctctgtgtgaatcagtaaggcacattaatattgttaaacaggctacgaggtaatttgcctcccattgtctggcaatttcttttattatttggagatgctctaagccagtcttggctgggaattgcagagttcaattttatgtccagaggcttggtccccaggttcctggcctgggagataatggtaagtgattcatggattcttgaatctgacaaataaatgagcctaggccccttattttacaaatatagcagtaaaaatatcaacaacactaccaccaaccaccccaatttccggtttttattgtgtacttcatatcgacccagcactgtgctgtatcttcattctctcattaaatcttcacagtaactcttcaaggagggcaatgatttaacagatgaggaacctgaggcgcagagaggttaagtaacttactcaaggtcacccagcaaagaagtggcagagctgagagtggaaaaaagccaattccaactacctttaacattgacagcacttccagagaggcacacagattgcttaagatcacccaaggccacagaaagactcagtgatgcaagcaagtgttaaatccagaactcttggctctttcttaagcttcctttgctttaaccatgtagccttttattcagttgtttgcagtttaggctatagttagtactagccgtaacatcaatgcttctggagcaactcataacaattttgatcagactcatcatctcataccaattgcaggagcttcctaacaggcctagcatcctctagtctaatccctgaaatgtccttcacactgcacctatgaagaacattcttaaccacaaattagagctatcaattccgtgctaaaaccctccaatggctccccagtgcccatggaattttgtgtagactcctgaggctggcaggcaaagccaggtacaggcagcctccaaccttctactgggccacctttcaacccactgcgtcttttatacctcctgtgtggcaacctgtggtctccggtttctgcaccttcaagaattctgttaactctgcctgtcgtcctgtaactgagcccactccgtctgcccttcttgcttgcttgacttggattccacagcctttcttggcttcctattgtcatggcatttttattccatgttataattgtatgtttacttgactactgtctccactagatcttgaactccttgaaggcaagaaacagcagaatttgtatctagaagaaaggatgggaagctgggcccctggtagtgaggaagcagacctgtaaagtcagatagaaagatacaagaatgtgcctcgtggctgttggctgaatgaaaaagtaaaacaaggaatcccaagtaagataggaatgagtgagatgtcccaaagcaggcctagaggttacctaccacagtgatcttaaagcaaatttttattgcagattgttttcttcaaacaggatcgagttctcccaacacataaaaggaaagctctaggtaaaggtttatatctccaagccttcatgacttggcctaaatctctcctccttcttgaagcctcaggtcacagtgcaattgtgatggcatgggctctgtagttacgttgattgtgtcagcagggcaaacttgctgctgtaataaacaagccctgtatctcagtggcttaacacagtgaaaattcccatttatatcacctcatttgaaggagatgagcaggaacactctgctccatgaagccattcagggacccaggttccttaagtgaagtggttccaccattctctaggactttggagtcctctgctagatcctctgtggctggccagctgacaggagcaagcgtggagcaggcaaacacattctcagcgtcttggtggaggtcacacatgtcccttgtacttacactccttgcttgagaagtagtcatatggccccacctagatgcaaggaactgggtaaggtggcctggcagtatgtccaggaagaggagagcactgtgaggtctagcaggccctgcagttctaccatctttggcatggctatgggatgtgtttctccactccagacttctctgttgtgaatgaaacttctcaggatggctacaagggttgaatgagatgagatatccaaatgtctgatacatacttagcagtcaaccaatcttcattccatgtctcctcttctcccctaaaacagaggtattgatatcatcatctttatattttctacacttagagttggaaaaaagtaatggttaagagatggactctggatccctgctcactggggctgagtcctggtgacatcgcatgccaatggtgtgagcttgggagggccccttgtggctctgtggctcagataccacatctgcccaaaacagaggtaacaaatagtacccttgtggagggtaagaagtgagtcagtatgcctccagttcttagaatagtacagagcatattgtaactatgatgtgtgggttacctgttttattattatatggttactgccacacagcagaaactcaaaacgaattcttatttaagcacccattctgtatcatgcatgaccagtcatgttttgccataggtgaggttcacaaatctcaagcttggggaatgttagtgcagtgaattctctgagcaaacttcatcactggcttcagccttgtggtaacaaggcctttcacctgggctattgctgaattcagacctggaagacaaacgttcagttgccaaaagcattggggcaaacagctttcggggaacttttgagaaaagtgttcctgcagggggcctaggctatgcagcaagtcttctggcccctccagagtctatagaggcttctgtcagccatttcccaacgtcacagtaagaaacttccacagactcccaaagcaatgcttggtagtgggtgagctgaaaaccctctcttttcccaccaggctcctgaatgcagtgcaacacaaaggaaaagacaaaatttcctcccaatcagcatccttttcatttccttacattaattccaggaagccagtcattactgaggccttccagggtgggtattagcctgactccttgcaagacagctgcaattgcttgaattactataagagtgccatagggagcaagttcacgtgcaagagtgaccttgcacatgtggaggtctcctgtttatcaggtggcaggaggggtgtctgtgaagtcctggatactcattacttatgccagcttctctgaagggtctttactctgtacatacttgcagtagttcctggggcagcctctaccccctgtcttgctgtggcccctctaatccttgcgcttagcaatcatcactgtttctcccactagactctgtgctccttgggggtggttgctgctgtattcaccacggtctgacggagtatccagcccaagcaaaggcttagttgatatagttgatatttactcttttttttgttttagatggagtctcgctcagtcccccaggctggagtgcagtggcgcaatcttggctccctgcaacctctgcctccagggttcaagatattccccagcctcagcctccagagtagctgggactagaggcgtgcaccaccacacccagctaatttttctatttttagtagagatggggtttcaccatgttggccaggctagtctcaaactcctaacctcaggtgatctgcctgccttggcctcccaaagtgttggaattacaggcatgagccactgcacccagccaatatttactcttaaatcaataaatgcaccattaggtttatctgcttaactttcacatcttaatcataagttcaagagttcagtttgtggagcagttgtatttgtgccctgaagtttggcagctccaccacaaaagcctcccagtgcatataagccgtgactgtgggcaggttatataactctcaggccccttgtttgtaaatgagggcttttaccactagggttgtcgtgagggtgaagtgagattatttatgtgctttgctagagtttctgtatttccatagttgtaaggaacaactaaagccaaaaaagttgttgaaaagagtgggttgctcacaggatcagtgggagggctggagagccaggcctggaagctctgtagctggagatactaccctaaatcactcccagagctggtcctatgggctccgctgcagccaccactgccattgactgcaccgctggcacaggacattgcagctcccctgctgctgcccccaaacccaatcccaccagagctccctctgctgctggagaatcctcctcagccccatgtcttagccccagtaacaccttgatcaaagttccagcatctgattggctgagccttggtcacatgtccacttccagctgcagaggatgctgggagagcgggtgtctggcatgtttggcttctgtagttatgtgtcctttgtttccccactcaggattctgaggcaggaaagtctcccaggcgggaagagggcttctgatgctggggagcctaaaaggcagataaatgtccaatagaggacataaacccttgacattgactaaatggtcaatgtcaggtaaatgtccagccactaagaaagaacatagtggccattctgaaggctgctggtagcaccctgatgaaggctcaggaatcagtgtcctggtagccccagtgaggggatggcagtttggaccggttgagtggtggaatggtggaagtggtgagaagccttttggaagctaggcaatatattacttttctagagctgctgtaacaaagtaccacggactgagtgactgaaagaactgaaatgtgttattccatagttctagaggtcagaagtccaagatcaaggtgttggcagagtggattccttctgagggctttgaaggaaggctcagttccagccttctctctctggctcacagatggccatcttctccccatgcctgtttacatcatcttcctcctgtgcctgtctatctccacatttcccctttttatcagggtaccagtcacgttggattagggcccactctagtgacctcattttaatgttatttgctttgtaaagattgtctccaaataaggtcacattctgaggtactaggggttaggacttcaacatatgaagtttggaggggaacaaaattcactctgtacccgtgtctgtctttgtgtcctctttctataaaggacaccagtcatattggagtagggtgggccttactccaatatgacctcttcttaattaattatatctgcaatgaccgcatttcaaataaggacccattctgaggtttggggagttaggactttagtatataaatctggaggtgtgaggttagatacaattcaaccctaacagtcagggatgagtgagggtggattagttgaggagattggatcaagggcaggagttaagaatgacttcgtggtttttggctgagcaactggagaatggtggtcccattcactcacgtagggaggaacagataaaggaaaggaattcaggggcagaggtacaggctgatgggtcccattccacactggtttagtaagggatctgtgccccaactatgtccagcaggacataaagagaagtttgttagaagcttccgggaaagttcctcttagcaccaagagacctatgagaggccaagcttactctctccagtcatgcatgaatagaaaagcatgtagccaaaactgctactaggagccatcctgcaattgtgagtgcatgctgtcttaggatgaggtcaaaattatggaaagcagagtgaagcaaccagatggcacctggattcttggccattactgagtcaccagatgggccatccttgaagctcaccactcctgtaaatttgcatttctgtaggtgtcctcattgttcagctattttgagttgaggtttcctgttacttgcagccaagagcatccttaaatgatacaatgcattatcagctccagtggatggaagatctttgagatccagggttatgttccatttatctctgtgtctagctcagggcccagtactcagcacatgtttgttgaatgagtcagtggatgacgtagatcagtatcttgtgcactgaggtctggaaacttcatcatcgatagaaatagctgtagctattgataatatattctatcctcactccgtgctatgagtaagatagttgtgaatccagaaagaaagagaaaacagaaagaagataaatacctcgcaagcagagggtgtctcccctcctcacctcatttccttccatcagaccgtttgcttatgtctgaaatctgggagttttctgtgatcttctttcactttctgcaacaccatctgttctcaaacctggagccaatcacccaggaagtcctacctattctactctcaaaatatatcttaaatccatccacttctgtccatttccattgcttagtgaagtccaccatgatctttggaccactgcagtgccccccaagtgtgcctggcttcctgtctagctcctctttcatccacttgccagagggatcctctgaaaatgcaagccacaccatgtcctccccctgccaaaaaccctccaatactttcccacttcatctagagtagaatccaagtaaaaaccaggctaacttccatgacctatcaggcccacatgacctgccctttcttgcccctccaacttcatccagcccactccttccctttctggtcctgttcctcccctattggcctccttgcaattccatggccacccaagctttcttctgtcctgctgtcttggcataattctccctctgcctggaacactttcctaccatttttcttttccatgttaaatggcagcatgtattatgcatacaaaagagtatataaaatacacacatatgcattatgcttgtgtgcccgtacacacacacacacactttaaagactgagtataaatctaacactcatgtcacaatccaggttaagaataaaaggtccggggaggctgcagcgggaggatcgcatgagcccaggagtttgagaccagccttggggaacatggcgagacctcctttgtacaagaaacaaacaaaaaaaatttatccaggcatagtggcacatacctgtagtcgtctgtctcagctactcgggaggctgaagtaccaggacctcctgaccccaggggatcaaatctgcagtgagctgtgatcatgccactgcactccagcctgaaaaaaaaaaaaaagaaggacctaccaagtgtccctccccagttatttcttctgtcatcccccgagatgacccctgacctgacatttgaaataattctttctttgtagttttaccgtctatatataattctccaaaaaattttaatttggcatacttttgggttttacacatggaatcagactgtgtatgttttgtttttggctgcttttggtcggtgttatttttgccaggttttcccatgtgtgtttggacagagctgtattcattcatgtttgtggctgtgatgtttcatatgatgatgattctgcaatttgtttattcctgctatcgaccatgggcacctgggctgtttctcgtctggagttattatgtgcaatgctgccatggacatctgagtacatatatcctagggctccccagaaacagtttttcaggggagttttctagaagtagatttgctgagttgtaggctacaggcatcttccatttgactagctgatgccaaagctgttttccaagatggctgtacaagtcaaactcctaccagcagacaacacactgcttgtcactcctcagtcttaccagatcttttaatttttagtctatgtgggattgtgtaagctccattcaagtactggccactgcttcaagctctcatttgaccctcacaacagccctgagaggtcaatgtcatcattcccattttgcagataagaaaaccaaggttcagctgatttaaatcattaccaagttgttgtgctgggatttgagcccaggtctgagcgacctgaacctaagctttttctgcagtgtcatatactggctcagctgaggtttgcgggctcacgttgggtagcaacagggaactctaagtaccttggggactgaactctgtttggagcttagtgccatggacctcagtctttggtgtacatcagaatcacctagtccctgtcccaaacacactgaatcagaattggcagcgatgagactctagtgaatgtgaagttgtatttccttgtggtctcatttctctgttgactaatgatgtcaggcattctgtcattagcataccagtcatttgtattttctctggagtctgttcaaatttttgctcatttttaattgtatcatttgcctcctttttgacatgttagagttctttgtatatcgtagacaggatttatttgtagttctatgtgttgcaaatatgttatctcagtctatgggttgtcttttcatttctgaatgacgtctttggaagagcagaagatgttaatcttgattatattcaaatgagcatttttttttcttttatggctagtttttttgtgtgtgttgcatttttgcctattttttttttgttaggtatgtgcccccccacttttcttttgagacagggtgtcactctgtcacccaggctggagtgcaatggcgcaatcttggctcactgcaacctccgtctcctgggtccaagagattctcatgcctcagcctcctgagtagctgggattacaggtgcatgccaccacacctggcaaatttttgtatttttagtagagacagggtttcaccatcttggccagactgatctcgaactcctggcctcaagtgacccacccatctcagcctcccagagtgctgggattacaggtgtgggcctctgcgcccacccggtatgtgccctttaacacacctccacagcaatgctgcggtgcactagaattggagaagcccagctatgaagctcatcataagcttggggtcagatctgagtccagctcccaggtttagcacttacctagcaagtcactttgtctccctgagcctcagtttccctatctccaaaatgaggtaaaaagaggaaacattttgttacaaaaaaagtaccttgggataggcaaagatgcaagaaacacaaaaaaactagccataaaagaaaaaaaatgctcatttgaatataataaagattaacatcttctgctcttcccaaaatttgttagaagaggccaatgagataaagctcaaacaaattagcaaagtgctatgcatgaaaatgctctgtacaagctgttttgttttgtacactggcttgcttcaagcagcaggagagaacagaaggaaataacatggtttgttgtttattttcagtacatcaaggccttttacaatgagtcatgggaaagaaggcatggacgtccaatagacccagacactctgactctgctctggtctgtgactgtgtccatattcgccatcggtggacttgtggggacgttaattgtgaagatgattggaaaggttcttgggaggtcagtaggaggctgtctctatctgggggtgccctccatgttcataatatatctgtgtcattgtcagggtcctgacaggcaacagaactccactcaggcagttcaactggagagattcaaatgcccaaaggggaaaggggaagaaatcagagaccaaggtccaaagataactgaagccatggactgcaggctgatgagcagcagcagaagcgtatagggactgggctgtgtcagagccacagcacccacatgggggggagggagcagggaagaaatgccctgacccctccctcctcccaccctccatcctgctgcagaggtgcacactggtcacacccatgtgaaagccagtaaaccaggaagtcatgttgccatccaggagatgctcccggggcatagagcagagcagggaggggaggggaattgatctgggtgttggggcaaatggaaaacacagtgcagtgccttggaaattgttccacgtaagtacatacagatctgcttttccagaaaattgactgcttagacagtcttccactatatggctgtctcatcatttatttagccacactccctgactgagagacatttgggtcatttcagatcgtttacattacaaataaggaagcagtgagaatcaaaaacttcatatcagcctttcctacccaggccctctccaatcatctcacttgaccttgtgagcctcattcctcacttattttagacaggaatccttctctcagagcagattgacttatcaatgaatccccacaaacaatgctttctctgtattcttgttcataacaacagcatcctgggagccagtgagcagtgtgtggaaagagtagagcttctccaagtgatggaggagtcgtcacatcaatctgatggggccagaacattcgtgtcttaacttgaatcatgtgtcttccacttactagctgtgtgcccttggccaaatcatttaatttatttgagcctcaattttcttatctgtaaaatagggatgatagtttctacctgcagggaatgttacaagagttagaccaaatgaatggaaggagaatggccatgagttgtagctgaataaataaaaattcttgtcattgaccacattatttggcatttccctcatcatcaccttgacatcactacctagtaagtactcgactaacctccttattgcattgacgtgagttgaagaggagatttatcagactccagaaaatctcctcagaccatgggattacagaaacccgattaagaaggagcccatttcacaatctgaaatgaccgaatcctttacattcttcctcacagcccaacaaggagaaaactagagttgacgatgtttcaaagcaagatttctaaaagatgggacaggaagccaccctgaaaacatccaagtggtgcttatgagggtctgtgatacctgtgaggtaggggaggtgctgacattttccttgtccccaagcccactttcagagcagtaattaatgggaattcagggcctggaagtacaactactgcatgatgtagtgagagatgccattgtctgaggtccttcaaggttccagccactcacacattctcttgtttaattttctatctgctgtggggtctgtagatggggaatgggaggttagagaggtgagggcatctgcacaagcttagctagcttgcactgtggctgagcttaggctggaatcatgatctttccactatgccaagcagatcttagttaggggccaattcccaatgctgggaatgtactgtaaaaccatgactgtttgacaacaggctggcactcagattggcatcactggccagggtccctgaggcatggtcactaagcctcctgcccaagccagaccctgcccatggtcctcttgcttgtcctagtgggatggagtcactccccatgccccaggatctggcctgtgatgtctccttgctttatacctgaccgtggcatttataccccaaggctgctcctcaaggaggctctgaacccatgcagatggaataggaaaaggaacactagaatcgggtcagaatgccgtggctcagcaagtcctgactctgctgtgtatcaggtgtgttacaagggactttgacacctcacttctcagccagcattattcttacctataaaatgagggcaatgaaagtagctttactaccctcactggcatggcaacaaaaaaaaaaaaaaaaaaggaaaaggaaagcaaaagagaaaacaactttgaaaataccttcaatctctaagtaatggaggagtcataaagaagtgaggatgcagaaaaagatcagatcaaaggatgtgttggttgttatgccccaagcagctgccagtttccttttcatcattatgagagtaaaagttgatttgggctgaagtttcagcttgaagagcaactctgctggggagaaaaggagcaaaaattgaaaaagaaagctaccatctattgacctcctgccttgtccttgacatcccatatatcatttacttcttaaaactccatgtttgcatcattacctgcacttttcaaatgatgagtccaagacccagtgggcaattggaccaaggtttcaaaatggagttgaactgaagttcagatctgcatgtgtttgaccacaggccaacactcttcctgtgacatgatgctatttgaaacgccttcctgatgctctgttattcctctcccatggggattctcagggagggagaggaaactgcaatggcagcctgggaggcccagtggaaggtgctcaaaggtatagctgggggagacattccagggaagtggggaagagttccgatggggctggtcactggctgctccagcagtggggctgttcctagctagggaatgttgagctcgtttgtgatttcggtgacaaaggagggcagggaagcaaagggggccaggaagagtctctggagatgggccataccacatgacctgggcctcacacagatgcaggttcctcacctcttggagtctctggctgagggaattctcagcgatcaagaattctggttgaagctcagtgacccatttagcatcctctgtcctctgcttgcatgaccatagtgacaggaccctccttccctcatgagacaggacagtgactatgtttggtgtacaaacactagctacgggcccagcttcaagtctgggctccgatacacacagctatgtgtttcttaaactctttcatctttacttagttcacgatgacatgaagataaagaatggccatgtcagagggttgttgtgaagattaaatgaaatggtggatgtgaagtgttcatccctacaattgacccagactcttcgcccagcctttgttcactagtgtcatcatcatcaacatcatcatcatcttcaccatcaccaacctcattggctttatttgagacgggtcattccatcacttgacagagtcaattgtgcatctgttctttcaattgcactgaaattattcttcttacacatatcattggatctggttcttccgtctggagcaaagcagaaaaaacatataagaaactataggaaaacacacatgggctttgaaatctgatcctgggccagactcttggacaagccacgtaaccatattcatctatccaaacaaacatttttgagcacctacaaggagtaaggtactgtttttggcactggggcttcagtgaacaagaaagacacaacatctggggcttaaggtgatgcttgggcaaaggaggcagcccctgagtaattcattatgtaagtctttatgattctgagcagtgctgtgcatggatggtagagatacaagaggcagctgctatgccctttaatttttaaatctgtaaagtgcagataaacaaacccacctgagggagcagctatgagggtggaacgagatcaaatttacagtgtctcatgtcactaaggaggctttttgaatgcctgtgacaggaacccaaagcaaactggctgaagcccaaaagggaattacttggctcacaataactaaaatataacttggttgaatccagtggctcagatgatagcttttaaaaaatccaaatctgtctccacctctcagctcaccttgctttgtgttggctccattgtcaggcaatctctcccatggaggtataagatgggcccagcttggtggaaattctccttccaatagttgtgattaaagtcccaggcatgaatctctttgacttgagcgaggttgcatgcgttcaagggttctcaaccagagggcaatgttgcctcatcaggggacatttgacaatgccaggagatgtttctggttttcataactcaagggtgctactagcatctaggagaagccagggatgcctctaaatatcctacaatgcacgggacaacccccacagcaaagaattttccagttccaaatgtgaatagtgccaaggttagaaaatcctggcaaataacattctaacactctggattaagtgcttttaaaaaagcacatcttaaatgccttgagaatgatgagtgattttatgttgactggccaggcctgtaccacacatccactcctgaagccatggttaggtggagacaggcaggaaggtttcttggtggaaatttgaggaactcctcccagaagaaggatggaggttcggtgagcacaaacaacaggcatcccatacatcactccagggaaatagcaggttgtcaaaaggactatttttgctttcatcattttctacttcaaccctttaaaaggcatctgtattttatagtagtagaaaataactgtgtctctctaggtgcctgctggaggagccttcagtgtatgtggcaagcatgcattggttagcccaggctgccatatcagaataccacagatggagtggcttcagcaaacagacattcattttctcacagttctggaggctggaaggccaagatcaaagtgtcggcaggtcttttcctcccgaggcttctctccatggcttgcagatggctgctttctcgctgtgtgctccctgtgtgtgtgcatccctggtgtcccttcctcttcttacaaggacaccaatcatcccacattagggccgcttccttgtgacctcattttagtttaattatctctttaaaggccctgtccccaaatgcagtcacattaggggttagggctttaacaggtgagccttaaaaaaatccaaatctctctctttctccacctctcagctcagcttgttttttgttggcttcattgtcaggcagtttcttctgtggaggtgcaagatggccccagcttgatggaaattctccttccaatcattgtagttaaagtcccaggcatgaatctccttggcccgagcgaggttacatgcgttcaagggttctcaaccagggggcaggaacatagtttagtccatgactgagcaacacaccgtgctgctgacaacctcttctttcaggctggaattgtctcagaaagtcaattgcccagaagcagagcctgaggcagggattgggatgcacacatggcttgtggaggaagggctcttcaggagtaatctttaaggtggggaaagcagaaagcagcaggggaaggagccaggcaaggctgcactccctggtcaagtttagcctcacttgggggagctctggggcataatcacaccacagagtcacccaacttgaagtaagggggctgcatccacccctaccactcatctgtcactcgctgcaggcagcactgggaaagggggatccaccttcagagccaatgtcaatcttctggagaagagtcaaccctgagcctttagaagccagcattcattgagctgggggaatccctgaggggatagggagataaccagccagccaggaaacctgatcctcaaccctgcttctcccagccttagaagacttgactagtcttctaagcatagtgagaatggcaagaactctggaagaaggaaacttgggttcatgatgggacataaggagaaagcctgggcatggtagataagaccagaagacttcgggacggcagggttccaaagtgtaaaacaaagagtcaacacatccaaaacaagaggcttcaatggtacaagctgtccctgcatcactggtttgttttattatggacacaacccctttggtattacagacgcatgagccgggaaagcagggttagaaatcataagaaatcttcaaccccatcccccactgcctaggacatatctaccagaactaaatattggccttctctgagctcacacaggactttcagttccctgtgttacgtcacttggcattttgggttgtactcatttcattatgttcccgtctcttccctgataagggagcccttcaacgtaagaaccatatgtatttatggcccctagcacccaacacagcagcttgtacacagcaggcaagcagtagacatttgttggataaatggaaggatgggtggaaaatgctcgatgcttgaatttttctatcacatctccccagtgtggccatccttgcttgcatctaagcatccttgtatgcttgcacactttccgttccctcatccgattatttactcaccacatatctgttgagtactttctatgtgccaagcactcaggcatgagcaaagctgccaaagtccctgtcctcctgaagcatgcagccaagcggggagcacagccaagtaacaagcatgcagactgtgccattcggcctgtgacaaggaccaatgtagaaaacagagcagctcaaggaggtcagaagatgctggggagggtgaagagctcaccactttgttcagaggattctctaaaatggtgacttgtgcagggagcactgaaggaagcaagggagtgagcacgctcatccctgggaaatagctctccaagcggaggaggcagcaggtgcaaaagcccaggggcaagaagaggctccacttctttgaagatgagagtggaggtcagtgtagagataatcataggaagctagatgggatatttggagtcagatcctgaggactttgcaggcgagggttgagactcttcctctgagcaaaatgggaagtcagtggaacgttttaagaactgatctgacttgcatttggaaaggtgtgctgttatcagggggtctcagagcctggttgggagaaccttgcaatagcgcaggtgagagaggacatggtttgcaccagggttggaaaacaagggaaggcaggtgtctgggcacagatgcaggtgcagaaatacaagcagagggcatgtgggaagggtctcttgggattgcctctgtgttctcagtgaaaaagaaagcatggtcatcagctgagaatgataaaaaggggatttgaagagagagagaaaacatatgaaatagtcctctaggagagaagggtgttggatggaccaggaatctgtagactcagtgcaggggagccttaacccttcttgaggttggtggtcatgaatttcaggtgagaaaggacaacacagccatatgtttttctccagccaagctgagctttgtagatgcccagtagacagagatttaaccagctggggttttgccaggcatatgtaatgaaagggggtggatgggcatataaatatttaaagggatgagccaaggaattcaagctgggtatgcaggaacggatgaacacgaggagggtgagggatgtggaaacaaggcatgatcttggcttataggcccagtcaggctgaagatttactggaaaggtctgtggagagatacattatttccataggttctctggtctactagggtttaatgaaaagtactttccaaattcaaactgaaatagaattccctatgtcttcccccaatccgtcctggtgctctgcaccaagttaaagcatggcatgaaggaaggtggctctcctgctttctctgacctcttgtccaggcgaaatgtctccagcccctttgacacttctgaagggacatgccctccaatctcctcatcaccctaccatgcttccttgtatttggtctttttttccccttgagagctgatgactttctgggtttcatggggaagattctacactattggagaagctaaaaacaatgaatcaggcatcctaggtggagttctggggacactggagttctgctttcagaattgatctcccttgtttatgttgctgttcatccacaggaaacaaatggaaacaatgattaaagtcctgctctgaagcccggtgagtcagctttgcaaaggatttgcacacatttccatcctcactgcaatgctgtcaggctgagggttattttgggaaggaatatattaatatgataaacttgcccagagagtgtgcactcccgtttgcacatgtttcaagtcagactttcatataattttaacattctcacaaacctttcatgcagttttaaaattagcacaaaatacaccatcatgtccaaagtaagggttcagaccaaagcttttggaggcatccttggctcctctatgcctctccacctctgtccagtccatcagcaaatcccaccaactcactcttcaaaatatgctaggatctgaccacttctcactaagtgcactgctcccagcctggtccaaatcattaccagtggttgactcacctgttgtggtagctccccagctggtctccctgctttcacacttgtcccctgcagtccaggagcaacagagaagacaagatgtagtgatcttgttcaagtattagccggtgtcattcctctccttggaatctcccagtggctgctatctcccccaggggggaaacgctagttcttatggtggcatagaagactctctgagttcttcttttctcttctcaactttcactttctactgcttgctccctggctccctactgcctccagccaggctggcctcactgatgtttctttctttctttttcttttctttttttttcaagacggagtctcgctctgtcacccaggttggagtgcggtggcatgatcttggctcactgcaatctctgcctcctgggttcaagcagttctcctgccccagtctcccgagaggctggtttagagaaaaaaacttatatttttatataatgagtataatagcatctgccataactgagtcccataatttatgacaagaggcaatgttagctggtgggaagagcgcaagttctaagatcagagacccactggggctctattgggcaaaataattttttaaccacaatttacaaaacaatttaatatctgttaactcattgagtctataggaaaaaaaataagccgtaaagggctaagatgtttccccaactccttgactcactgactatatgacctaaaacaagtttctaggccggacgcagtggctcacgcctgtaatcccagcactttgggaggctgaggcaggcagatcacctgaggtcagaagtttgagaccatcctggccaacatggtgaaaccccgtctctactaaaaatacaaaaattagctgggtgtggtggtgcatgcctgtaatcccagctacccaggaagctgagggaggagaatcacttgaacctgggaagtggaaactgcagtgagcagagattgtgccaatccactccagcctgggtgatagagcaagactctgtctcaaaaataaaaattaaaaataaaacaagtttctagcttgccagcaacctagttaacttgtttataaaatagagattataagagtacctatctctttgggtcattctgaggattaaatgagctactaatgcaaagtacttaaagcagggtctatcctatagcaagagttcaataaatgtgggcttttaggatcattttgcaaaagtgaggaaaagaaaacacagagaaatgaagttcaaagtctcctagctcctgaaggatagagctggtgcaggaatccaggtccccaggcctccaaacaagtcaggtatttgaaccatgaggtcttaggcatgtgtttataaaagtgatggcagtcctgacacagagctgttaataataattattgccatggaaatttccctaatcttgtttgagaggattagtccagccattcacttagtactgtagttcatcaaatctaagatgccattgggtctgaggagtattgttattttatgagccactggaaaggaaaggaaataaggaagaaagggagggagggagggaaggagccaacaaaagttgtagaacgctatgctggttgtcaagctgttgtctcctagctccacacttacccttctgggctctctctctctgatgctggggctggggcctgcacccccatttgtcctttgccaataggggcactagaggagagagaaaagactagctttttcatgtttgtctgagtttcctgccagtcccagtgatgacattggcagttgattccagcttccaacttttgtccatttccagaaccagaatcatattgctcctcagaggaaacagtccagtggacagtgcccactctcaaaggtcttcggggccctcctccatgcccctgaggtgtcagcaccacatgggaaacaccccttcttcagaggtcttcctttttgacatctcggttcttcaatatccacttaaccaattccctatgttaaattctctccattaaaatacctagagtggtttccattttcctgcctggaccctgactcacgaattgtaagatgaccactgacttcagaaatgttaaatgatagtcttagaattacagcaataaaatactaccacagagaattcatagatgtcaaggctgatggtgcctttgtaagtgacctagtagaccccagggctgaacccagtcacacagccagaggtggcaaggccagtgctccctgcactgtgcctgagtcttgctctactcacccttcagaagggcctggctcctgctcctgggatggacagttcagtgacatgcctcatggttagacatcttcatcaaatctttcctttctttccaggaagcacactttgctggccaataatgggtttgcaatttctgctgcattgctgatggcctgctcgctccaggcaggagcctttgaaatgctcatcgtgggacgcttcatcatgggcatagatggaggtgagagttcaccatgacggggagggaacagtaacatactccttgggggtgtcccaaaatgtgagaagtgtttggggctgtcacatgactggggctctctgctggcattgacttggcagggaccaaggatgctggaactctgcataaagtgggacagtcctgtgggatgaaccatcccattcatgatgctctagcccctaattgaggaatgctgggcagggtccgcagtctaccccaaagacctggatggtcttcagcatgtcatgccttctgtttggtcaccttcatcataatgttaatattccaaggttatttgtggttttcatggggcttttatgaggatggggtttcttctctgggcctctgactcattcgttatttcatttactcgccaggcatttgtagagcacctgcgagggctggcacactataggatggagacacaatgattaacaagaccctgtccctggagcttacattctagtgggcagacagatacataaggtagacagtagcatgtcctaggaagaaaacaaagcaggacaggagggtggtgagggctgttttagaaaggccaatcagggaagactgctcagagaaggaaacctgagcagagaccagaggagccaagggtgagaactgttcccagcagagagaagagtattatgtctcagaggcggaaggaggcatggcacgtctgggaaagagcaaggagatgtgtgggtgctgatgacgccaaagaggagctggggccagatcacataagaccttgtaggccacggcgaggactgtgtgcctgtgccgagtatgcagggagggttgagatgaatgtgacatggactggtttgttccagtaatggagtatgaggggaagccaggagtggaatcagaggagccagctgttcaggggaagggactgggctaggtggggagctgcagagaaggggacagatgctggctatgggagtgagagtaggagactcaagatatattgtcagacaaacgctgctctctttctaaataggcaaatccataaagtatcacttttaggcatttgtggaaagattgcaagccttaggattagaaatccctgagtttggatctcagttctgctgcaagttacttaatggctctgagccttggttttcccatttgtaaaatggtggtaataatacctacttcaaaaggctataataaggctgaacggaaacacacactctgtctctctctctctctctgtctctctcacacacacacatatacacatatgtactgcctggaacctagcatgagcttcttaaaggctaattcccttccttgtcgatgtcttaaaagctgagggtaccaggttgttcagctgagtgagatgaacaataaaaatgtctcagggagaggtgagcaggagagtgggggcctggaagtaaggttgagaagaggaggcttcacttacttttgttgccctgctggaggggaataatctaggcctctctaatagtccaaactcaagatgaaatgactcctcaatcatttgtctattcatttgtctatactacttgaatagactccttctattgatggctattgagagtttatccataagaataatggctggtgtctatgtaatgttttataactgaccaactgtgttcatgcttttcattttttttgatctcctcctgtaatgaaagactgttttctcatgttcattttacaaatgggggccctaatgctcagaaagctggagcaggaaagtggttaagggtgaagactatggagtcagactgcctgaatgctctcacttgcttccattaatttcattaatttatctgtataggttaggtttgatgtatttaaaaaccccgaaacttaagccatgatggcaccactgcattttagccttggctacagagcgaaaccctgtctcttaaaaaacaaaacaaaacttaatggcttcaaatagtaaccattttcctgtgctttcacttctgtgggtcggctgggcagttctgctctgggccagctctgccaatctctgctgggccttctcatgtgtctgcggtggcttcaggttggtcagtggctggatgacctgggatggtctcacgcctgtgtttgggtgttagcaggtggcctggtctcacgggctgtcagtgggccagctcatttcttggcttcccaccctgggccaggggggcctgggctgccttgcataaagttcttgggcttccaacagcagccaaaggagaaagtcccaatgtgcacaatgtgcaagcactttgcatgcacgtttgctggtgtccctttggcccaagcaagtcccatggccacgtgcagaataaatgtcagagaggactaactccccaaggatgtcgatccagggagggggtacaaatcagggaccactgcagcaaccattgacctcacagtcttggcctctttcccacctggcgtggcaacttagcagtaaggcctcccttgttgggtgatgtgaaaattaaatgggccgggcacggtggctcacacctgtaatcccagcactttgggaggccgaggcgggcggatcacctgaggtcaggagtttgagagcagcctgaccaacatggagaaaccctgtctctactgaaaatacaaaattagctgggcatggtggcatatacctgtaatcccagctactcgggaggctgaggtgggagaaccacttgaacccaggagatggaggttgcggtgagccgagatcacccattgcactcccgtctgggcaacgttagcaaaactcgatctcaaaagtaaatacataaataaataaataaaataaacgatgttctacgtattgaagtacttagtgtagttccaggcacttagtgccccactccaggaatgctgatggtattattgtcattgttgttatttgtgttcttaattaataaagtacagatctaggatttgggtttcagaggccctgcctgctttggagaaagcctggatgaggttgcagtggatcttctgggaagtcctttcctagtggaggcaactgagattctctgtttggcagttttatattttatccattatcccctttcttgttgctttgactaatctggggagttgacccttcgaacatataactaattgatctctgaatttccttaactaaaaataagctgcattccaagatggaccttttacaaaaccacagagatagaacaaatgtcttttagaccctttttcctatgagctttcaaaaagaagcaggaaagaaagaagaacaagaaggaaagaaaaaacttcggtctttccgacttgtggcacgtggcctgttggagtcacgccaggacttggagacttcatgtcatgtattctcaccaaccctctcaaagcagagagaagaactcgagggcacttaaggtgagacaattggtcagaaagaaaggaatattgctgctattacctgaactggccgatctgtttgtaataaagaatttaaagccggtccgggcgcagtggctcacgcctgtaatcctaacactttgggaggccaaggcaggcggatcatctgaggtcgggagttcgagaccagctgaccaacatggagaaacccgtctctactaaaaatacaaaaattagctgggcgtggtggcgcatgcctataatcccagctactcaggaggctgaggcaggagaatcacttgaacccgggaggtggaagttgtggtgagccgagatcaagccattgtgctccagcctgggcaacaagagtgaaaccccatcttggaaaaaaaaaaaaaagaatttaaagccaaatgataaacctgaaggattttgagatgatagaaggctctaagacttgctaatccagccaggttctcccggagtatttgaaaccataataggacaacagggcatcttcctggagtgttcttcatctagaaggtttagagaaaaaaactattatatttttataaaatgagtataatagcatctgccataacggagtcccataatttatgacaagaggcaatgttagctggtgggaaaagtgcaagttctaagatcagagacccactggggctctattgggcaaaataatttttttaaacatctctggacattacttggtgatttaggcaagttactcaacttttctgtgcctcagtttactaatctttagaagagaaatggtaatagtatatttaattcagaagactattgttaaaagtaaataacgttaatacatataaagagatgagaaggattcctgttacttggtagccactatgtgtattggctattatcattgtgaccaccatcaccaccatcaccatcaccaccaccaccacaccatcactatcaccaccatcgccaccatcactatcataaccattactactactaccaccacaatcaccatcatcattgctacaaccatcatcaccatcagcaccaccaccatcaccatcatcaccattactactaccaccacaatcaccatcatcattgctacaaccatcatcaccatcagcaccaccaccatcaccatcactatcatcaccattactactaccaccacaatcaccatcatcattgctacaaccattatcaccatcagcaccaccaccatcaccatcattaccatcaccagcaccaccaccaccaccatcactaccattatcatcaccatcaccattatcatcactattgctattcgcatcaacatttaccatcattattaccaccatcaccatcatcaccatcatgaccattattactaccaccaccactattaccattatcatcattgccacaaccattatcacagtcatcaccnnnnnnnnnnnnnnnnnnnncatcaccgtcattatcaccatcaataccatcacctccaccaacaccatcagctgtgtcctgtcctctgaaatgcacctccagtcatactttaggattaaattataaagttcatgggaaagctttggcaatttgtgctaagtgctgggaaaaatgccgtggctacagtgctatttaatgtccagggcaaagcagagccaagagaggcattgtaaccagagtgcagctcccccgggaagacacctctctaactgctgctatgctttctctctacaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggtgagtgtggctccctggtcaaccgcatctgctctcatctcatgttaccactgcaggaaggagccttttctccaaaagctggtccctgtattttgcaatttctggtattcaagcctcttacttattattggagaaaagttgtggagttcctttgagtttattttttttaaggacataaagaatacacaacaaattgaaaccttatagaatgtttaagttcacccacccagtaattatcattaatagctcaatttgtgtttgtttaggcatcttctgtgctttaaaaacctatataaacatatatagtttattgtggctttgatggaattatgccatacacattgttctacaacctggtgttttcatttaatatattttgggcatcttttcaagacgttagcttagctctacctcattctttagtctcttttttcctgaatagataagtaagtagagtcttccggttttggcttgctgttttgggagcaggtgggcctgaatttgaatcccagttcgatgatttacttgctgtatggccttagcagggagaaaagaaacatttcactcaggtcgaatggggtggggtaaactcaaggaaggctttttagaagaggtggcctctaaatggactcctgaagggtaagcaggagttaggcaggtgatgatggggattgggacagaggatataccagagaaaggaaatcagtaaagaaaaggctcaagatggggcacagccctgggaaagaactcagatggctgtggggctgaggagaaagcaggcatggggagggtgagagatgaagcgtctgttcactgagccaccacagacttcaccctgggggaataggaagccctggatggcactggagctggagggtgacatggccagatcagtgttagaaggtggctctggggtggaggcggtgggtgtagactagagtgggaagggtggggaggagagaggcagagggctgctgctattggtacacatggtaagggaaggatgcagctgcgactgaggtggtagacatggggataaagaggccactggacttgctaggattcctcccaggggatgcctcccagggatgcaggggcgctgccttcccactcacacaggcagggcaggagggtaggcagagattaaaccactaatgatggtcgaatgcccacttcatgccagactgttctaggcacgaacagtgcacaacagacaaacagctccctgtggagctgaattctagcagcagggggcaaacataacaaattcgcacgtcctagagcagttatgtaaaagactcatttgttatgctgctcaaatcctaacagctactttgtgagtagctcagatatgcagccttggacgcaagcagagagaggtaagggacagagctctcacaaacaagggcatattggtgctgaaaccagaacccgggtctgtgtgctttcaaagccacgtatgggttgtgtcttacacatccaaggatggatcacactggtgtttctgggaatgtgggctctctggagagaaggggctaattctgcccacagggtcctttctgtcccagctactgagcctcactgactctagggccagctcctttctcattcagtggaaggttttataagtggaggaatcactgtattccatttttaaagcaaattttaaatgttttgaacattttttattgtggtaaaatccacataaagtttaccattttgaccattcttaagtgtacttttctgtgatattataagtgactttttatatttcagccaatcgaggtcacctcagaggcatctgcttctgatcttttattatgaccattctgggttattacggctatgactttagtttcttcttttgcaaaaacagaaacaactcacattttacatttgtggttgtcatatgcatgacgatttctataattaattgcgagtgtgttagaaacagtctctcaacctaagtgaggttccaaactaaagagactcttttgctttttgtttctaaagatattttaaaattctcaaaataaccaccacatgttgataataaaaacaagataacagcctcagctccctaaacaaaaatacatttaaaagtcaatgaagagtgctattgtcctttaggagtaaaaaaagtaaataaatatttacctcagtagagctaaacttttctctttggggatcatttccaaattccactttgtttataaatcaatatcaagttctttctcctgcttgagtccgtaaggtctgtcttcaacctctgtcttcaccctttatttattcattcaccacatttgttaaaacattgagttgattctggagctacagctttgagcacatcaggtacagcccacgtctttcttactcagactgcaaggactttgtgaccttgggaaggtcgactcacctctctgacccagtgtcctcttcagtaacaggaatggttgcaagtcccaaattcccaagccccactcaagcttgacttcctctgggaaaacatcgctggcaaatagtgactgttcagcatatcctaggacaccgtgcacctgtgcctctcccacactgatttccgtttgcttccgcatcttgtcctgccagtcgatggcatcttacttgcatgcacactaacccagaggcgtcaagtttatccagtcattcaacaaatgtgtagaaagcttctattgtgtgctaggtattgtgccaggtattgggttggctgctggtggtagagtggtgagatcatcaggctagccctgcccttcggaggtcacaggagggcaattgaccaatggccacaggtaataggaaaataggcactgacctctggtagggcatcgggggtggttttcctgcagcagtgacatctaaactcatggcttgaggatgagtaggatttatctgggcaggtctgtaggaagagagaggcaatgggggcggggagttctagccagaggtaagagtatgggggaaggccctggcatttgttcagaggcagaaaaactcaggtgtcaggagcagggggagggggagggggagggggagagggagagggagagaccgctggcaaggcaggcagcagagagggccacacctatgctgtaaatgagcacagggaaggatgggcaaggtgagaggttcccaggacctgtggctgcttgagggacaagggcatctcctactgtttccatcacagacactggcctagagatgacagattttctgattttcaagagacattacaaatccagatttgtcatatttcataatttgtaaatattggaaactgacctttaaaaaacaaaaaacgtcccacctgtgggctgggtctagccttagggccacctttcacacaccttgatggggactgtgtaactgtgaaggcttatttgtaccccaaagcaatgggacatcattgaggacatgatgagtgcttcaagaaggcttttggcctgcagcatggagaaaggattggatcccagccaggactgaaggggttgactggtccagttatgagttgggtcagagtaatggcagtgtggatggagagaggcagatgaggttgagtgaggttagtggtgatgggatgtggtgtcccagagaggaggagtcaaaaataactctcaggcgtctggcacatcagccagatagaatggtggtaccagatgctaagacagggagctatgaaagagaaggagtagctctgcaggggaaaaggtgacaagttcactgatgtgaactgtgcatgtctcagagcaactggaaggaagagctgattcgaggacctgggtacctagattctgaggctgggacactctctcccaggaacagggctcatgaacatgatgccagccaaggggcacagctgcccatgcccaccttctggctttgagctagccaaaaggtgtaccattggttcctataggctgtctcttcccatcagatgggagtttccagacagtcttggccctggccaggaagatgggtgaggaaccctgtaaatatccttctgttttcaaatgtatgctctgggaatgtggatctagggcttctggtccaggaaagaacatcaaatgggaaatttttattcatgtctctggggatttgcagtgttccagccaagtgaaattcacagttatttcactaagtgtcagaatttcattttcactattttaatcatatttcccatttaccttcaaagactgagacaacgaagctttgaaaaaagagagagaaaaactgggcttcaatgaaggcaattgctttgaaacacagagggtgaaggagggttagcaagaaggtagctatttatttattttatgacttcaacttttattttaaattaagagggtacgtgtgcgtacttatttcctgggtatattgagagatactcaagtttggggtataatttatcccatcacacaagtactgaacatactacccaatagtttttcaacttttctcccctctatccctcccctccatctatcccactgtctccagtgtctagtgttgccatctttatgtccatgagtacccattgtttaattcccacttataagtgagaacatgcagtgtttggttttctgttcctgtgttatttcacttaggataatggcctccagctccatccatgttgctgcgaacaacatgattttgcttcttctcatggctgcatagtattctacggtgtatgtgtatcacattttctttatccagtccaccattgatggacacttaagttaatttcatgtctttgctattgtgaatagtggtgccatgaacatatgagtgcatcactctttttggtagaataatttattttctttggatatatacccaataatgggattgctgggtcaaatggtagttctaagttctttgagaaatttccatactgctttccatagtggctgaactaatttacattcccaccaacagtgcataagtgttcccttttctctgcagcctcattagcatctgttgttttctgactttttaatcacagcccttctgactggtgtgagatggtatctcattgtggtttggattggcgtctctctgatgattagtgatgttgagcattttttaatatgtttgttggccacttgtatgtcttcttttgagaagtgtctgttcatgtccttttcccattttttaatggggttatttgttttttgcttgttcaattgtttaagttccttatagattatggattttagccctttgtcagatgatagtttacaattattttgtcccattccataggttgtctgtttactccattgatagttgcttgaattgaagagctctacagaagctcttcagtttaattagattccacttgtcaatttttgtttttgttacaatttcttttgcaattttctttcccaaggccaatgtccagaatgatatttcctaggttttctcgtaggattcttatagtttgaggtctttcatttaaatctttaatccatcttgagttaatttttgtatatggtaaaatgtaggggtccagttacattcttctgcatatggcaaaccaactatcccagcaccatttattgaataggaagtcctttccccattgcttatttctgtcaactttgtcaaagatcagatggctgtaggtgtacagctttacttctgtgttctccattctgtttcatttgtctatgtgtctgtttttgtaccagtaccatactgttttggttactgtaggtttacagtatggcttgaggtcaggtaatatgatgcctctggcttttgttctttttgcttaggatggcttgggctatttgggctcttttttggttttatatgaattttagaatttttttttctagtttggtggaaaatgacattggtagcttgatagaaatagtgttgaatctgtagattgctttgggcagtattgctattttaatgatattgattgttctaatccatgaacatagaatgtttttccatttgtgtcatctgtgatttctttcagtaatgttttgtagttttctttatttaaatctttcacctccttggttaattatttcctagtttttttttttggcagctattataaatgggattgcattcttgctttggctctcagcttgaacattattggtgtatagaaatactactgatttttgtacactgattttgtatcctgaaactttcctgaaatcccctgtcagttccaggagacttttggtggagtcttttctagatcatcagtgaagagagatagtttgacttcttttcctatttgaataccttttatttctttctcttgcctgattgctctggctagaactttattgctatgctgaataggagtggtgagagtgggcaccttgtcttgtttcagttctcaagaggaatgctttcagcttttgcctgttcagtatgatgttggctgtgggtttgtcatagttggctctcattattttgaggtatgattgtttaatgcttagtttcttgagaggttttatcattaaggcttgttggattttatcaaaacatttttctgcatctattgtggtgaatcacctatattgatttgcatatgttaaactaaccttgcatcccaggaaggaagcctacttgatcatggtgaattgacttttgatatactactggattcggtttgctggtaatttgtaaaggattttttcatctatgttcatcagggatattggtttctagttttctgtttttttttttttaatactttaagttttagggtacgtgtgcacaacgtgcaggttagttacatatgtatacatgtgccatattggtgtgttgcacccattaacttgtcatttaacattaagtatacctcctaatgctatccctcccccctccccccaccccacaacaggccccagtgtgtgatgttccccttcctgtgtccatgtgttctcattgttcaattcccacctatgagtgagaacatgcggtgtttggttttttgtccttgcgatagtttgctgagaatgatggcttccagcttcatccatgtccctacaaaggacatgaactcttcatttttcatggctgcatagtattccatggtgtatatgtgccacattttctttttattgtatctttgccaggttttggtattggtgttatgctgatttcaaagaacaaattagagaggagtccctcctcaattttttggaatagtttcagcaggattggtaccagctcttctttgtacatctaatagaatttggctgtgaatccatcttttcagggcttttattggttggtaggttttttattactccttcaatttcagatcttgatattgttctgttcagggtttcagtttcttcctaattgaatcttgggaaattgtgagtttccaggaacttattcatttcctctagattttctagtttgtgtgcctagaagtgttcataatagtctctgaagatattttatatttctgtggaatcagttataatgtcaccttcatcatttctgattgtgcttatttggatcgtctctctttcttttttaatctagctagtggtctattaatctcatttatcctttcaaataatgaacttttggtttcattgattctttgtatggattttggatctcaattttgttctgttctgttctgattttatagctgtttcttttcttttgctaactttggagttggtttgatcttgtttttctacttcctctaggagtggtgataagattattaatatgagatctttctaactttttgaggtaggcatttagcactctaaacattcttcttaccactgcttttgctgcatctcagagattttggtatgttatgtctctgttttcacttatttcaaataatttgtgatctctgccttaatttcattgtttacccaaaagtcattcaggagcaggtcatttaatttccatgtaattgtgtggttttgagagatcttcttggtgttgatttctaattttagtccactgtggtctgagagtatggttggtatgagtttaattcttttgaatctattgagacttgctttatggctgagcctgtggtagacgaaggtggcttttagagtaggctgctagaaggcaagaaagggaaataaatgtaggaattaatgctggttccatgaatttaatcaaagatacatcataaaacaattgtcatggctgaacatttatgtgactccaaatgatatatttttttttaaaacaaatcaattagctatttctcttgcaaagataaagaagaaatagacttagatgaaaattataggcaaaagtatgagaagagagattaggaatgatgtgaggccgtaaaggaacgattttatatgctcagaagaacatttatgtcagataagaatgattaactttgagctcccacttttctttcctctcaaggaaagaaatatactaatggttgcaaattttttcaatctaaataacaaacagggagactttctgaaagaaaacaatgtttattcaggaatgggcattgcaattggcataggtgtgccatagtaaaccatgtgcatattcagggaggtaaaagaagacaaaggattttaaagaaaaaatgagacgaattatgtaattgtttttgagatagttatctttgaatagaaggatcagtaacaagggtggcatcagtccaaggttggacaggcagttgctaggcaggtgttctcgcagcagtattttctcgtgtaaggttgtagtggcctttgtgcaaggtttttgcagtcttttgcaatagtttttgccagcaggcatctgtatatgagaatcttcctttcatgaccttccttagctttatttttcaggggtttgcttttatttttgctttttaacacaggtgactttatttttattctgacaactttcacatttccttttttgatcaagattttttaaaaaaatcactggttaaccattttgtagttaggttttgattatccctaggtgaggcagctgggatcaacctgtctcacgttgttggttggtcctacattggaaggtgtaattggagttagtgtctaaactcttttagctacatttgagcaacaagaggggtttggagagagtggttctcaggctacatctacctaaaatcaagtgttaagtttaagtttttgtctattctgtaggcatttactattatctaaaagtgttgggccagtattattctgtgaagatttgttctgtagaaatttaacaagtaataggtacaaggtttaaaagaaaaatacaaagtaaaattaatagtaatatgacaatctcagcttgtatattagttgtgatccatgaacttaggtttaaaagcaaccagttaaataaattaaataaattaaattaattaaatgatcatgacaaattaggtgaaacttgttgttgtagcaggatgagccacagacaaaacctctcacacactgaattgtagaaggaagggctttattcagctgggagcatcggcaagctactgtcttaaaatccgagctccctgagtgcacaatttctgtcctttttaggggctcacaacactaaagattttacatgaaagggtcgtgattgatttgaccaagcaggcggtacatgacgggggctgcatgtaccggtggtcagagtgaaacagaacagaatgggaggtttcacaatgtccttctatataatgtctggaatctatagataacatcagttgctaggtcaggggtggaattttaactactaggtttaggccaggcaggcccaggcctggttttgggtccggttttgggtctggcgcctggcgctgggctgcctgcctttggtttcacttccttgtttttttcttaaaacaggtactgagtataaaacaatatgagaggtctctttcttccctcattgtaacctgcatttttttttttaattttgtgtctttgagtcttaactcttctaggggaatttatccaagtatagcatgtagtattagcaacagcacaaactctttttgtttgtttaacccagctagctgggttccaggaaccttgcactgagaactcaaaactgccacaggctataagctttccccacccagacagaaactgtggttttcaggctgtgcccctcctggtccaccccaaagcagggatgcccagcttctgtacttgtgactacagtacccccacttgccccttagttctggccaagggagctcatccccactcaagattatgtcgtgaatcacagttgagaccttctctcaacctgtgactgccacccgagttggctggctgacttctgcaaggctccctgtgaagtagagtcaggaatgtcttctctccatccccactggagtctaggagtgcacgcaaagcatgtccgatgctgctccttctcaacattccccaccactcagctccagtgctgggtggggccaaggccatcccccatggcctatattatcaggttccctagcgggagtgtgtgtcacagaggcagtctctcccactgccacactctgaggactcacagttttccacctggcttatggtgtaggctgctgccaccacttctttcaaagagtctgtggtttctttcagttttctggttaaatgcctgtggtgtttcttggaaaaaaaattatagcgtgagtctctacacactattttgtctttccaagtatgagaggtgatatggtttggcttcatctccacccagatctcatcttgaattgtagctcccataattcccatgtgttgtgggaagaacccagtggcaaataattgaatcatgggggtggatttttcccatactgttctcatgatagtgaataagtcttatgagatctgatggttttacaaaggagagttcccctgcacatgctgtctcttgcctgccgccatgtaagacatgccttcatcttctgccatgattgtgaagcctccccagccatggggaactgtgagtctattaaacctctttttctttataaattacccagtctcaggtatgtctttatcagcagcatcaaaagggactaatacaagaggcatgctaacaatgcctctaatctgccatcttgggggaaaaaaaccacattgatcttaaagttttttgaaacttgtatttaagagtatttgtcaaagtctttgtaatgaatctaattgcagataactttagagaaaaatttaaaataactgtaaatgacaaaaatttaaaactaccatagttgaaaataggataaaagttccccataaccagaaatttgcaaggaaatttagttattttgtggcctacaatataataaccaaaattatgactgataacatagaagattttaagagttttattaccattttagaacatatataccaataacatatccataaatgtaactgaaagaagatctagtatcacttagcatttgatatttcccatataatttaccaaataagcctaattatttaatatctctacaagatgagagagaagtcctttgaggctttctaggggcctgactggaaaatctcaaagttaagtttatgtcaaaaagatttaatttagcattttgatgctggggaagtccatcaaagatgccaaaagttttaaaatacctgatcaaaacagtatcacagggcactgtgtgatagtcatttatttaattagagtgataattatagatcttaaaagcaatacagaaagttatatagatattaaaaaaactttaacccttaaagtctccattttttaaaagtaataaaaaaatttagtaaaggcaacacaggaaattatcttgataaaatataaaatatttgtttcttaggccagttactaaaaaggcaatgaaaaacctccttctatgtgattggttcacctcatgggaagcctgtttagacaacctgatgaaaaagtacttgtatgtattcagaatgtatatccaaggctatgactgtacactgtggaacataaacaagaaaagtattactttaagcagggggatatatggctcttagtaaaagcatgagaaattccctggttacatggaacaatgtagacacatgaagaaaagctaagtacagaatcaagttatactggaaaaaaagaaacattgcttttctaggtctttgagacaaacatttttagtgtcaggcctcaatagctgttagaatgagaggaagaagttataggagctaacaaagaagttgaaggagaaagtcaacattccagccaagcaaaaagatgtaccttctcaaggaaagaaagtgaaagaacagaaggcaatgtagtatgaactgcacatgctatgctgtgagacacattaaaattgaacttctgagataggactctgagaagcttcaagacgaaaactccaccttgagaaatgaagataccatttttaagaagaagatagcattttaaactaaaaactagttaaattaaatggagactataaaacaaacaaaaaaataagctacagtttagaaagtggctgaaaatttttacaattaaaaatcagaacttcttgtaaattttactaaaagcagatcattacttcaagaaaactttgttgctttaacataagggaccaaatttttagttttgtattggtgtatttttaatatcaaaactcaaaccttagaaaggcttataaataattcccttttaaatatagtcaacttgatcacatacaaaatttcttttgtaaatttatcattttcagaccttttacaacttacacagactttcgtaactttcatggcatgcttataacttttgttttgttctatactttcttatttttaaataaccagtcactttattttaggaaaaaacatttaccaggcaagattttttaatgtaaagttattttcttttcttaaatctttcttaccagaaatatatctttattcccataactttctttatatctctttctatttactggattctttttgtttatattttctttctaaatccatattttgacacaacttttaataaccttttaatttaaaaaaattatttttaaatgaagtacatattttgtcttataattttttaattaaaaacagttcttacttttttggtacattttacataaagaattatatgcagaaatcagaatgctcaactcttattaatcttaatttttagtgaaaatctagaaagaaattttaaactatcacatacaaatattttatagatgaaatccttttttagttttataaacatgtttcaacataacataattttagtgtgtattaagaggcccaatgatatttagtcttttataaaatttaagaagcacataatttggttcattccatttataactttttgtattctgattattttgcaacctgatgttgtgaacaagtcattaaaattatttgctgtgatagttttactaattttataatgataataatgaattttaaaaaacaatctcaattgtattcaaactaatgtattcattcaatacaatttcaatcaaaagttcaatgacatttctgtttgtgatggaaaatgaggaaagagttctaaaattcccacaagagaataagcaagtgtatgtttctgacatagttttgaaaatggacgctagtgagtacattaaacatgtaataaagtgacaacaattaaaacaatgcagcatgggcacaagaatggaaagatcaaaggcactaagggatggccagaagcagaaaattcatttctatgtatgattttaatgtgtgcaaaaggaaacctcaaaaatcaacagaggaaatgttgtttggtttaatgaatagcttaggaaaaaatgggaaaagggtaggaaaaaagactaaagcaatgcttacattacaccatgttttaataattgtactagtttctatttatgagttataatttgtttcatttttcttttatttcctggacatttggattgtttccagtgtttgtttgtttatttagcgacacagtcttactccatcgccaaggctggagtgcagtggctcgaccttggctctcaacccccgcctcccaggttctagcaattctcctgcctcagccgctcgagtagctgggactacaggcatccaccaccacacctggctaatttttgtatttttggtagagatggagtttcaccatgttggccaggctggtctcgaactcctgacctcaggtgatccacccaccttggcccatcagagtgctgggattacagatgtgagccacttcacccagcctccagtgtgtttattactgaaaaagtgtgatttgtaaacttcagatgaataatcttctacattaatcattattcaaatctgtaattattcatgtagtttagtgtttcagaaatagaaataacaggttaaagagtgtaaatttttttaaggctttcgtacatatgagcaattttttttcggatagtctgcttcaatttccattcccgctggcagggcacaagggcattagtctcactctgcccatgtcatccacaagcatttaaatgaggctttggtatttgataggcaaaaataatagatgagaatttcttataagtatatttgtttcctgttgatgctgtaacaagtaaccacagcagagacagaaatgtaatttctcacatttcgttagttgataatcaaagtattaaaagacctcactagtaaaaccatctcaccctgtagtcttttggggaaaaaaatgctttgaatatcttttaactactttcgtaaaaatctatttttattttcttttgagttgatgtcattaatttctgtcttttcaataaagtcacttatgtcatcgaaactttcaaatttgttagcatacaactatataaatttacaccatttaaaaaataactgaaatgattttaagaatcaaatgtaaaaacagataccataaacaacacacaaatgaatacagattaattatttagaacaatgttttcaattgggattttgggattttgtagatgggattttgttatcctcattcattaccagttttgttttattacataaagaaaggtcatccataagtttcttctttggggaacatatgatagtttattctgtggtcagtttgtgatcatcttttgttaatattccatgtttgcttaaggatggcagctctttcttagcacttaccattttataatggtaaaaaacagatccaaaattacaagtgatttttattatatcacaataattatggttaatccgtaaaatacagaaaaatttcccatgagattaaaaaagggtgataatgtgtgattctatcagagagaaatgagcttcaaagggaaaggcccaaaacagcctctgcagggctgtgtagtgggcacctgggccctcgtgcccgactgcctggatctgcatcacagctccccacacctctcacacacacacttgctgtgggactttgggcaagttgctaacctctccaagcctaatttgttacctatacaatagcattaataatgggacctctttcgtggggattttgtaaggcttaagaaagagaatacatgttcagcacttggaacagtgcctggaactggtgccaaattgatgtcagtcatcgcgtcatttatgtcatgtggcagtacttagaaaagatgttatgaaatttctattttacagatgaaaagctcagtctcagagcggggtgataattactccgaatgtctgcagcagggaggcagtgggacttgagcttcctggttttgcagcccataatttctctgtggtaggaccaacgtcctgacttgttgatggagaggcaagagggctgtccccaaaggttagagtctggtataggaatttgagcaaaacagtcctttgcagcctcatatttttctcatccagaccctaagtgtttgaaagcacttgttttctgtgaactttttgacttagaactctctggacttcattcaagtccaggaagagaagaacttttgatttttatcaagaatattagaagaaatgtactcatctattttaaagtgattttaagccccagccacccagcaacatcgtccttatcctccactgacctgtaaatcctaccgtttctctttgaaaagaagattcatttcggggcacgacccaggcattttctgtagccagagaaaatgttcagatgggttgaaggccattgcatgatgaatttcctttgaagggaaataggagaaaagaagtttagaggttgtcacctttgcattcttcctgccacttcggagtccctcacaggttaatgcctgaactcctttaaataacaaccagagttctcaaaacgtgttcccaggaccagcagaactggcaccagctgggaaggcacttgttagaaatgcaaattctcatccctgccctggccaatccctgttgaaccaagattctgaaacctacacgacatgtataatttcagactcttttgtatacccgggtgcatacaaaattggctttaataaacattcagcaactcttttgtaagaattctcgaatgtctccccctcgatattcagtgttgactccctgatttccctctgcagggtttagacctcccaggatggtgacgtgccaggtccgtatgacctggctccaggctctttatctccacccatccacccctccacctcacagagcagctaagcccaatagacagcacattggaattaacaagcgtgttgggtgtttgttaaatgagacttctcagccccattccagacctcaagatctgaatcttgaagcaggtggttccccaagaatcttcattgtttatcagactcgctggatgtgattcttgcacacacaaaaggtagaggatcccactgtgactccacatcccattccaggatcccacaatgcgggtcccacctcccagcctctgcctttgctgtttcttcctcccaacctcctttttctacattccctgactgttgtcatcctgcaaaacccagcgagcaggggcctcttgagaggccctctctcctgccagccactagaatcagctgtccccatctctgcctcccacaaacagtactcctctctcacagacttgctttgttctacatagtggtcaggtggtcatccgcgtgtccacctttccctgggaccaaagtccaagttctcatctttgtatcaacgtagagctgaccgtggggtctgtagcattgagctaccccctcaatgtggagggaaggtacacatttcccttgaccttggaattatgaagaagaccctgattagtgaattttttaatggtcctgaaatggcttggctttatccctacccaaatctcaccttgcattgtaataatccccacgtgtcaagggcagggccagttggagataattggatcatggtggtgctttcccctatactgttctcatggtagtgaataagcctcatgagatctgatggttttagaaatgggagctcccctgtacatgctctctcttgcctgccaccattgcaacatgtgactttgctccttctttgcctttggccatgattgtgagatcttcccagccatgttaaactgtggaagtctgttagacctctttcctaatggccctaatgcagcgagagagggccacggaaagctttctggagaaggtggcatccaccttggggtctggaggacaattagccaaatgaagggaaggaaaacaccattccaggcacagggaatagccagtgcaaaaacaaaaaaagaacaagagggagctctgcacatttagaaactgagagtgatttaataagagtgccagaggtgacaacaagtgatgaggtggatggtcagctggggccacactcatccactccctgcctctgcacacatctgcagtttcagtcacacctgcccaaacatcttccttttttaagttttattttaagttctggggtatatgcgcagggtgtgcaggtttgttacacgggtaaacatgtgtcatggtggtttgctgcacctattgacccattgcataagtagtaagcccagcatgcattaggttgtttactgtccctccccctgcccaggtcccccgataggccccagtgtgtgttgttcccctcactgtgtccgtgtgttctcattcttcagctcccacttataagtgagaacatgcagtgtttggttttctgtttctgtgttagtttgctgaggataatggcttccagctccatccatgtccctgcaaaggatatgattttgttcttttttatggctgcatagtattccatagtatatatgtaccacattttctttatccagtttatcactgacaggcatttcggttaattccatgtctttgctattgtgaatagtgttgtaatgaacttacacatgcatgcatctttataatagaatgatttatattcatttgggtatatacccagtaatgggattgctgggtcaaatggtatttctggttctaggtctttgaggaattgccacactgtcttccacaatggttcaactaatttacactcccactaacagtgtaaaagcattcgtatctctccacagccccatcagcatctgttgtttcttgactttttaataatctccattctgactggcatgagattggtatctcactgtggttttgatttgcatttctctaatgatcagtgatgttgagctttttttcatatgtttcttgaccacatgaatgtcttctttcgagaagtgtctgttcatgtcctttgcccactttttaatgatgttgtttgtttgtttgatttttataaatttgtttaagttccttctagactctggatattagacctctgtcagatggatagattgtaaaaattttcttccattctgtaggctgtctgttttctctgatgatagttttttgtttggttttgtttctgcgcagaagctctttagtttagttagattccatttgtcaatttttgcttttgatgtttttgtcatgaaatctttgcccatgcctatgtcctgaatggtattccctagattttcttctagggtttttatagttttgggttttacatttaggtttgggttttacatttaatccatcttgagttaatttttgtataaggtgtaaggaaggggtccagtttccattttctgtctatggctaaccagttctcccagcacaatttattaaatacagaatcctttccccattgcttttgtcaggtttgttgaagatcagatggttgtaggtgttcagtcttatttctgagttctctattctgttcattggtctatatgtctgtttttgtatcagtaccatgctgttttggttactgtagccttgtagtatagtttgaagccagcctccagctttgttatttttgcttaggattgtcttggctatatgctgcccaaacatctttctagcactgtgctttggctgggtcactccaagcctctctgtgggaaggggcatagcatgacggaaattgctctgacttgggagttaggaagttgaaggtttgaattctacctctgctgctttctagctgtatgacttgaacaagttacttcacttctctgaggcttagtttctgattctgtaaaatgaggacaataatattaatacatactccatggagttaatgcaatgattaaaagagacactatatgtaaaggactttgtaccgtttctgcaaatgggagccatccagtcaaacaacagatcctgtgtccaccaaatgaagccctaatccctcagtctagccttgaaggctcccgaatttgggttcagtctccaattttaacccattctatcctctagtgccattcaactgcccccatttcccttctgctgactatcatcccataatcctcatgccactccctgggcctggaatcacctctctcatcacccctctcaatccatgtcactcagccttcaagaaaagcctaattcaaacaacaacaacaaaaaagaaatagcattttcacagcccttctgaaaatggaaatgagaagagatgctgaatgccacgtgagctttggctcctgacaaaagctttctcttcctctgttgaattttcacatgctgtgggtgcctttgatcagataggggtacatggggaggagctgtgtcttcttgcttccctctgacttcaccttcactgtaaacccttaaggggctgggccactcctgttcatattcccctttcttccctggcactgcccagcatagagtaggcatcattaatattgtccaccaacttaggtatttgatggggagagttaggcagcattttgtattaacttacttgtatagagggtgatacctggggctggtgaaggggaacttattttccaggcagaaaggcctattttgcatctttagtgccagtctgtgcagttttagcggagcctgagtgacttgggtaggctcaaggccctggagagatgtaaattcaaatgctgcacttcaataactggatgagacagatgttgcttctggcagatttcaaattctaatatttggaacaataaggctcctctcctgtataacttccttgacttgcggcttttccaagtaatgcccactgataatgattcctttccatgctttaaacactgggggagaatataacccagttagccctggttcctgcccagaagggcgtggtgttgaagtgggacaatgcttggaaataaattatctccctgcctaccaccaaattcatctagcagtcaagtcggaccctgaatgtgactcagcccctccccgaaagccagaacatccacgtttcttaggcccaggatacagtctggttgtgcagctcagtcacagcaaatggagcctgagagtgtagaccagggattcactaccaaaaacaaatctcaaaggggcacttgaaactccacaaagggaaccccaaaggaaaagtattcatatttcaactaatctttgtcttaaattttaaattattttagtcaaaacaatgcaagcaaatgattgaaaaaattcaatactgctaaaaggcttatagtgacacacagaggtccatcgtcccaccccctcaagctccctgtctgctctccagaggcaatctcttacaactcttttacctgttatttgataattccaccatattttaaaataattgatgatagaacttttaaattcattttctttagatattatccattgatgtctaagattgagacatcaatctgatgattgaggcctcagtattcttttttttttttttttgagacagagtttcgtgtatctccgaggctagagtgcagtgcagtggcacaatctcagctcactgcaacctctgcctcccaggttcaggtgattctcctgccttagccatcagagtagctgggattacatgcccccgccaccacgcctggctaatttttgtattttttttttttttttagtagagattggcctaaatctcactaaagagattggccaagctgatctcgaaccacattggccaggctgatctccaactcctaacctcaagtgatccacctgccttagcattcttccagcaccatccctcccttccccttctctaacctaccaatacacatatagtacaattttttattagttcactggttaacatttatattggtatgactatttaccgattactttcctttctcgtacaaccttttgtttttcctggagttattaattccatcattgtttttattttcttatttgcttagttttctaactacctacaattaatttttttcaaattctccaacattaaacacctggtaataaatttacaaaattcttaagtatatcacagatgttctaccactttatttttgtacctcagccctctagcctgttgctttcgtctaaatgggtcttttctggacaggtcctggtgcagaacagtcctgggattcttgcctctctcctgggtagaaaccactggttcctggatcctatgtcctcctcttcttgttttttgttttgtttttaaattattattgtactttaagttctgcgatacatgtgcagaacatgcaggtttgttacataggtatacatgtgccacagtggtttgttgcacctatcaacccgtgatctacattaggtatttctcctaatgttatttctcccttaggcctcacctccaacaggccccattgtgtgatgttcccctccctgtgtccatgtgttctcattgttcaactcccacttatgagttgaggacatgcggtgtttggttttctgttcctttgttagtttgctgaggatgatagtttccagattcatccatgtccctgcaaagtacatgaactcatcctttttttcttggtttattttcttgttttgctaaatcatttcctgaagtactttcttaagaagaaaacatgcaatgaagacaaagcttttgagactttccatgtctaaaaatgtctttattctatacttatacccagtagatagttaggctagatatagaactcttgtatgaatataattttcctcagaattttgaaggcattgcttcagtgtcctgtagcatctgacattgctgatgagaaatctgatgcctttcttatttttgatcacttatatgtgaactgttgtttctgtgttaacttttagaatcttcttatttatccctagttttgaaattgtataattacttccataggtgagaatctttctcttcagttgtgcagaattctcaatactcatttcctttcattctagatcattatgttacttctttgataattttctcctaacctcccatttttctattcttgctcctttctctgaaactccttgcagtcagataataggctgctcttctaagtttgattttagtattttctgtcctttccttcatctctttatcattttgttctttatggaacattttctcaaatccatcttccaacttgtcgactgtatttttattattttatcatatttttaatttctaagggctttccccctgtccccattcattttacatggagtcctgttcttgttttttagatataacatttacaactatattttagagggtattactgatagggtgtattgtcccctgcatttgttctgctgctacatttttgtctctttgctccagattgctttatctttctgttagtttctttttgcctttctcctttgtgttagacactttttcaaaagtgtggttctcccattcatatttaaaaagaaggtgagcaaaagctgtgggtgagggacaaggcttcattcaagagtgatgacagcgtgagcaggatttgtactgggaggccccacaagtcagtgtgtgaatgccttttctctttggaggtttgggttctcctccaaagaatgggagatgcctattctgggaaaagattcactgctgattactgagggctctgagatttattttcatgtttttggcctcctgttttgctgctgtatctggtatgtccaagcctggaatgacggtggttccattgattgtgagaatgaaccccatcttctggttcccatcaagaagtggataaagggcatggggctaaaggcctgccaccaaaactctgttttcattcccaccctcaccctgtctttggtgggtcctccatgctgagccaccaggggtctttggggcaaatgtcttcacttcccttcagtgcccccacagaggctccaagtgccacttcctccactttgctattccatcttctaaaactgggctaaaaacctcttgctcaccattgccatttcttgcattcccatgtccttgtggttaatacctttgaaatgtctgtactgccacgtttaaggaatggataagataaatcggcatggacaatctgccttgtttatcaagaagttttaaaaaaaatttttcggtacccaatacacaaaaggcacccaggaaacttcaaatgaataaattttagaattatcacaatttgaaatgctagccctagaaaaccctttaaggaaagcctgagacattcatattataaatgggagactgagactcaaatagcacccagcctctatgtgaacgccgctggtaacaaagctctcaattcctccagagaagaggctcataggtggaggtggctgtgtatcagaatggccgatgatacttttttttgtttttttgtttttttgttttttgagatggagtcttgctctgttgtccaggctggagtgtagtggcacgatcttggctcactgcaagctctacctcccagattcacgccattctcctgcctcagcctcccgagtagctggggctacaggctaccatgcccggctaatttttttttgtatttttagtagacatggggtttcaccatgttagccaggatggtctcgatctcctgactttgtgatccacctgccttggcctcccaaagtgctgggattacaggcgtgagccactgcacccggccgatgatactttttaaaaatccagatgctcactgggtggatcacgcctgtaattccagcattttgggaggccgaggcaggtcgatcacctgaggtcaggagtttgagacaagcttggccaacatggtgaaaccccatctgtactaaaaatacgaaaaattagccgggcatggtggtgggtgcctgtaatcccagctactcgggaggctggagcaggagaatcgcttgaacatgggaggcagaggttgcagtgagccaagtttgcaccactacactccagcctgggcaacaagagtgaaactccatctcaaaaaaaaaaaaaaaaaaaaaaaaaaaaaatccagatgcttgagccctacctcagactttctgaataagaatccctagagaatgtccagtggggctcaaaaggttaatactgacccaaatctggaatctttgagagacagaggtgtccgcggcagcaaatccatacaggtctgcagcaacctcaattcttgcctcctcagaagaaaaaatttgacgaggggcataaggcagagggagagactgaggcaagagttagagcaggagtgaaagcttattaaaaagcgttacagcaggaatgaaaggaagtaaagtacacttggagagcaccaagggagcgacttgagagatcaagtgcacggtttgaactttgacttggagttttatatgttatgcttccagggggttgcgtctcctctccctgattcttccccttggattgggctgtttgcatgcacagtggcctgccagcacttaggaggggccgcacacgcggtgtgtttactgacgttgtgcacatgctgacttgaggcgtttttccctcaccagtcaaaagttcccagaggaaggccatataccaggtaaactctgccattttgcctcttcgtgcatatgcttgagcccactcgcccaactcctgagatcttgtcgggaagcttatgatcaccagttttaggtttttttctattgggagactgactgcctttcccaataattgccagctgtgaccaactattattttagagagacagtttaacaactgcctgaccatcacctgatggccacctgacattcctggtggggaatgcctgactacccactataacagaggcaggggtcagacactacctcttttactcatcaggggtcatggtaggtcctggctaggtgagcaggaagcaggtcttgtctgggccttgcaccctctacccaagggaacatttgggtctgtagagtctgtagacacccactcacccagggccgctaccacacccagatccagaggaagagggagaaaaaggtctcaccccctgcatgtatggctccacatgccagccaccagccagtatagaccaatggctgtcacccagtaaccccataagtaactccgtcgtgaagttagggcagagcaggaggtcagtagtgtgtaggcaaagacttctttatgtagcccagaggagtggggagcaagggttgccccttcctgcccaatctaggtccaaacaaatatagttgcagacaagtcttccagtggggagccccatgtctgtggccaggccctttgggctgtgtgaaatggtaacagtgacagctgttgagtgagtgttactaagaactgggcattggctgggcacattggctcatgcctgtaatcccagcactttgggaggccaaggcaagtggatctcttgagccccggagtttgagaccggcctgggcaacatggcaaaacctcatctctacaaaaaattagggctgggcgcagtggctcaagcctgtaatcccagcactttgggaggctgaggtgggtggatcacctgaggtcgggagtcagagaccagcctgaccaacaaggagaaaccctgtctctaccaaaaatacaaaatcagccgggcatggtggctcatgcctgtaatcccagctactcgggaggctgaggcaggagaattgcttgagcccaggaggtggaggttgtagtgagccaagatgttgccgttgcactccatcctgggcaacaaaagcaaaactccatctcaaacaaacaagcaaacaaacaaacaaacaaacaaaatttagctgggcacggtagtgcatgcctgccatcttagctgctcaggaagctgaggtgggagaaccacctgagcctgggaagtcaaggctgcagtgagccatgattgcacccctgtactccagcctgggtaacagagtgagaccctgtctcaaaaaacaaccaacaaacaaaaaacccctaaactgggcattaggctgagcactttgcatgtaatctgttgaatccccagcacaaccagtaatgcaggttttattatctctattttattgataaggaaagtgaggctcatagaggttaaatttaaatttgaggtccaaaatgaccaagggagcaggcagtgcagtgaggagaggactcaaactcagatgggcaaggcaccagtgcccacatctgggcccacctggccctcagtggctccagctctttaagcaacagcatgtggctgagatttgagacaggcagatgatacagtgtgggacctctcgtcactgcccaacgatgttacctcaggagaagcactggctctctgggctttggttctctacctcctacccatggccaagaggcatagcgggttcagtgggtatttggaaaacagcacaagctaagcttgccccactttgcccagtttccagtcaggaatgaccaagatgcgatccgaacctcctaaaagacttttaggatctgaagaattaaagtcacagaacttgtgaatcagagaaacttggatatagaacattaaaatcacaagtgtatgattctaggacttttgcaaagcatcttacaatgcaagaattacagcttgttagagttataggacattcagatcacagaatctgtgaatagaaattgaccatagcagaaaatgacccgaccgcttctggaatgcagaaatctcttccaaaacagctctgacattgttatttctattatttatcaaacattgtatttggccattcttgcacggctgtaaacacctgactcacgccggtaatcccagcattctgggaagctgtggcaggcagatcgcttgaacccaggggtttgagaccagcctgggcaacatggtgaaatcccatctctacaaaaaatacagaaattagctggccttggtggtgcatgcctgtagtcctagctaccgggaggctaaggtgggaggagcctaggaggttggggatgcagtgagctgagattgcgtcactgcactacagcctgggagactgaatgagatcctgtctttaaaaaaaaaaaaaagacagacagatctgagacagggtaatttataaagaaaagaggtttaattggctcatggttctgcagactgtacatgcatggcactggcacctgctcagcttctggggagggctccaggagcaggcacatcacctggcaaaagcagaagtaaggctagggaaggtgccacaaattttaaacaaccaaatcttgggagaactcattcaccatcatgaggacagcactaagccatgagggatccaaccccataacccaaacaccttccaccaagccccacctccaacatcggcgattataattcaacatgatatttggcagggacatatattcgaattatgtcaagcacttataaagcccctactgcatgtgaggtcctcctctgtggactaaactttacggatgagcaaactgaggagtagaggggtgaagtggtttatctgttatctcacaatcagtaagtggcaggaccagggttcaggacccaacctcagaggtgggccaactccagagggcactctctttcttggcttctgtggcattgggagtcttatgagctgagccgtggcacatggaagccacagtgctttagcctctgccttccaggcagtcagcttaaccccactgctttgatacctactctaattctgcaaccattcatccaaacattaaatgaatcttttgtaaatttcctgtccttttctgacaattttacttttcaagctttttaaagattccatatcaaaaactttcataccacctttttccattgagaataatgaggaacatttataaaatttgatttctcacatctttattagcttattcttctagaaagaagtacatttcctttagacagaaaggacagttctcaaaaagccaaattcctaaagatgattactgtttttttaaaaataaacttttctgattccatattgacattttgacatttactcctcaagccttcctaagtgggatatggcaattataattctttattatctgtacaaatttatggggtatgtgtgaaattttgttacacatatttgtgtggtgattgagtcagaatatttaaggtatccatcacctgaataaaatacatttttgttaactttagttatcctaccctgctatcaaacattggatttattcctttttatacccttcagcgtgcttctctttatctcaccccaccacccttctctgtctctgttatctatctttacactctccacatccatatgatcaaattttttagcttccacatataagtgagagagaacatgcaatatttgtctttttgtgcctggcttatctcactttagttaatgccccccaattccatccacgttgctgtaaatgacatgatttcattctttttaatggctaaatagtattccatgatgtatatataccaaagtttctttattcatccattgatggacacttaggttgattccatatctttactattgtgaatagtactgcaataaacatgtgagtacaggtatccctttgacgtatgaatttcttttcctttgagtagtacccagaggtgagattgctggattgaatattaattgtatttttagttttttgagaaatctccatactgttttctttcacagctatactagtttacgttcctatgaacagtgtttaagttttcctttttctctgcatccttgccagcatctgttattttttgtcatttaataatagccattttgacaggggtgagatgatatctcattgcggttttgatttccatttctctgatgattagtgatattgagcattttttcccataagattgcttgagaaccaagcaaggcagaggacatccaaaccctttgaaaaatagaaaatgttttaggaataggggaaggagcatttcttgaaagatgacccatgggggggctctatgtgggtgcttctctcacatccaattctcagaaccactttttatgtggtgagtgttgtagccttggaagttcatctcattattatttccaacagagaaaaatgagaggtaatcacaaaagcccatgttcttgagatacctgttattgttagtgttgaaatagaatcagagcatgaatgcacaccaaaaatagcaattctagaacaacatatttgctgcaatgaattgagccatcttactagctggcttgtactctgtggggtcaggtgtggagagggtgacattgaccctcatgcccaacaggtaaggttggtaaggcaaacacgaccagccacatgctccccaccccaggattcagtaaagctgtggccagcagggtccttcccaggaggcagttgttgggagggacggtaaggtcaaagaagctccatgaacatttgctggctgtcactatttccctgtgaggccccactgctaaacaagcaggaagcattcaaagatgtaacaaagcaaccctatggaatgtgagtgcaggcttcactatcttgatgtttttgtaatagcatgagctattggagttgagcttgagtgatcactgatgagttctgtataggacctgccatagaggagtgtgacaggttcagcctgatagaatctgcatataaattccctattcagctagcagctgccaccatgagggaagggaaggtggcaaggcagcagtgctttgctccaggaactgcagatctgaggaataatgtcaaggaaagagccccgtacagggatcagaagagccaggctcttgttctgccagaccccctaatttctcatgtgccttggcatgagttacctgacctttacaggtctacattttctcttctatggactagaaattataataatactttgtgggaaaatattatttataatactataaaacatcagccctctaataggacaacatataggacagttttagcatttttataaaaagtattttaagagcaggagtgtctgtcgtttcagggatttctgtatctagctggagcatctcttatctgtgctgtcattcatcctccccaacatgcattcagtaaacaggcatttactaaacacctgccttttacctggcactgggcagataaataaaggaacaaggcaatgggtggcccttcaggagctccgtctatagggaaacacacccataaaaagcacattgctatgcagaataacaagtgctttaatggaaattggtaccagatagagaagtcatccacgggagggaatgctataatgtaaaggatgagtagatagatgtgctgcagaaaggggttcttgctaaaatggcctaggagcgtcctttgctaaagctgtattttacagggaagtacacagatgggcctaggagaagtttcaatgggctgactaatgtttggccaagtaaataatttttgtcagatgtatggatggacatgaagatttggaatcatgggcccatagatgtgtcttaggttgagttccccagaaaagagaccctgagatggagatgtgggcaggaagctgattggagaatgagctcagatcagtgcctgcaggggaagagatgggaccaggattcagcagagggaaaaggtgagcaaccctcagcacaacagaggtctcagttgagcccacagggagctctggagctgggatggcccatcagagtgggataatttggaggtgggggaacagaactttatgcccccacatcagtcagccattggatgcagtttgttcttggggagggctgggtagccttggtggaggaaacatccttcaagggcaattccagaggacaggcccagctgtggtccacagccagtaatgctcccagcagctataagtcaagcttgtcagttctgggccatgcaccaccattcactgcaggtgacgcaggtgtgggggaagccctaggacagtggccgtcaaatagctctacattagagtcacctggagagcttgaacaaccccagcacctaagccgcacccccagaccaattaaccccaaatctctgagagtaaggaatgagtatcagtagtttgtaaaaactctccaagtgattccaatgggcagccaagttcaagaatcactacccgggggatgtgtgtgagatgaataagaggagggcttgcctcaaaaccttggataagtatcccgagaagctggaggagaaccagggagagtgtgtcatggaaggtaaggggtgggggggtggtgtttagaaagaaataagtggccacctacagcaagaacatacatgcctgagtgggaggggcaaccagctgttctaaaatgtacccagaatttgtatgaatcctgtatggcgaggtgatggacatggaggcaaccttatctgaaagaagaatttattactcacagttccctagaggaggggacataccacgccatgcaggaccacgcagggaagcactgggtcagtcaggaggcagaaagagggaggggacagcctgcaccagagcctttattgtggccccatggcaggaatgagtgagcaggggaggcaggcttgagatcatgttgccaggctctgggctacagggctgttccctagttgtctgatacctggctctggagtggcctgtgggaggggaaatgttggctcagagtgtgagagtttgataaaggaagtgattggagtatagactttggattggtgggtttgcatacgaaaggcctgctctcaggcaggttgtttactagctctaggaattattaatagctagggagctgctattaataactgctcgggaaaggtcggtctctctgaaatcagaaaggtcatacaatatgaaagcgaaataaaatacagaacacataaaacatgattaatattaatacactaacctcatggccacctaggttggggtcagagtgggctggatttagcctcagcccacccccttatcagggagctgagtgctcggtgcacctttcacaaatatgcagagcagccttgaccctggatcccttgagctgcaatggagagagacagaaagagatgtacaccttgcagcagagacagagaaagagcacctgcaaacctgcaggctaggacaactgcaagggcaagtgggtggtcccaaggttgggacactccagaaccctcagaaagtgctcatgaggaaacaatatcagttttacacatccattggccccagagtcccaacgtacagcctcacacacttggttcctagaggggtcagacactggctagcaagcctggggaagaggggtaggaaggaggagagaaatagagaagtcaaccatctacctcccaccccagctctttccactgcaggcttctagcctaaagcaggcttggaggaaggggtatgggagatggaagaagtgtcagtcaatccattcaattcggttgattttgattattattttatactggcaattctgatgtctaaattgaaattgtgattctaggataggactctgctcagtttcagcagaaaagacatgagctcctagaatggggcagggaaataaagccccagggattaaattttagaggaataaggagacaaagatcaaggttgtatttagatgacattctggactgttcttatgtaacacaaggttacatttgtaacacacttagcagggagctgggcacgtggagcccacttgatcaatgtaagccattattagaataagagcctaaatatgaagaaatataaagaagagcatttcatttaatcccccaaatagctgtgtaaggtagggcttgctcttcccctttccaatccagcagcatggagcaatggccacttctggagcccttttgctgtcagaggcataagtggcccagccagcatcaaccccctcaccgtgctcccttgtctgggggccatgagcatattggaacatcctttataagaacttgacttggggtaagagtaatgatttcaactctacttaaacattttttgctgattcatcatagtccaggatgatattatttatggactaaagtagtctatagcttgggggaaatatgacctggaagtctatttaaaacatggaaacctgcagattaaagaacaagataatagagttattgcaaagcccattcgcctgacctgactgggagttaaaaatcaccttggctgacaagactatccttttctttcctcctgagtgaaatagcaggtgcaaagactctgcctgtgttctcctagatggacgctctagggctttaccaaacccagcaggctggaccgacaccacaaagactcatctttgaggttgttgtttggtggcgcctcatggtcttgtgtcaggcgagtaatatgcggttttttaaaacatgccttcctttttgaacagcacctgaaaaagacactcagaggccactgtctgaaaatggcaagcgctgtttgtgaaagggaccagtgtgtaggaaagccctttcccacgctgatttgctccttcaatagacatgtattgaaccactactgtgtgctagcaggtctctgccttcaggccatgcccatctaatgtaaaacactgaggcctcagctctgtgttgggaccaagtgcccaggagctccatcaagggccactgagggtcttaggcctgggtcagatggtagaagttcagaccaagctctcctggcccttcccctgagtctggtggtctgatggctcctccctggtcactaggtatgtcttatcaggcctcctggatttgaattcagactctgggatcccagatttggcggccagtcatgcctctatgaccgagttgtggcctcaatgagctattgaacccctctgtgctgcagttaatatttctgtatagtggagataatcacaggctctctgtctgcgagctattgtgaggatgagaagagatgaactatccaatgtgcttagtaataaaagccactctttcctgttgaacacctacagtgtgtgcaggcctgtgctcagcactcccgacatccattcatggactaaatcctcccaacagaaatcctccctaggaatacgtgttgtcactgtccccattttacagatgagaacactgaggcataggcatttcgataacttgcccacagcacagtgagtgggggtagaggcagaattcaaatccagacagcctgcaagagagctgtgcccatagccactcactaggttgccctgatcctggctgcaagcccctgctcagtaagggttgctgatggcgattacatctttaccactgtcattgggagagaagacgtgcatgttcattgtcagaaattcttccataaagcacagggcatagcagagcctttattgtggccccacggcaggaatgagtgagcaggctaggcacttactcattgagatgacgtgtgcgcaggtcatcctagctatttttattatttgggtgggccacatgtataatatgggtggaaacacttcattcaacacacaccctacccacacacccagtcacacttttcttggtagaaggtgaggggaataatctctcctaactataacacctctccctgcagccagctaatatctccaggaaatctctgaacacttgctggaaaaagccaggttcagactcttctgctggctaagctcagtccctctggagtaaactcttatctgagctccactctggacactcccgaccctcaccttttccgctgttcaccccagggatgtgtgcagagtggccactgccattgtccttccccagttcagaaatgttggcatcccaatccgggggctgcccaccctgaggtttaaagaatccaccttttctccagaggtagaaagaagaccatagtcacccatgcgaccccccttaagaaagagtccacatgtccttgtatttaagagaccagggatcaaaggctatgccataaacttgataacagcctttcaggaataagtcatgcaatgtgaaacatacccactgactaagattccaaaaacactgaattgtagattcaaggaaatagagagtgtccatctcagctagtgcatagacccctcaaaggctcctgttgtcctcaagccaagtccaagagccatggaaaggcagcaaagccacccatgacctgacctctgctcaaggctccagcctcagctcccacatctccggcatcccctgaccttctgtttccactacagttgttgttccccaatgagcctgggtggatcatgcctctgtgtggttatacatgctgttcctgtgctgggggtgcccttccacccagtggcagctccaaaaacaccacccctgggaagtgctcccactgtgacgatactgtgggaaaatattaggcttgatttccacctgtgtggctcctggctgggaggcctcagcacaggaatcgcctgccacacctttaacatgcagcagtattgctggctgtgtgtggggctggcggctgtgcggtggaaggagacagccatgggaagggctcacatcacatccggcacgtggtaggagcttcatggggttggttccctcgtgttttctcagattctgtttttacccttactgagacggcagccaaaccccgagagaaaataaaatcaacaccaccacacacaggcctagcgaaaattccacttctatgtatgttggggttttttcttcctggtctttctttttgatcaaactatgacacacatatcataaaattcatccttttaaagtatacagctcagtgggttttggtatcttcacggagtcgggccaccatcggccttccctaattccagggtatttgcatcaccctagatgaaaccccacacccatgcgcagtcactccccactcccctgtccctggccctcctgggcccccgacagccctagcctacccctcccagccttctagcgagagctcctcctgaaactggaaagctgacattggccttgccagttcctcaaagggcgatggaagggctatgctggctggcggaaccagaggagttttgtgaataaaaattgttattagatacagaaaagggaatcaaatctaaggcaccccttagatggagatgatgattggaccagctgctggctgtgtgcccctggcaggccacttccccactcactctgagccctggggccctgctgctctcccttcatgggatcctagaacttgcaaaagtctctgttaccatggacctcagtagggagcgagtcttgggagagcagcagagggaagccctgcctcccagcgggcagctgggggagaggtggggaggctgtccccaggccctgccagttctggtgccccaggatcctgagggtaccttcccatgggccccacctgaagccaacagaacctctgcctatcatgtgaagtcttttcaggtctgagtgtgtcttattttgcccttggccatctccttgtaccttcttgggaaataaacgtgtcaaggatgtggcattgaggacttggtttttcctccttctcatgatcagaactgcattgtgagcaggattctcttctttcagtggcacactgagagcctatttgtaaacttgggtaggaagaaagcaggttaggacgaatactaccttgatgggcatcgtaacgtgtgctctgggcttcatttaagctgcactgcaggggatgtcactgcttggagtgcatcacttgcctcttgaatagtgcgtgtcgtagggatctgtttgcctttcatagctggctggaaagtgaaaggcctcctctccctaaggggtaagctgtgccccactggccccctcttcctcactcccatggggtctgcaagagctccagctgcccttcttgtgtcctcactgagaagacagagatggttgaatgtcgtgggcgtctagatatctagcggtggtgcccatgtcacctccacatgcaggctccattcttggggcagcctgggaggcagccctggtgttgaagagaaggagaccctaagatcccccaggctcaccatggttccccagggagtggggtcaagcagcccttgagtggccttggccaaccagagccgcctgcttttcagagctaccttgcaggtcactatctcacaggggactcttgaggagtctctggactcatgcatggaaaatgctatatacgtgggactggtgcccagcctggctcagttccttccctcagcctttgttcctggggatcatgctgggcaggaagaccttctgcagggtcgaaaccacctggtccagtggcccagtcccctcaacaatgaccaaaggccactgcactcagcagcatctccttctcccacaggagagtacctggccatacctgtttggagtgattgtggtccctgccgttgtccagctgctgagccttccctttctcccggacagcccacgctacctgctcttggagaagcacaacgaggcaagagctgtgaaaggtgagggcccttccctttcctgcacagctccagcccctgcatagatcatcactgcaaggcatgctgggacctgggccaatgggcacaggaaggggtgttgtcattgttcctttttgcaggcactgggctgggtatcatagggtaccttctcatttcatcttcccaacagccttgctgggggacagagaggggacacagagtcacccagggagtctcccagggaatctggaaaagccagaacagacaagataagacgcaggttccctcacttctgtgcagtgtctcactaccacctctctagttgttcccagccacagagatgaagccatctgaaatttctgagtggcttaggtgcatggcggccctccttccacttcttctcccttcactgacttcctctgtcttaatatttacctgccaggagaggaaaagatgcaagcacagagtgaacaccagatcccaccaggcactggtctgagtgcttcttcacaatgacccacaggaccttgccaacagtccttcgagggaggaaggagtatacactcattttacaggggagaaaaataaggctcgcaaaggggcttgggagttgtctcatgtagctttctttaaatgccctaaatggggggatgctgagtcagattcaaatcttggctttcggaatcagagacatctctctacagagccctgaaaaggcaaaattatgttgcctagagatagacaatgcagaatgaacaatcacattctgattcttttagttttataaaatgagatgcagttgacagcaccatggttagttaggcatgtgaaggtaaccagcactaccttcacatccagctctgatgtctgaccttgagcaattttttaaacctttctgagccccagaaccctcatctgtaaaaaggaaatgacataaacttccctcatggggccattgtgaggactgaattagatggtgcgtataaggttcgtagtattatctgctatcattattactgagaactctgtgcattttagttctaaatttcatctatgtccaaatccaggaaaagacttgagaattatatatacaatttgtgcaacatcttttgaaattcacactacctaagtattttctgagttaacaaatggcataatgaaatattaacaattacctatatttgtctagcagtttatggatcagattcattttctcatttataacatttctctaaagtgaagtcagagaaggtaattgttattaccttcattttgcagatgaagaaactgaggcttacagggatgaattccgtttcccaaagctgtgggttttggtttatagagatttatagaggcttttgaaaatatgatggaaatgatagtgttttcttcaatacagtaaccatatacacaaaattctgcctatggcttggtgatagacctgggacttgagccctcttttctccagaggaccctggttagtaactcccacccccaatcttaaacccgttagtaaccaaaggattggaacccaaagaagattttcctccaacacccctcgtgcacagagagataccaggaaacggaagtagtggctaatgtaccgggtgacttcccatgtggccagtgaggagaaaaaccacctaaaagtttggttcagatggttgtcagatggcagagtctctggagtaaaaagaaggtgactaagagagagaaccaaggggatctgattctagatgcacctgggctgtgcattattggaagagggtgaggcctccagctctgtctctactagcctgggagggtaacccgcaccccctctggctctcttgagaaatgcttcaattaagtacagttggaatgaatagtgcatgtcaatgccagacagtgaagaaggttttaaagttttatttcatagcacagtagggagtgagggagaagtacagttacaaaacgtgataaatattacatgtgcactctataaaaagaacaaagatattggccttaagttgaaatagcttattgaaattttcatctgtacctataaaagtgctaattttactccagacattcagcaagcaatggatatttagcatgttgggtgttctgccaggtgacagggtaagacagtggtatgagatgacattcctgccccccaggagtgagggagggtgaaggtctagttaagggagatggacagaaacacccactaatggctcatctgtattgaaaactatttcattctaagcacttcacatacattagctcattaaatcatcacaacaaccatagaaagtaggtaatatttttattcccattttaagacctaaaaaaaaaaaccaaggatgggataacttggccaaggacataaagctagccaatgacagcactgaaatttgaattctgacagtctggctctggaacttatgaatgtaaacaaaatgcactttattacttagcaccatgctcggcactgtgggagataccccttctccagtctgttgataatttggggaaaagaggccctgtgttagtcaactattactgtaataatgctgcataacaaaacacccaaaacacattggctttagataatagcatgccccagttcacaaacctataggtcaacagtgttgttctgttaatcttagtagggcttgaccttaaaatctttcttggggccagctgaagttcactcgcatgtctgttggtcacctggctgacctaggttggccttagctctgttcaatgcacctcatccccagctggccagcagggcacattctcatggtaatcagagaggaaatggaaaacacaagcgttttctctaagcttgaaatctcctaaaatcctattggccaaagtaagtcacatagctaacccaaagtcagagtggaaggggcttcaaagttttagggtagaggacataaacgtagggaggccacgaacttgggccatcaacacaatcacttcagacaagaggcccctttcgggatgttcctatccccactccatccccacccccagttcatagtggcagggaatgagtcccaggccctgggtcttatttatttatgccacccttgtcagtttaggagaatcccagcctccagtgcctgcaatacacatggtgctttgcttctgtgatctccaaaactttgcagacaaggaaatgaccactcagaggctgagtagcttgcctaagataccacagatagttcatcacagaagcgagattctaactcagtttgtctcattcaaacctgaattcactgaagtgcagggtgctgccttgagcgtgtgtgtgactcttatttataagacataacgtgcacataaagacaaccataatagcaaaagatcggccaggcgcagtggctcacgcctgtaatcccagcactttgggaggccgaggtgggcagatcatgaggtcaggagatcgagaccatcctggctaacacggtgaaaccctgtttctactaaaaataaaaaaaattagccgggcgtgttggcaggcgcctgtagtcccagctactctggaggctgaggcaagagaatggcgtgaacctgggaggcagagcttacagtgagccaagatcacaccactgcactccagcctgggcaacagagtgagactccatctcaaaaaaaaaaaaaaaaaaatagcaaaagatcattaatccatgggttggagacacagaaaatttctcctgaaatattatgactttatatattaagccagggttaaattccagatttgcatccatttcatctaagaacagttagataagtaatcgtgtatctgcttaaaactgaaaatgatatcccaatgccaatttaattcacttatttaacaaacaattatagatgattgtagcattatgaaggcatgcttaggacataatgttcgggggggaacaaagagaacataaaaagaatctgtgtgatcacagaagtgtggacatcatagatacgggcaggcccaggtaaatgcaggcacaaacggaggccgctgatgcttgagggagctgggctttgtgctttgtaggctcttgctgagggaggggcaacagaggtaaactcctcgcttactccctcacctgtgcaccaaacacacccaccaacaaccaacgcagaacccaggaaggaggccacggggtgatcagctggctcttcaggccctgctgtctgtggtggccttacctggaggccctcagctcacctatacccatctggagatggctgaggagagaagaggggctgtgtaacgttccatgcttgcccttgtcaatgataaagatgtccccatctcctaaaccgggcagagggagctgggcagagggaggtggggacgcactgcctcagaggtcttctctcggtctctgctggcagtcacctgctcccggaagaccagcgccctcctccctcactgttactctgtttcatttctaagatgtgagccaagataggtggcctctgagagtcttctcattttggcccatggactagctaagccccaggactcccttttccctggctagagagaacttgttgggacagggtgctgagtgaagaaacagaggcccacagagataaatgtctcctacagaaaacccaagggccaaaaaggggcgggaaaacacagctcggaaaccaccctaccaaagcctccagccctcagagcacgaagtcgttcctagaaattgcccacacacttcttcgttttaaagaacaagcaactcttgctgtaaggaccagcctcactttagatttagagaattgcttagggttttgctgaagcagaggatgttttctatgttgtgcctgtgatgggtgccattcccgtgcaacctttgagattgctggaggtctctgtgcccctgagagctgggaggaagttctcaacgtaccttcaattccacagcacagggaaggaagttcaacatttctttaccattcagagcatccctgtgctttgagtctcctctgcttcttggggaccagttctgttgctcttgggatgacatgatagtcccaacttgaaattcagtaccttctttggttttctcaaaaacaacagcacccatgtacaacaaatcaccagagagtttagagaccatatcaaagatttcagggtggtgggggagtcactccatcctgccactcacagcctcctctttcctctccctgtcatctctgctcatcatcccctctgctttcttagatgcccctggagccccgatttctcctccctctagcatgtcgagcgccttcccgccccttctgtagctggaaccagcacacatgcagacattcagcagacacctgctgctccagacattcatctaaatatttttcttagccatgacagtgcttgagaaacattctggtgtcagccgtgaagttgacacacttttcttcccctctttgtacctggtaatgttgctgctagtatcatcatgctccctggctctctggaaggcctactgtgtgtcacagcatgtggcccagggttagctgagagttagcagagctggggtccagccccgtcttccccataccacagctgtgtgactcaggaaagctgcccgttatctcaaaggctcagttttcttgcctgtgaatgcttatctctagggcccagagaaatgatcatatcagatcatggatatcagagtgctttgtaattctcttttataaaggcatgaatcctgttcgtaaggattctgcacccccgacctgatcacctccccaaaggccccacctcctgataccatcagtttggggattcattttcaactttttacttctggggggcacaaacattccacccatagcaatggtattttggcagaagggctccaatttctcgcaggaggcagcgtaagacaactgccccatctggggccctagggtgaagagctgccatgctaatgaggaaggagattcatagatgtgcctcccagatgtgcctggtgtgttcagacacaacagctcccaaaaatcccttaacccattcttcacaggctgggcatttcatgaaatggcagcagtgctcattttaatgttttatgagccacagagcttcctgcaggaaagagtggaatggaaactgttaagcccccagcgtgaggtcctgggacccatcaggtttgactgggtgcatctgcaggcgagacggtgctgggagcatatgttcaggggcacacgtcctaaaacaacatgcagcatctcctgggcttcctcaccaatgacttcttggacagcaatcttgttgagttcttccacatagcaggtgcagagagactgtgggatctgagtgttgacactgggcaggggtcaggagttctggtttggtcacaacacctctctgggctgtgtttctctacctgcaccatcagaagtagaacaagatgctctctaagaaccagctcagctccaggttctgaggtcagaaccagggcacatagggacagggactagtgtcaggcccaaggctcctggaagcaggtgttcgggctctgccaccacccataggctcccacagcaggtggttgtaagtgtcattgctccccctccgagggacagtgagacagcacagaatgagcactaagtgggctcaaaaccccccagtaagaaataggaacacttttacactgttggtgggaatgtaaattagttcaaccattgaggaaggcagtgtggtgattcctcaaggatctagaaccagaaataagatttgacccagcaatcccattactgggcatatacccaaaggaatataaatcattgtactgtaaagacacatgcatatatatgtttattgcagcactgtttacaatagcaaagacatggaaccaatccaaatgcccatcaatgatagactggatgaagaaaatatggtgcatatataccatggaatactatgtagccataaaaaggaattagatcatattctttgcagggacatggatgaagctgaaagctattgtcctcagcaaactaacacaggaacagaaaaccaaacaccgcatgctctcactcataagtgggagctgaacaatgagaacatatggacacagggaggggaacaacacacaccagggcctgtgggcagggggtgaggggagggagagcattaggacaaatagctaatgcatgcaggacttaaaacctagacgacaggttgataggtacagcaaaccgccatggcagatgtttatttatgtaacaaacctgtacattctgcacatgtatcctggaacttaaagtaaaataaaaattaaaaaattccccatggtaaatccagctctgctactaactggccatcatgcatctctccagatgactgtttcctcatctgctcatggctaggatagtgctggatggtaccaaagggcctttccagcaacaatcccagacctctgtcaggatggaaacttcctccaagaacagtgaggattcttgttctgccatcagacagtgtcttagggacatagctgttttgggacacaagaagcagggcaaagtagtttgagaaaaaatgaaaagccatctgtggtcaagaaagtgtccagctacccagggaagcatctgctccagtggtcccgatagacacatagtgtcttcatctacttggcatcatttttgtgcttacccaggtggagtggtacagtgggcagacaaagctgtgaattttgctttgtacaaagaggggatttgattgggagatctcatggcttcctttgtttgagttcctcttatatgctagtgtgggaggcagaataatgacctccaccccaccctgaaagatgtccacttccttcttcccagaacctgtgaatatgttaggttacatgatgaaggaattagggccacagatggaattaaggtcacagatggaattaaggctgctcatcagctgactttggaatgagtagtcctggactaccagggtaagcccaatgcaatcacaagggttcttataagtggaaaaaggaggcaaagagagagagaaccagagaagtggcaatctgagaaggagttggcccaaggttgctggcattgaagatggaggaatgggaccaggagccaaggagtgcaggtggaccataggagctggaaaagacaagcaggcggattctccctagagcctccagaaggaacacagccctgcaacactcaattttaatccagtgacacctgcttcagattctgacctccagaactggaagatgataaatctccattgtaatttgctgtagcagcaagaggaagtgaatagagctaggtacatggcaaccattaccttagtcctcacccccctaaagtctacacattttctaccttttgctttatagatgagaagactaagactcagcgaggaaatgtcaaggtcacagagctagtgcattggtcaatgttccacccaggaaagtggaaataatatttcagagaggcactggatgccaggaaatggttacagaggtgccagtagggctgggagagcaaaaggagttgggcagagtcaccctggagcccgtgcgttcaccctccctcccctttccaggagaaagggctcagtcccagctcagccactggcctgcccagtggcctcaaagtgctcacctctctgcaaaatgaaagagttgcattggcattggctcacttctaatttctgaagcctaaaagaagctcctctttgccgaggctgagttcagctactctcctccagtcacattccatttgtgtcaaactttgtcctcctttttgggccacaccatgcatatcccagattctgtggtcttacagagccagttttgatgccaggtgagtttgggttcaagaactgatcccatctcttactgacactgctggaagcatgactgtggcagcagggcagatgctggagctgctctcgttaacgtggctgatgttcttggcacagatgacgtgggaaccacagcctctgaggctaaccaggagccacagctgatggtgctggaactttgactagcagaagaggtcctttcttcctctaacgatgcatcagtgcctctcactgctggaatctaacaggactctgctagcatgggagtaaggagatatcatttatagggagtaaggacaggcagtttgtaggctgctagcccccatgacacagaagagttctaaaagggtggttgtggggctgagtcccaatagggcaaatgcaacaagttcataagtagtgggatgctgtcagcacatttcatctcagcacctgtgcactggctccttcgcctggaaggctctttccccagatgtctgcatgacccacacctccctcacttcctttaggtctctagtgaaatagcatcttctcaaaaacatctcccccagctgccatagctcagtgtcccctcttctcactgccacttaccttgatttatttttctttttagcactcattatgacctgaaatgatatgtttataaatgaatttgcttagtatcactcccctccatgagaatgaaaagctccatgcgaggagggacacttttcctattttacttattgctgaaaccccagcacctagagcagtgcctggcatacagtaggcatttacttactaaataattgttgcatgaatgaagaaaaccaaagtataccaaaggctgagtacagtctgtagcacgctgctgcttaaagctctgtagtacattcttggaggtgtttatagcaatcggatggagacttacttgctgtgggaacatgaagcaatttcacccagaggagaagcaggcatggagaaagagagagagagtgccatttttacaagggaaatattttagatcattgctttgggccttctgtgatgtttctgtcttgatagtttctacctctgttctggagaggtttcctcatgagagagattttccaagtcaggcaaggcatatatatatatatatatatatatatatatatatagagagagagagagagagagagagagagagagagagagagagagagattgagagagagagagattgagagagagagagagagagagagagagagagtcattctcatttcaggtctccctgcagtcactctccatgtggcatcaagccccaccaactcaagtggtagtgagtcgtgtctgtctctcactagagacctcctgggagcagaacccgttccttgttcttcccttaacacagtggatctttgcacgccatcccagatgcacagcaagctctcacaagctgccggataatggcaatgagctgaatttggctccttagcctctcagccctgagatttcttgtgaggtgtgtggaaagaaagatcagacagatctaggtcagagcatgaactcctcactattacctgggcgaacactggcacatttcctcacctccctgaagctgtggactgaaacacactcgccttgaagggctgtttctgtaagacacctcgcacaaagcctggcatacagtaggtacacaataaaccttagcctcttctcccctgctcagtgtctcttgactcctcttgaataaagttgaatctgtaactggggcaagatctgattatgtaacagctccctctcccagcccaggagtttgccatgctacacagaggtttttttcccagttgggaaatgcaatttctcattcctctttcaagttctttggagttagtgattagaacatggctaggaatatgcatgaggtatgagccacaggaagccctcttactttcaaattgaagggagaatgtggggaacatgcattcagggggtagggcttggatgaactatttttaaatgacttggagagtgaagagaatgaactcctctgagagagttaccttccataaactcatgtaatttttaaatgggctgatagatagcaatttcccaggccatttcctctctctccaagggcagccagtttaaactggaggtatcagctctgtcccctcccaccccatgggtgacattgccccatctccttccaatcatctacacagcctgcacacatctggggttctgggcttgctttagagaccctgttgttcatcttcctctccagtgcctgggtcccttccacaatatgattgacaggtggtcaccaggctcctcttgcacaccttcagggatggggaactcactgtgcaaaaaacacgttcatccttggacacatccatcaggcagttcttccttgtggtcccacacatcagagctcttgcctggagcccttgttctgacctcagagccaaggaaagcaaatccaatccaggcatctcctcttgggaaactcttttctgcagactagacatctgcaaatatgagtaggttcattaccttcatccagcatgctgtgagcacctctgcattctagacccagaggaaaaccaacctcttccatgaagcatctgccatgagccttcccctagtgcaagcgctgccccgagctgacaggactgtgaggacaggagccagcacaggtgtggccacgtaccaatcacagcacacccccaacactgcactacaggcaattgcaagtttagcaccaattctgtgacatgttggaagcacagagaggactttctggctctccctcctaccctctttttcaccctgggcctgtgaggagctacatttccttccacccgtctttaggggaagacctggcatttgctaaacttgcaacacagatatccgtcttgctctgatgaaagtgatggtgaagggaaggttgggtgaaaaccagagagcatgatgagtgtctttcaatttcagatgagactgagagagagaggaggaaaggtggaagggaggaaggagaggggaggggagagagacaggcaggatttgcggggaggacagcattccaaagctctgaagggtctgattctaagttgctgtcatggtctgaatgtttgtgctcctcaccacccctaatttctatctggaagccccagctccccagagtgatggtctttggaggggagtctttgggagggctggctgaggtcatgagggtggtgcctccagagaagtgagaaggcagtgtctgcagccaggaagaggctttcaccagggagctgactctgcggacaccctggtctcgaacttctggcctccaggactgtgaagtctgttgtctaaaccacccatctgtagtatgatgttatagcagccccagctggctgagcttccaggaagcattgctggacattgggaaaatgatacttctggagccccggtgtgggttgtaattctcgctcctccgctcccctgctgaatgacagcactagccccttctagtgtccccctcacaccctccctctgcccactctaatttcagccttgctgcagcagacagtccatgtgggctcaggtatgggccaatgtttgcccaccttaagcacagcacgtgcctctccaaatgctcaggccctctccatggccaggaagctgctcagccatctgcagcgcagtgtagacattcagggagttaatacccctgggggcaggagctggcagataaatgccccatcttcccctgtgggacagttctggaggtattccatgtgctgctcagaagccccgcagaactgatgccctttgcccatagaagtctccccaagatgcaccttggactgccttgctctccagccggtaaacttcccacacccagcatgtgtctcaggctctgctgcgagggcatccagtgtcactgcccatgtgcaagcttcatcttctcacctgcaaagtgggaatactgactgtgtctacttcaggggatagttatacgagaattaaatgaataagggcacataaaacacaagggaacccttagcaagtggtgaccaatgttattgcaacgtggatagctcaaaaatgaacctcattaaacgatgtagctccaaacagaagcaggtgacaaggctggctgaacttgatgaagcggcttcaacctgtaatcccgtccatcaggaatgaaatgttttgggagttgaaaatgcaggccagtgaatttccatcttccttagtatcaaccactgtccttgctgagtagtaagaagttgttgcctttttatattttaacaataatcatttagcaaaacctactgaaacttttcattcggaatatgtttaaacagaaagttttttaaactgcttgcaagtttttctttttgaatgtgcagatccgagagttttttgtttgtttgtttgtttgtttgcttttgagaaggagtcttgctctgtcacccaggcgggagtgcagtgatgcactttcggctcactgcaacctccacctcccgggttcaagcgattctcctgcctcagcctcccgagtagctgggacaacaggcacccgccaccacgcccagctaatttttttgtatttttagtagagatggggtttcaccacgttggccaggctggtctcaaactcctgacctcgggtgatctgcctgccttggcctcccaaagtgctgggattacaggcgaaagccactgctcccagctgagatccaagagtttttattggtgatctgtgtatataactttgtctaccaaaccacatgacagacacatctctttttatggaacagtttcttataaaaggttgctactttctcactcctgttaaaatgtcatctttatcctgaagcaacagattgactacatcttgaatttgaaaatctctgtgaggcagcgtactgtcaatggtcattgaggctagcagcaggcttgcacctgaaatggagatagcgggttccactattgattgtcctgtctttctttgtgtgggagttgttagttttacctttaatttgtggtttcttttgttttgttttttttcttgagatgaggtctcactgtgttgctgaggctggcctcgaactcctgggctcaagaggtcctcccacctcagcctcccaaaaagattagttggaactacatacaggcatgtactactatgctcagcttttggggattctttacaagccacctgtatattcattggggttaattcaattgaaaccaaatactaccatttccaaatctgctaactggtaaattgcacaagtaaacagcaatatgtcattcaaaagacagatcgaaggcaccctgtcagcttctccacacggtggagccctgatccccagtcacataggccatgtgaaggctccaggttcggtccataataaaacgttataaagctataaataggagctccaatatctcctcctacaccccttgttacataccctaccttggatccaactgctgtcggtaataaaaacacactgaacctaagttaaaaacccaatgacttcctcctcttaaattccattagtcattgaaaaataaatgctttgatgaaatctcctatttttagaagcatgaggcctgccctgtgtaagggagaacaagctcagtgccactctgggcatggaacttatacgaggctattgccctatgctccacgtgaagtccctttgcctgtctcatcccaggcccccgatcacaagagggaagaggcctccgggttgttctgcgctttgctctagcaggaggtgataaaagaggtgacaaagtgtggctgctgccataacaaagtgccatgagttagtggcttacaacaatagaaatggggttgggcgtggtggctcacgcctgtaatcccagcactttgggaggccaacgcgggtggatcacctgaggtcaggagttcgagaccagcctgaccaacatggtgaaaccccatctctactaaatacaggcgtggtggcggatgcctgtaatctcagctacttgggaggctgaggcagaagaatcacttgaatctgggaggcggaggttgcagtgagtggagactgcatcactgaactgcagtctgggcaacaagaacggaactctgtaaaaaaaaaaaaaaaaaaatcgaacaacagaaatggattccctcacagttctggaggccagaagtccaaggtcaaggtgccagcagggccatgctccctcttctggcttccgacggggaccagcagtccttggtgctccctggcttgcagctgcatcactccaacctctcctccgtgaacacaagcttgccttccctgtgtgtatctatctgtgtctcttctcctcttgtaaggacaagagtcatattggatccagagtccatcctcctacagtatgacttcctcataacttacatattaattatattgacaaaggtcttatttccaagtaagttcacattcacagctaccaggggttaggacttcagcatatgtttatgaagacacaattcaacccacaacagaaggttatagcattttgtaccctctgccaggctaaagatgaaagggagagggagaatgtagcaagtaccccacagtgatagcatgtatattcataatgctccttgctcatcaagagccagataccgttctgaggactttgtgtgtgccaacatcgaacactggttacaccaccaatgctattatgtttattttacagacaaggaaactcaggcatggaaacattaaatacttcacctggtatcatactagatggaaaatggtgcagccaggatttgtttgtgagcacccattggccccgaaacaatgtgtgtttgcattggtgagcaccaattggcccaagacaatgtgtgtttgcattggtgaacacccactggtcctgagacaatgtgtgtttgcattagtgagcacccattggccctgagacaatgtgaagcccaggtttctccagctccaagacctgccctctcccactgtaccacaacgtcccttaagtggctcttgctcagggggcactcccaggtgtgggctcagcaggtgtacagacacctggaggggtctccaggccaggatggcacctgtgctaacagcgtggctctctgaggaccccaagggaggctggcgggctccatctcatctgcttgcagtcgtgtgtgggccacccccagatgcatcagtgtctgtcactctgctgtgctctgaaggtgtctgaggaccatggggagcctgccattggaaaatcacaccatgcccggaacagtagggagaacaccgaacagatactggcccccctgctgatgcaatttggttgacatctagcataattttcctctgttcctgtttgctcagccctcccccgcttctgtgtttataacatgctccttctccttccctgtcacctgagtcttgatttttactatttcattcaaaacacatgggttggatgtacattctatgcaaggctcaacagagaggaaataaaataacaataattgtttattgaacacaaattatgtgccaacacttaacacacattgattttattccccaaaacaacctcataggtaggttttattatttctgtttcatggaagaacaagcatggggcgggcagaataggtaactagtctggggtcttttagcagagacagggctgggtgtgaagcccaggttgctccgactccaaggcccacccctttccacagtaacacagcatcccttaaatggcccctggtcagggggcgctcccaggggtgggcacagcaggtgtgcagacagaacgccccagacaagagtgaaagtgcccaagagagacagacacaggtgcaagagcgacccggatgagagggtaacagtgattagccatcatgggggcagggaaggtctccaaaagatgtaactgctgaggggatcctcggaaaaggatgtcctaggcaggcaacaaagtggcagggtgttctggacacaaggaacagcacgagcagggcacagaggcaaggccatgggggtatgtggaatggaggacgagtgccttttccagggcagcagccaagagagatggggggagcctccagatgccacagggaccgtgggaggaggctctgcatggcagatgagaatttggactggatcctgctggcaagggcaagacagcacaggtttgtgtgcagaagagtggcccaatcatcttcctggggattagcctggggataatgagcccagtggggagaggctgaggcctgaactaaggcaggcctgggctcaggcagagaggagcacatggactgtagacgctgaaggggcttagtcactagatcagacaaatcagacacggaaggcagtgtctgggttatgtgaccacaggcatccagtttaggtgactttgtgattgttgtcaggtgcccccaaagcctgagtcaaggttttgaagatgggaagtttatttgagaggtgactcgaggaagcaccacttgcccagctgggaaatgggacagggaaatggaggatgcaattgaggaagcaccacttctccagctgggaaatgggacagggaaggagagggtacaattgaggaagcatcacttccccagctgggaaatggcacagggaagtggaggaggcattgaggttcaataatgagcaggtgtcagctgtgggcaactgggaccccacccacccagtcacctctgggggacagcgtaggactcactcaggtgtctgtgaggaagctaggtatacctctgttaacatcagctttgtcttaaccgagggctgctcctgggggtgttaactgctgagggctgagcacacacctgtgcccagggaaagccgcaggcggagaggcacgggtgctgggtgtaggaagctgtccatgtgcaggagagacatgggtggcatgcagtgccggctacagggacacaaggaacacgtcagcaaattgaagcaccaggttctgtctttgttccttgttggtcataagataatgaggctggaccagaggatgggacaatctgggttgtttttctttttttaatcaccatatgcccagctcccaagccccatgcctggcaccttcaggggtctcagaactataggtcttgccaccccctgtgacctgtgggcaggaacttcatctccgtgcaaacactcaaggccctcctcggcttgctcctcccttgtcgtccagccaggaaagcatcagagaaggcttcctggaggtgtctgagataaggctgaaagaacgaggcaagtagccaggtgcagaaaggtcaaaagaacattccagattgaggaaagagccagatatgcagatgaatgtgtcaggttccagccccaactgaggcccaaggagggtggatggatggacaggtagctgaaaaaacagacggggggccgtaagcaggtgaatatggttttactcagcagctctctcatcagcagctctcatacactgtccgttctgtctcagctgcttgagccagctgctcccacgctcagctgcacggccagctctcccttgccttcagggtcagcagcttaactctttctctctctgggcacaagcgtgagccgtgccatgccgtgctgtgccgaaccctgccctggctcccctctgtccatctgcaagatggacggctctggttatccctctcctctctttctctgggtgccagcagctgcacaagagtcatgtggagccatgcccaagagcccccgtacagtgtcagcagggcagttataccttcccaaacaatagtggctccaagccaagtatgaacttacacaaacaggttatataacaagtggagtatgcacctgtgcacctaaactcactgagtcattctggcctggatgtttgcctcggcctattccttgaccaaagcacatccatgtaccttacagaatgtctcttgcttttccctagtgccaggaataggagacaactttccatccttctgcctcctgcccagagtgcccctgccttctctggcagcctgaaatgccccctccttggtgccccctcaggactccagctcagtcttctatgtttgctattttcaaaagaatatctgtgagccctcagccagaaagggtgcatgtggaatagggaggactccaagcccaaatcccaacaggccgttgttaggagtgattgaaaatagtgagggagtcatggaggggtggggggcggacttacctggcagttagggaaatagaaggctggtgcgcttgggccagggtcctgcagggcactgaagaggcaggggctgaagggtgtgggaggcgccggcaggtaactccttggtgcaggtttgggttctcctggaagcaggtctgagaacgagttaggagagcagaagtttcaatggagaataacacatggaaagtgacaaggatgggagaagaactgggcaggaggagctatcaggccacagtgcccctggcaaagtcttggcaagtccaggggagagctctggagaaactcaggagaaactcatgcattgcaggaggtcccccactggacagaaatggctgggcccttggactgcctccttgctcattcataggctgggggtcactctgaaacagtatcacccactttatgaacatatatacaataggaaggttaaattgaagctttaagaaaagatcagaattttttttttaaattttaaagttccaggatacatgtgcaggatgtgcaggtttgttacataggtcaacatgcgccatagtggtttgctgcacctatcaacccatcacctaggtattaagccctgcatgcattagctattttttctaatgctctccctccccccaccccaccccccaatgggctctggtgtgtgttgttcccctccctgtgaccatgtggtctcattgttcagctgccacttataagtgagaacatgtggtgttcggttttctgttccggcgttagtttgctgagcactgttcacagtagcaatgacatggaatcaacccaaatgcccatcaatgatagactggataaagaaaatgtggtacatatacaccatggaatactatgaatccataaaaaggaatgacatcatatcctttgcagggacatggatggagctggaagataggaaattttaagagaaagaagagagattttttgtttcaggaaattctgttaagggctaaacattgcatttgtctgagagcttcctggcagccatggtgaaaagagaaaaaaaaaacataggttatgaagttatccttattttataatggaaaatatgtatgtcatgaaggaaagaaatagttttctaccccagaagtctagagttattttatcacatagatgttgcattttgaactttgaggaaacagtagaaatattatacttaatgcatgaaacagaaacattgctcattcagctgcttttctcatttacccttaataaatgctggggagagcattaaattatagttcataaaaaaagatattctgaagcagtttttagtaccctgctggaaataacactccaaagccttcggaagggttcttgcttcttggagaatctggagcaagtttaatggcatttgcttaagaagagcattttcacacgccctgaggggcggagccatgttttagggatgctgcctgctgtgtctggaatggactgtccgcaggagccagcacaatagccacctttccctgtgggaggaagaaagatcagagcactgagcattgaaatctgtgtccaaaagtgcaccccatgatctgattattgtgctttccgggatctaatcagtcagcccgccttcaagcacacattcatagaggtttgcacaattaaggtcttcatttaaaaaaaaaatgatgggttctctgaggctggaagtttgcagtgttcaacatggaaaaggcataaatcatgagggtgggtttgagtcctggtaagattcactctttgggactatttccactcaagttttcttgtatttcagaggatcacatggaaggggccttgcagtcgttaagctcaatccttcttttcacaatagcatggactgcagggcatcctggccaagtgacatcctactggtctccggacacctgcaatgaggatgaactcatgagccaggcaaacaggaggtgcttagtgaatattcagcaaacgaactccagtgtgggaagctccgagccatggttgaatgtatatgatatcctgcaattattacaacagccattggaggcaggaatgataacaaaagatgaacagggacacaactgcccaatgttatagacgggtttgaactctgggtgtgctctgccttgcgttgcggacagtcaagagacccacgttctcagcttttctcccagccagctgggtgatgttgagcaaatcatggcatctctctgggcctctgttttcccatttttaaacaagggctttggactccatagtttcaaaggcccctgccaagttccgcccccagctaaggtgtgtggctaggaggtgggacccgtccctgcagggcccagcattagacatgatggacactctaatccctgctgaaagtccatgtgtgcctctgtttgcagccttccaaacgttcttgggtaaagcagacatttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcagtgagtcctggggcccggtgggcatccttgcatgactggagggatcagagggtggggaggttcagggcttgggccccggacgcccaggttcaaatctcagttctgtcattgccacaaactctatgctgttaggtaaccatgtaacttgactgatcctcagtttcctcatctgtaaaatgggatcacataatatggaaagacacaatccatgcaaagtgttcagttcagctgctagccacagagatatcctataataaatgctatcactaattattcctagacatgtctaaaagttatatttctttaaaaaattgatattaggaagtcagaagtgagagacattcagatgattttcataaaagtactcttgactgggctgtcttcaactcacaactttggcttgaaaaaaacctcaaggctttaagtaagaaatgttctggggcttgagctgctgcaggcagggaagtctgaggaggtctctccatgaggttccccagatgcttggatgttcacagcagtctcctctcccttgagggcactcaaaggtggaattcccagttggagacttagggaggcagagtctggatctttactgttactgttgcttctgacaaatggagtgggttgcctctaggggtggtgatctccccatctatggaagtgtgcaaataggctggccaaccacttggcaggggagcgtagaggagattcttgcataaagcatccaaactgcctctgaggtcactcatgtcacttgggaggagactgactgaacccagagagagggagaaggggcacccgccagcacccttccaaagggccccagtaagacagcttgcatttatactaaataagcgtgagaccagcaccccccaaggcgggcagggagggtgtttgggggtgtctagggaaggtgatgtgaaggggagtcattcctgtccagagaaggaaaaacagcagcatagaaatctacaaccacagtgttgttccacctcctttcaacaactgttggttctattttcggaaacactgggatgaaatgagatcaccttgcttcttgcttttacctttctccttggtctggttaaagtcagcagattgagcaggcgcctgggtcagtggctgtacctacattaactgagtgatcctgggagagtcctgttgtctcttcctgttgacgagaccgaggttttgccagacagtctgaaggaggcgctgcttgttctcagagagtagagaggggaagtgaattgtttcttcaagctaacacctgaagccttaaagaccgaatatggaacctgtagtgaatgaggcatttacactgagaaccatcagttctaaacagaattcaattctccacagggacatcatttttccatttgcatcccccgtataacttcattaattcctctatggtgtacctgcaagccgcactgactaagcacctgttgaaaaaaaatctcagctgctcccaaagccagcagtcatgaggccccatcctcagagtgttctgccctcccatgttgatgatcttcaatctttaagtcgggataatatttccagctgagcgtgctttacctgacctggagcagagctctggaccaagagtcagaggcctggcttcccatctcagtgggacacaaacctgcagtgagaaacccgggccagctgctccccgtcacttggcctccacctactgggctgcaaacctcatcaagtgcacatgcatgtagcactcagagtgggccaggagctgtccccatggctgccctgtgagttaggccgcactgttaggcctaaagacataaagaaacttttccaaggtcaaacagtgaggaatagtaaaaggatttgagccctagctatctggccccaaggtccccctcagagcacccccatgcatgtcactcaggctgtgtccccaggccatccctaggcagccatggggacaagtcttcttccgtgttacatacagagagacccatgctgtttagtggcaaatgccagcatcacagccacactgtggtccagctctcccctgtacctgctgccttgtcatccaaattcacgggacaaagagagctaccagcactagcaggtgtgactttttctgtgcaggcaccacccctgggatccaaaacttcagctgccttggaagacttgctttgtcttcttcattatcccagacattatttgggggacatgacatgtcactggagacatccgtaaatactgccaggcatctctgtgtttgtcattttattcaagccccaaacagccccacagggtaagtggtattgtccccattttctagatgaaggacgtgtgactcacagagggtcaggcattgcccaaggtcccaggggtggtgcctgcacagacaaagtcacacctgctggtgttgggtgcactccctggacagcccacccagacactttgtaccaaacttgcatttctcagcctcatatctgtgtacattttgagctggaaaattcattgtcatgggggctgtgctgtgtgcctaggctattcagcagcctccctggcctcttcccattaggtaccagtagcaccatctgccccaccagctgtgacaaccaaaaatggctccagacactgccaaacatcccatgggagcaaaattgcccctggctgagaacctctgtatcaagcaaacatcacagatggctcagtatatttatgctaaggagctgatgaatgtttttcacgtactttagaagtcactcaaaattttgctgggtgcagtgtcttgtgcctgtaatcccagcactttgggaggctgaggcaggcggatcacctgaggtcaggagtttgagaccatcctggccaacatggtgaaaccccatctctactaaatataaaaattagccaggcatggtggcaggcacctgtagtcccagctactctggaggctgaggcaggagaatcactggaacctgggaggcggaggctacagtgagccaagatcgcaccactacaccccagcctgggacacagagcatgactccatcacaaaaaaaaaaaaaaaaaaaaaaaaaggaaaaaagaaattattcaaaagttgggataaccaacatttatttatttatttctaaattcctttttggtgttggatttttttttccctctgccttacacaataggctttcaaattccattctctaaaattagacctgtcgcttaaagtgacttattttaggcagctgccttcctttcgagcagtttgtcctcagcatgaaaaccaggcttcagtgtgagtgtcagtctgttgccagtgtgaaagaggctcctggctttaggcccatccccgtccccattgctggggtggccacagcagttcctgcccctccactgtgctcccctcacctggagagagctattagtgggtctccatcctgggagatggaggctgcatcttatcaaccctgtgcctccagcaccagagcagcccatgccacatggtgggcacctgagtgtctgggggagaaaaggaggtgagggcaggagatagggagttcttgggctgaaaattggatcaataccaattgtcaagcccagtgtggggaagccttcattttcttgaaccttcccttatcttccagaatgcccagggtcatggtggttctcttatctacttgggatgacccttccttccttgggattccttctttcttaaacacagaagccaatcatagtcacttccctgggcttcagtctcccatcctgaaaaatggggatgataatactcagtttgcacaactgctgtgaggaatctgtggaattatgtaaaatatctcacaggtggcagctgctcagcttgcatgaatctcctcccaaccttgctgtcatcagcacgactgtttctagcattgttttctcctctctcaatgccatgcagtttcaaaatctgctgcttcctgatatgcagtcttggttgggaaacaagacacccaagtgtgttagaaatagatgtaaaagaagagcaaagaggatcagagtgccagctgtgaatgagccatatgggcctggtgacattggttctgggtgctcaccggcggtggactgctgcctgggtctttgcacttggtgggatacccatgcattacagggttcctggtgtgttcctctaaccacttagttgggaaatcgttgtgtactcctcccttccttgctagactaagaggtcttctagggtagacgaggacctgtgttgtctgctgtcaccttagtgcctaagagagtcccagatttcttacgctttctctaaacagttgagtagaagggagggaagggaggtgactgggaggaacaaggggaaggagacatgaaaactttagatgtgtttacagaaaactgtggtactttccccctcttttggcctggaaccacatgaaggtccatctgatttgttgaaccatcattaggagttctggagcccaaatcaagttttgtacaaagtctcaaattataatttcagaagcagttattaataactttggttttgaaaagattctcctgaaatcacttcctagatcaagttggaagaatctaaaatgctctgtaatcataaaagtggagaccatctcactgcagcagtttgctatgtcctgatgaacagggagaaagctgagaagagaccctccatatggccaccctgaactgtggtcaagagtgccaggcttggggtcatctgcctgcatgcagcttgcaacattgaacttttgagttatgggatcttggacaagttgtcatgactcctccgtgcctcagtttccccagctgtagagtggtggtgaagatagatgaaaggatgcatttaaagttcagcagctgggcatggtggctcacacctgtaatcccagcactttgggagcctggggtgggcagatcacttgaggtcgggagttcaagatcagcctgaccaacatggagaaacaagtctctactaaaaatagaaaattagctggacgtggtggcacatgcctgtaatcccagatactcaggaggctgaggcaggagaatcgcttgaacccaggaggcagaggttgcaatgagctgagatcgcaccattgcactccagcctgggcaacaagagcgaaactccgtctcaaataaataagttcagcatggggtcattcacataggtggtgctccataatcttagctattattttgttgaaggagccccacactgagaccaccagggaggctatggttccagcccacatcctctgacttcccagctgtgtagtcctgggtgagacacttcacccctctgagcctcaatcactcatgtcagagttcaaagaagaccaggccagaaaggtggtatcattcattgggctaatggctaggtcagtgtgaggttagatttttatccgtaagatgagaagcaagactgggtgatccaacactcttagaaaagcttttaaaagcaagcattttctggccactcttaaaatttgagtccttactttgtatgcttctggatttttataaagaaagacagtggaggtcagagaaggaagcagccttttactgagcatggaccggctgttgggcatctagatatgctgtccagtttcatgctcacatgtgctctaaggatataaagcaaggccggggtggttgaaatctgcattcacgttctcaccaccatagcaattgctggggtcaaatcccttctgtccagcccacagactcccgtccctcccaagaataggagctcacagagaggggacgttagatggtcaattgccctgccttggagattcaaccaccagggaccagagcttcaagcccagctaacccttcaaggccagtgagtgacccacaggtcctgttttgtgaagcgtaaggtgcgcagctgtagtcggggtgcaactggtcccagtgagagatgtgggagagtcagctcattcctctgcctccactgccaagctgaagcaaagtctgatgagaatgggagctgacatttgcttggggctgtggatgaagcagctctgctgagagagagtgggcttccatacattgccgtgaagcacacagcctgcccttggtggagagggtcttgctttgcttggcagctgccggtagtgattcatccctggtgctcccatttcctctcacctctcgggcaattccacttgccctgctccataggacttagcaccctcccctagcatctctggaaggaaaacagattccttctcacccagaggtagcagaggacagtagaaatgtttgggatgatcagggctcgatctcagctctgccactcatagctgggtcacccttacctggctgagcctcagtttcacatctgttaaatggagcagtgatagctccctcactgggctgtgctgggaatgcagttacgtcatgtaggggataggtttggggatttacaatagataagcccccttcttctctgaaattcagaaaaggttagagagggggagacagagagaggcacaagaaccagatggggatgaaaatgttagctctattttgagtggagctggattagacagcatggcttcataagtggcagttagttcagcacctctagctttaagatgctagacccagccacaggcagaaggagcaaccccagacccctctacagggcaagcccctccttgggtggaggcagcagacacgtctccagcttcctgcaggaggcagatacagaaagagcccaggggatgcaagagggcactccctacctccctgtcccttgggttgagagggaggtatgttccctagtggatgctccccaaatggaaacaggaaatagaagggaaaggaggtccctggaaacagtaggtgaggcatcggcacagttcctggaacacagtgtttaataaatgggcaaggtcttctctgtcttctgtacttcaagatagatcctatacatcaccatttgtctgtggcggccacctctgtgtttacaactctctctgtttctctctttatctctctctatctgtttctctctctctctgtctctctctctctctctctctctcacacacacacacacacacacacacaaacacacaggaaatgcataaaatatattaattatatctttatccagtatatattagttttctattgcttctgtagcaaattactgcaatagcttagctattattttgttgaaggagccccacccacatggtggcttaaaaccacaccaatttattatcttacaattctggaggccagaagtcctaaaatcaaggtgttggcaaggccacattccttctggagactccagagggatcatccacttccttgacattcccaacttctagatggcacctgcatctctcggcttgtggcccctttctgcatctgcaagtcagcagcatggcattttcaaatatttcttcctctctgacctctgcttccatccttacgtcttctctctgaatctgatcctcctgactccctctttaaggaccctggtgattacatttacagctcacccagataatccaggataacttccccatgtcaagattctgaacttaacatatctgcaaagtccctttggccatgtaaagtaagatgttctggggttcccaggattagcatgtgaacattttgagagcggggggctgttgttctgctcaccacatccagaaagcataaattaaacccatactctttgtcagtatcaccttgttctaggcaaaagtaaatgggatgtttactcttatggacccttgactgatccttagacatgctgctttcttagacatgttgggcatccttaggcatgcccaactgtggagggggcaaaaatgattatgtatgttacactttgtctctaaaacactatgacgtgagttaagaatgagagcttcagggcattaagggcagggacttgagaagacccaaattctttcctgctgcccttacccccacacctgccagctgcacagttcttcaaagccccatcccacaagaaggaggctgaaaagagacccagaggtgcattcctagcatggcatatgtgccactgtcagatgctcttcttttcttttttttttattattattatactttaagttttagggtacatgtgcacaacgtgcaggtttgttacatatgtatacatgtgccatgttggtgtgctgcacccattaacttgtcatttaacattaggtatatctcctaatgctctccctccccgctccccccaccccagaacagtcactggtgtgtgatattccccttcctgtgtccatgtgttcttattgttcaattcccacctatgagtgagaatatgcggtgtttggttttttgtccttgcgatagtttgctgagaatgatggtttccagcttcatccatgtccctacaaaggacatgaactcattattttttatggctgcatagtattccatggtgtatatgtgccacattttcttcatccagtctatcattgttggacatttgggttggttccagatgctcttcttaaccaagaagcaatcacatctccatggagagacagaaccttctagaatgatacctacaatttgttatatgccaattataacaggtgctgtcctggatgatttcttttatcatcattaaaatttttacaagaaccctgaaagacgaagtattattacctttctttggagaacagagattccgagatgcaaaatcgcttgcctgcggtcacgcaggtcatgagagacagtgctggggctagaatccccactctatgcctccagaactgctgctcctgccacgctgcacggggaggctaggggcaacctgcgagaacagagttgtgtggtgaacaaggtcaacacaaagcacacaccgtgggggctggcggggctccggggcaggatgcactcttaagtttcctgagtgctttcttattttacagtgaactcaaactgtccaatcaaataagcttcagtgtgagcagaggtaaagctgaaggcagtcaccttcccactctatcagctgatgtagggggagggcagtggcttcgtgtcacaaacagattaagactggcagtgtgtgtgatgtacaggtctgccccggggcagacagggccagcccggcaggacccctgtagcccctgggcagcgggagaggatctgtggactgatttctgccttttggtgcatgaatgaatataagactaaatatggcttttattgctttattattattattattatactttaagttctgggatacctgtggagaatgtgcaggtttgttacataggtatacacgtgccatgatggtttgctgcacccatcaacctgtcatctgcattggatatttctcctaatgccatccctcctctagcccccccacaccccaacaggccctggtgtatgatgttcccctctctgtttccatgtattctcattgttcaacttccacttatgagtgagaacatgtggtgtttggttttctgttcttatgttagtttgctgagaatgatggtttccagcttcatcaatttccctgcaaaagttataactgtccctcactgaacttagaattttatgtacaatgactctcttcactaacctactaagggacatctatagcagtgtctctatggggagaattgaaaccagggaagacggggttgtgaggggtgagaggagccagaaggaggtgctggccacatcataagaggattcacattaagtgggacctagggctgggagcctcaggaccatgagctggtcaggccatggggatcagaaccacggctgtgaataacacaaatgtcagacaccttcacatgggtgacagcctggcagcctgagggcattaagagggtccctagagaacgttggccattgaaaatcagtgaatttggctgatgattaagaaaggctgttacacttctggaatccaaccctgacggtgcactggggatcatagttaccttctaaaggggaagcaattgtataaacatattcaatggacatagagttttcaggataatgttataatgtcagcttctgtcacagccctgagaacaataggaattagtggatttattaggcactacctctgtacaccatggatgtgacagcaaaggttcaggctaacgatggagtctaacgttcactcaagtgagaaacaggtgcagaacatgaaggttcttgttttacacgaatattaaaacctgtttttgccaatagatggatgtatccatgcctgcaagctcgaagaaatgggtgtcgtagttttcactggcatctcttggtatgcccataactttatggaggtttactttcttcacaaaatttaaccatctgtagatataagtaggtcctatatcttccccccaatgcatgaataatttttgctaaaaacatctggcaataaaacagatctatagaaacaagagcttcatccagaaacaaagagcaaaatgcgagagtgtggccagctaacgttggacctgacaggttatgagcaatgtgctctaacacttctgctgaataagtatcaaactgttcataaatgttcataaggtcctttaatgcagggggtgtccccatcagaattcatcagttaggacaatgtggttttctatcattcagcaaactcttggttttaaagaaatggctgggatggggagaacccagacatcatttgtgtccaggctaaaatcctcaaagtgaatactgaagagtgacaattctcacccagttcctgacacctcatgggacaggcaaaataagcatggtcatgttcatttgactggggaggagtaggaatctcctcatggcagggtgaattgcctgaggtcacacagctagttcaagatggagccaggtctccaaactcctaatcagttcttgtctgatgccatgggcatcaattaggatttaggtctaacctcatgtggcaggtaccccaacagagacctcaacaagatggaaggttttcagtctcacatgaaataagttgcgagggctggtatagcaactccaagaccacacatcctggttttcccaggacacactcaatgtaagtgtgtcatcctagcataattatcaacactctcaaaagtcctcatgtttggataataaattacagaaccagtgtagtcagtaagggcacaggctaactctttctaacttcctggtccagcatctaaacaagtggcttttatcccaaggcaggggctctatgtatagttaaacaggttgtgcattacccaactctggggaacatctttcaccttgtatgcattgtggatttactatggcaatttttcagtggatgacagtaaagcgttttgtgtagtggcgaccttttctggttctcataaagttacaatggaggttaatggcagtgctgttctgaagtcacctagtaatccaaaaaaggctgctgaggctccagccatcacctccaccatcctgacacagaaagaaggaaggacaaacaaaaatggaagcagacctccttgatgaaaagttccttttaaaaaaaggaaacttcccggaagccccaccaacattactgtttttatctcgctgccacacttggctgcaagaaaactgggaagtgtagtcttttagctggacattcccagtaatgcaggagaacatcacacaccagggcctgttgtggggtgggggtagtggggagggatagcattaggagatatacctaatgtaaatgacgagttaatgggtgcagcacaccaacatggcacatgtatacatatgtaactaacctgcacattgtgcacatgtaccctagaacttaaagtataataaaatatatatataaataaaaaataaaataataaaataaggaaaaaaagtaatgaagaaagggagaaggtgggatgaaaatgaaaaatgagcatccacgcctctccaccttgggactctgagtttaatccagagaccacctgatacccaaatttgatttagaaaatagattaagtccttccactgaccattctctctgctcattctttcctgaattacagatttggttctataccaacagcatctttggaaaagctgggatccctccggcaaagatcccatacgtcaccttgagtacagggggcatcgagactttggctgccgtcttctctgtaagtcaactgagggttactcctgagaatgccacagggggttacacagcacagtgggaatgttcataaggtcctttaaggcacaggctttccccatcagaattcatcaattaggacaatgtggtttcctatcattcagcaaactcttggttttaaagaaatagctgggatggggagaacccagacatcatttgtgtctgggctattgacccaaaacctcaaagtgggtactgaagagcgacaattctcacccagttcctgacacctccggggcaggcaacactgcaatgtgggaacctcaggcaacaaacaggcatctctttagaggagcatgtcctttatcatgccaaagggggctggattttaggaggtcatcatgcagctcttcactgacattttacccatctagagaatattcttcactgacattttacccatctagagaatatttccttcctagattttgcttccctgtcatcttccttttaataaataactccatcctttgaattctcacctagtcacaaatgatgaaatatgaatgccctgtgaaacagggccatattgtccccaggagttcggatcagagaattggcttgaatctccaatctcttaccatgacatttaaaatgtttcaaaaccattagcagtcatctcattaccccagacatgtgggagtttgcaaggcaaaggagaaaggacattcagttgaccagtataatagagaggaagaccttaataataagccaatatgttcaaaagaaggcatagagctcctcactgtttctcaacctccaatatgcaaaacaaacatctggtggaggggaaagttgggtggcttcagaacctagtagaaatttccagatcttggaatcagatcaaactggatttgaatcctggctccggcacttcttggctgtgtagcactgagcagtgcactcaacatctctgagcttcagttgtcctctttatgaaatgcttgtgtctcttcttttttgtagctatgtctgtgcctcacattttgggcacacagcacacagttaggctcccttccaaatggaaagagacggctaaaattagagagttatattctctgaccttgatggagtagttcatttattttcactcttgctcactgatttgcactgacaagattgatgcccatgcaaacaggcagaggcttgcaattgtctttctgacttcttgttgacagaacatttcattttgtaccttgcacttaatgggtcattctaacaagatgcttttaaaaaatagataccataaaaaatgtagaggaatgatgttttgtctctttccctttccactttgtggtctttttattagaagaaaacatttcaacgtttcacattctggaagtttcacaagattcattcttgttattctcaagttatagactgcacccagttttgtttatttatttttactttgagcaatggaaaaacacagtctgagatgaaacttatgggggaagtacgggagatgttttttgttttttgtaaagtattttattggtgttgtgaagaaatcaataccagctcattagggcaaatttgtaaaattcggaaaaatagagaggaacaaagaagaaattacctacaatcatactacccaaggaagtttggcaaattcttcccttgtctttctatgcatagatgtatatttcttacatagtagcacagtaatcctattctaaatacgagctctgatctgcttttgttcacataatcttatgtcagaatgactctccattttcttatttattatttttttgttgaagtgtatcatatatgcagaaaatcatgtagatcatcaccttccctgaattaacactagtgctgaacgatttatccttctccagtaattttctgtatgataatttccttaaccattgtctgcgggtgaggttgttgaatgtctctgctcggaacctgatggcagtgccatgctttctgggttccagtcccagctctgtgtctttttattagccgcgtgacccccaagtaagttattcagcatctctgtgactcagtttccccacttctaaaagccatcatccctgcttcatagggatgggctgaggattgtaccaatgaatatacattaagtgattccagcagtggctggcaaatggtatacacccagtaagtggtaactattcttgtcctatttaggtagatttccataatgtgtgattttacataaggctacgatggacatccttgtggagagcaggattttacagggggtcttgctatcttttgacagttgaggaaactaagaccaaaaggagtgacttactctgggtcacacagtcagctggctcagaacccaagagagtggggaaagagaacatcatggggcccctactgtccctgccaccgacaccccaaagtgttctacatgggacctcatgaatgctcacatcatgcctgaaagtccaatgactgccattgtttgaaagaggggcacactgaggaagtggctacacttcttcccttggtccaagaagacttcacgggaagccattcttattcattccagactccagaagccactccttctcatcccgatgctctggcaggcagatcatcttccttaaaagctgacaattttgggcaaagtattccttggaaaccccagaaaggagggtaaatgacttcacagtcctggaagggaaggaagagtcctttctaaaatcagaactcagagtctcagcctctggagagcactcctgccactgcctttaagtttggacccagtggatctcagtcatctggaccatggccagttggtaccccgccatttagcaagctcttgccagctcctcccatggtcaggctgttggccctgtgctgggcttacagagggcctttgccatggtgcctgcctgtaggagctcacagtccaatggaggaggttgactatgacccaaggataaatgatgttttgctgttctagaggtgcaggaatctctgtgtgggaggttcctctgagcaggaagtgatgattcagagcttgggtggtggattctttcatgcaggcatgcattcatccattccacagacacctaaggtgcactcatactgtgccagctgtcacaggtgacgttgccgtgatctagagagaaaagcaaacctggaaacaattaccacatgcaacactgagacgagcttccctctcaaataaggggttctgggagggattcctggagacagggaccaggaacctgagagctgaagggccagcagaagttaggtgaagtgaagtgcattgggtagtctgtccccctttcatcttctcaaagagctggagatgcaaggatggatgcagaatagtccattggaaacagtccttaaaatggtagcattgaccccaattcctggaaaggcatgaaactaaattcagcatgaggttgagagtgtggaatagaaaaatgttctggggagaaacagctttggctttaggatgaggctactctgaattcaaatcctgatcacccatttaccagctaagtggtcttgggaacattgcccaacacatctgaatttatttgctcatctgtaaaatggacataaccattcccacctgtggtaggcaaaacaatggctccccaagatgtccacaccatgattcccagaagctgggaatatattaccttacatggcacaaaggaatgttgcaggtgggactaatcttgagatagggagctaaccctggattacccaggtgagcccaatattatcacagggtccttgtaagtgaaagggggaggcaggagggtcagagtcagagaaggagatgtgatggtggaagcagaggcaggagtgacgccattgccagctttgaaggtgaggaaggggtcacacgcccaggaatgcagatgttctctagaagctgcagcaggcaagattctgccctggagcctccagaaggaaccagccctgcagacaccatcgtgtttgcactgcaagatctattctagacttctgatttccaaaactataagataatccacctgggttgttttaagccactgagtctgtggtaactcgctacagcagcaataggaaactaatacagcatctgacagaattatggaaacaaaatccaaagtgtgtgaaagccactcccctgttcctcacagagcatcaatataaggtaagttccttgcactttccaaagttatgtatatataaaaatatcatatttatataggttatatatataatatgcataatatattataatgtttatatattatgtatttgaaaacaaggaaataaaatatgtagatatattttatatatttattgatataaaatatataaatatataaaatttataatatataaaatatattttatatatttatataatatacaaaatatattatatatcttgaaatatatttgaaaagaaggcaataaatatatttatatatatacagttacatatgtaataaacacacaaatatatgtctatatatttcatccagccctttgaagtgattgcttatccaaaaagactttccaatttttttcattcctcttatgagattttgacagtctattaaaatggctcaggaggctaataaagttgagaggggaaagacatctttgctcatttgatctgcaattaattttggctcagggcgtcagtcatcagcttggggaactgtaaataatcgccatctttcagaaacagctggttttccaaattgatttgcctggcacagtgttaactctctgatgagtgaacttccagtgagcgtcattcaggccatgtggggcaggagctttgtggggtgagggctcactcttgagaagcacagactctgtgcttttacaaatcaggggtcagaattcacaggaagtcattctgattcactgcagtacattttcataattagcaagaatggaatatgctcttgacttgtagtaaaaaaaaaaaaaatccttatggtttctgttgcctgtagtctccattgcttcccaataaattcgacaatttcagaatcaaaggcctcagagtttactgctggaactcaggacactggatccagcccgtgtgagagcagaacgtggtaaaagggagaaagcagggtgatagatcatctgggctctgtttcatactggccccgcagctgctagctgggtgaccttgagctagtcacttaacctctctgatacccatttttctcttagtgaaagtggcaataataacagatctaagcctcagcaggtattgtcatgggaatcatactgtaattcacagtgcttggcatagagaacatactcaataaatgttcactattgttatgggttgaattgcacctcctcaaaatgcatgtgttgaagtccctagtacctcggaatgtgacttgaattggaaataggatcattgcagttgtaattagttaaggtaagatacggttatactggaatagggtgggcccctaatccaatacgactgtccttatgaaaagggaaaatttagatgcaggcatacacacaggcagaacgccctctaaaaattagaattgtgctgctgaaagccaaaacacactagaagccaggagagggccctgcaacagacccttccctggcgcctccagaggcagggccctgcagacactttgatcttggacttccagcctccagaactgtgagacaacacgtttctattgctgaagccgctctgtctgtgggaccttatcacggcagccctgggaaactcacgcagttactcttgttattaatattcctgaagagaagcagacatggaaaatgccgaagctgccctgctacctctcaaagactagaagacgagcccaaggccaggatgcttcttcctccagcactcagcaagtgctcacttgggcccctgctctgtgccagtggacaaaacagacaaaggtctctgctgtggagaaggagagctcctcatggggtcacagacagtgtaacaagggagtaccccacacagtgttttagaaggtgaaggatgttatgagaaaacagtagagcagagaaaggggaatggagagacgggggcagttgccattttaaatattgtggtcaggctccaggtgagcccagctgtctgggaagagcatgtcaggcaaaagaagctgctgaaagaaaaacctttgggaaagagggacacagtgaacctgagcagctcgaaggcagattaattcagggcagccgagggcatgtagggtgggtacgccacctatcaggagctgcaacctttgatagagggacaaagccaggcaaaatgtctctgtagaaagtgaaccaagaaaccaacccctggcctcattctctttcttttgccttctgatttctgacctctgatttctgatttctgctgaagccgcctagaggtcagagggcagggagcttgttgatttgagccaatgggtctccctctaggacagacagcaagaatctgagaggtgacagggatgtctgcagcagcccaaggcaggggcaaggatgtggctgccgcttgaggggccaaggggctggtgggggggcatggggcttgaggggattcaaatatggtttgcaaatcttttctcccattttgtaggttttctcttcactctgttgattgttttctttgctgtctataaggcttttagtggacaggggtgttaaaaggagagtgccaggtcatgctttaaatccctctgactgctgtagacaaaacagataatggcagagggtgacaagggtagaaacagcgttgtcacaaggcttggagagaggccggttttccctgtgaatcatcacactgacatgtgctctagaactggcctcgaaaggactgagttcaattaatttcccttgacagacattcctttttcattgataaataatgattctatggcatttctataggtcacagactagaagaaactacacccttcctccactaaaatactagatcaagttcccagtttatttaacaaatgttacaggaccttaggagaaatgagggttgtagcaagcagaaacaaagctagattttccccttggctcccaacccaaacccctgggggcctgagctcagtctgagctgggtggcatccccagatctgagaagttaaaactcaggctaaatggcttttcatgttcagagcttagatcaaaaacattagtgttaccattgcctgagcaggaagcaggcagagaaatgtggactctcgttgatatggtttggctctgtgtccccacccaaatctcaccttgaattatagttcccacaatccccatgtgtcatgggagggaccggtgggaggtaattgaatcataggagcagttaccctcatgctgttctcatgatagtgagtgagttctcatgagagctgatggttttataagggacttcccccttcactggacactcattctccttcctgccaccacatgaagaaggatgagtttgcttccccttccaccatgattgtaagtttcctgaggcctccccagccctgtggaactttgtcaattaaacctctttcctttgtaaactacccagtcttcggcagttctttatagcagcatgagaatgaactaatacttctggttatgacaggttatcctcatggggtgaggactgggtggggatgaggaagggaagaaacagagtcagtgccccagcatccccaagcagaaaaggtggggttttgccctggaagcacattcccctgcagtttccactcccacccaccccaagctctgaataatatcttttaagtaagtagctctatttttgagtttggccaaggacatacccacaagtccgttcctgcagctcaccctctgactcttgggatgtgctcctgagtctttacttcccaccaaattttcctgatttactccccatccctctgataacatcctttggctcccctgtgtccggccccaccagcttcactcaccaaaggaaagtgcggatgtggctcatgggatgcagggtggagacagcatttaccatccccttgtgtcagttctaagtggcggctgttcccactgcccactgccctctgccaactcgatgctcctgctatggaagccctgactcctaagtcatctggacatccagtgtctctttctctgctccttgaagagctatttttttttctacttgcccaaatttccaagaacaatatgaatgtatcctcacaaacctgttgagaaccacattttgccttttttgagaagagtaagagcatgagggggagtgcttcacttagaaactgcaaaagctacggcctcaagccaagcttgtaaagtgacccaagtggaggagacgtccacaggactggagaacttggaaaagcctgtctgctgccagcctttccttccatcccagttggcatgggatggaaggaaaacccatgtctgttttgcactttggctgaaatatctcaagacattttaatttgttatacttagagatcatgggccaccctgggatgatcattatttaaaacacaactctcatttctcacacctttggcccaaacagatacaccgataccttttatgcacattcatcttttaagcagaaattcccaaaaaagtttgtttcattgaattatattccgtttttaacttagagagagcctgtcccaagcagaaaattgtttctggcactctgtcctctgaacataaattttaaaatttcactaacttgcaataaccacagctttccaaggtcttggcttctttttagagagatctgtgaaagtaaagattagcctttgcatgtttaaaacaggattaccagcagctaaaagtaatactggaatgtgaaattgcttttcatgtaatgtaccttggccttctgttctctgcagagggagctgcgtcagtgataatcacaccattctctgctcctttctcccatccttttgcagctaaaactttgacaataatccaacttctgactagaaagtcaccaattgctcatgtgccaagggttcctcaggtactcctccattccaacatgtcaggattaggaaacagctgtttgggatgcctgcggggtggccctcatctgggccacatcttgccccagcatttacatttctctctgaaagagtctcagttgtctgcaccgctttggctgagttattaggggaaacctcatagagttgctttaaaatgtaaatttgaaagagagaaagagagagagagagggggagggagggagagagagagtgtgtgtcatgcatcatgtttaaagaaatggccatagtagttgtcatgcattcaataccattaatggttgctcaacggagtacggctctagtaaagcctgttgaggaaatcacaccagctgactaaagagggagctcttgcctttggctgggatccctgcagggagcagtcagacaggacgtcctgagggaggcagagcccaaccaacagggcttcctcctggtaggcttctagggcccctgcgcacaatcagtccacacggcccacagacccagaagcatcaagccgggcaaggatggggattatgtaaatcagaagaatttaaaaaggccccggcctggagttggacacagagaatggggcatcttctacgaccaaaaggctcaccctggcacagggaagaactcatgtaggacgctgtagtccctgagaaagtcaggaactcctgccatgcacggagtaccgcatgcagtttatatagagagatatacacattgaatacaatatagacaatgagcaataaataaagtgtatataaagtaatgtatgtgaaataatatgaaagcacattacatcaaatttggacgctttaattgagataaatttgaaataaattaaattttaggcgatattttcttgccctccagctcttcctttttaaaatgttgtttattgtcatataatagttgtacatatttggagactaccttccttcttttttttacatacattcaatcatttagcaggcaacattacaagccctgccctccatcaggtgttagctccttgtgttggtttgcccaggctgccaaaacaatgtgccacaaactacgtggcttaaacaacaggaatttattgtatcacagttctcaaggccagaagcctgagagcaaagcatcagcagtgctcacttctcctgagggctgtgagggagaatgtcccgtgcctctctcccagcttccaggaacttacaggtgatcttgggtgtttcttagttggcagaagcatcatcccaacccctgcctcatcttcagatgacattctgtctgtgtatgtctttttttgtttttggtttttctgaggtggaatgtctcactctgtcacccaggctggaatgcagtagcacaatctcagctcactgcaacctttgcatcccagttccagcgattcaacctccctcctgcctcagcctcccgtgtagctgcgattacaggcatgcaccaccacacctggctactttttgtattttttttagtagagacagggtttcatcatgttggccaggctggtctcgaactcctgacctcaagtaatccacccattttggcctcccaaagtgctgggattacaggcctgtgtgcgtgtctgtctccgtgtccacactttcccttttccattggctcaaggacaccagtcatcatggattgaggcccatccaaatgatgtcattttaactgaatcacctaaaaataaagaccctattcccaaacaaggtcacatttttttaactgaatcacctaaaaataaagaccctattcccaaacaaggtcacattctagggaataggagattaggattccaatatttccttttttgagagaatgcaattcagcccataaagctccccaagggcagagactcctggctctgtcttctctgtgccccagtgccagtgctgttggaggctctcagtgacctcaggcagctcacacaaatgaagggagaaaaactttgggagcatgtgcatattcttttgataaatgtgaatgtgtatttgcctcagaaacactggggagaggaagtagaacacaaaggttaagagcaagactctggagccggagtgcctagacttgaattctgactcactgtgcaaccttagccaggttgctaaacctctctgagcctcaagttctggatataatagtggatgataacagcacctaccccaagaaaatgtaatcagagttaagttattaatatatataaagcagccggaaccattcctggtacatagcaaggattgtaacaatgttcaaacatgggaataaagacagcatgagattggcataagggcagccccacagatcaatggaacagaatggaatccagaaaacaaaaagttgctgaagtaattcaatgaggaaaggatagtcttttcaacaagtagtgtcataaaaagtagatatccacatggaaaaatgtgaatggcaacccttattataccatacaaaaaattaactcaaaatggaccacgtatctagacataaaagctaaactctaaaacttctagaagcaaaggagaaagttttgcaacattaggataggaaagatacagaatcacaaaccatttttcaaatgatacattggatttcatcaaaattaaaaactgtgactgtttaaaaggtattgttaaggagataaaaaggtaagtcacagacatggagaacatacctataaaacacatttgagaggggacgtgaattcagaatacataaagaactcttaaaactcaaaaataagaccaactgcccacttgaaaatgagcaaaatatatgaacacatgctttaccaaagaagagttccaaaacatcaaaaatcacatgaaaagatcttcaacattgttactgtcaccagggaaattaaaactaaaaccaacagtgagataccattgttcaccaaaatggtgacaaaaatttaaatggttgatataataccacgtgttgccaaggatgtggagtaacaggaaggctcatccactgctggtgggaacataaaatggcacaaccccttcagataacattttagcagtttcttataaaggttttacccatccaactcagtcattccacttatacatatttacccaagagaaatcaatgcacaagtctacatgaagactcaataatcataatggttttatttctcagagctgaaaattggaaacagctattgggtcaacaggtgaatggagaaacaaattttggtatatccatgcaatggaatactgatcagcaatacaaaagaactgttgatatgtactacaagaaggatgaatctcaaaaacactgcaataagcaatatgaaatgataaatcgaatccttgtgctggaaagcagatcggaggttgcctggagttgggggaagagacacaagataattctgggaagtgatggaaatgttcaatatcctaattgtagttgtggttataaggtatatacatttgtcaaaacatacaagactgtgcaattcaaatgggtacattagactgaatgaaaactacacctttataaagctgcttcttaaaatcctaaccagaacaaaaggttcccattattatttcaccagaggtcccagccctgtggggaagggcactgggtgctgggtgaatggctgctgagtggatgggtgaccccatggctccagagtccccagaggggtttcctgggagcattaggattttgacagtcatccctagctgacatcagtagccttcagtctgctgttcgtctgagttaatgtcttcactcatgattttaatgtcaagtggaaataccacgttcgctctaatcccttccaacaggctgcactttaactggacttaaaggagggagggaagaagaacagagccgggagactgattgtcagatgggagggttgtttttaccccttctttctctttcaaagctgtttccctggtgtcttcctagaccatctttaaagatcatttctgaatcagggagaatgtgttcagcctttcattggctcaagttactggttcatcaagagactttagggaaacgaaacaaaaagccacatgtccctcaccccaccctttccaaagcatttgaacgtcagcatcatggtgtaggataatggttctcaactgacttttgtaagcacactttctgactctgaaattgtgggtggtgcacttgaaactcttttttaaaaacttcaaaatactgaaatcagtaaacatatatgttaatttccgtaaaacaatgtaacacatgataagcttagtgtaacaatataacacatattaatctcattataacaatgtaacatgtgctgatctccctatgacaatgtaacacatgctgattgcagtgtaataatatctcccagcaactgtgatgctcttccatggcacattctgttgtcatttcagcaccaggtcactggatactctaatccaactcccctaagaagcttaggagacagagttcctgcatattccagttatgaacaaccttcattttcagcaacagcttaacttttggctctgtcctgttagccacaagaaaagctgtgacatctttagattgtaccaaaaccatattttacacagttatgaaaaattgccagtatgggtattggaaatatttggtgatttggaaagaataaagacataatacaggggacagagatttgcatccaacacttcaactaaatctactttttggtgtttttaagtcaaaactctccggagaaaatcaggaaaactgacagacaaataaaataataatcacatattcccccaaccagagttagccattataaactatttctgcatatatttttccagggtgtattagcttaacataattgtaattgatattatataactacatgttttagtatatacagatttatgtcctactcttttcgcctaagattgtaccctgagaatttttctgtaccattttacaattctttaaactatgttaatttctacatatttaccatctagatattccagcatttatttaactaattgttggtggatttctagattatttctatttccccagtagtataaataacacaccaacaaagatcgttgtccatgcatctttgaccaaacatctatttccttaggatcaatgcccagaaggtgagtgactgagtccaagggtgtggacgtttgcaactgccccttggtgtaaaacagcatctatcccacttccttctctctgaatagttagccctgggtgacttttggtaaatcccataatcactcttggcctctgatcctgggcccagatcactgagagtgctacgccaagattaacatgtgttgcgctgagattaacatgtgttgcattgttacactgaaattagtatgagttacacagagataagcataatctctctgggcccataatttcataatctctctaagcccctgatatctctgggccttttctcctattacctttgcgggggtccctcctggcactaggacccagctcccttgcccatgttgcactggacctggcacagcagccccatcagtgtctcctctttgatgaaacccagctcatgagggcctaagaggaagggatgctttaaatgcaggtttctctgtgtctccctccctccctcactccctccctccctccctcattctctccctccgtccctctctgcctccccctatctctctttctcagaagctgttggtcattgcttccctcctgactctcactgggcctgacttccctccccacttcccaccaagtgaagttactgtccctcagtattcttgaacctcactgccctccccgccctccccctgcaaatgagaatcattctgcctgcgttataaagacagaccttccctccctcagcaaacacttacgccacacctgtcaggtattcttccaggctctgggaaagcaaagatgaaggctcctagccttcaagtgaagaaagagaatcagagagccaggaatgcggaggggggagggggtgggggggcagaaaagtgatcagtgcccttgttcgggtccgggagctggaccaggtgagacactgggctgttaccaagtggtggcattgactgtttctagtttaatgtcaagaaaatgtaatgtcacaacaacagaaaagattttgtaggtgatcccagctttgccacttaccagccatgtgaccctggacaagtttccaaagactctgtgcctctgttcttttacctgtaaaatggagcaaataatagaacctactcaaaattattgtcaggattaaatgagttgctgcatgaaaagtgcttaatacagtgcttggcacatagtaggtgctcagtaaatgatcattagctattggtatctagactaactccattatcatcagaaaagatgagaaattaagacatggaagggttaattaacttgttcaaggccacacagccagctacgggtaagagttgggaccagatccccagggcactccttagttaaaatgaataatatatttcctgccatttattggcaacctcttttgttcatgagtctatttcaggcattgtgagttctttcgctttatctcacagctaccctgcaaaaatggtattatcattctcattttccaggtggggaaactgagacttggaaaagctgaataacctgtcctgggtgcaaagaaggctaagtggcaaagccaggaattcagctcagatggcccatcttcaggcttttgtgcccctggatgtcacctgtgctctgttccactgggccaggtttctaggaggccaagtttaaaggcttgagtctgcccttcttccctaagcacccaggagaaaggcatttctgaccagaagtcttggatgcttttagagacatgtggtcatcagccaggcacattttcctcccaggcctctgactttcggggccagcaccctccgttcccctcaacattcatgcccaggtgactgagaggtccatggccccaggcagcactacatggccggggtgctcagctgacccacagggctatgcccttcggacaggcagctgtcactcacccctcagtgccggctctgcccagcagaacaacagcccatgctaagcttgggggagaacgcccattgcctagacggcttctcacctgcctccctctaaggagcagggtatgaggaaagaggaacaggtagagggcactggggtccctgcagctgggttccattgtggagaaaccctgaggctttggggaaggattgcaactgttcgtctcagtgctgtgaccttcgcactgtcacctgaagctggcaggcaggagccatgtgtgctctggcttcatggccctcagcagcgtcactgcttccccttgtccaagccaaatgactgtcgtgatggggaccatccagccccaaaaccttttcccccactaatccctctgcctgacaagctctccacatctctgtctgctcctgcctcctccaggaagcctcgcctgattgcctcattgagaaaagccatggattctgattcattctgggctcaatttctggccctctctcacctacttgctctgtgatgtctgctgttatctcacctctctgaccctccgtgttctctttttgtgatatggagcatgagaggaggatacctcacataatccgagtacctaacctgtgtgttgagtgcagtctcttatttaacacacccttccactccagacactcttgtggaaggatattttgattctcttgtcacagataaaggccctggggctttgggaagtgaagtgacatgccaaagttcgtgcatctggaaaatagtaaagccggaatataaacccaggttttcctgtctctgacattcggctacaattactctttcagtcattggcagttgaggagctgtttcctgaccaagtggacaaggggcacaggggccagccagatggaggtcagtgacagtcctaggccgagggaagctggcttcgaggacacagctttagggacttccccagggactccccacatcacatcccacaatgaaattgacttccccagacacaggcagactggaaaacgacatgggcttctctgcctactcccacccctgtgccccgctgtggatgcctacccctatgaaacccacaacatggagacacagaggagtcaccttccatgcaggttgcctctgaaggaggagaagggctgtggtgaccatatccatccagttccttctcccagactccctgttggaggagtccaccatagcaaggaagattcggaggagagtgctcgttattaatgctgtaggtgctcaagaattgtgactttctctccctcgctttttcctttctcataaagagcattgcttcagggctgtggccataaagaaggtggcccaactgtctcagggtcaaagccggtttttaatcatgatgccattgccggttcccagtgccacattcccctgttgtggttagaaatggaataatagctctctctctctcttttaccctggactagggtttggtcattgagcacctgggacggagacccctcctcattggtggctttgggctcatgggcctcttctttgggaccctcaccatcacgctgaccctgcaggtgagacgatgttcttgtcacatttgagggagataagcatggagctgacttctggcttcatcgttttggggcctttgatttgtgggttcatacttctacagaaaacacttgtgataaagctctccccggggacatctcatctctggagctgctgagggtctcagtgaagagggtttggtgaggggtccttggactgggagatgagagacctgacttctggtcctgtcactctcactgatgagccgtgtgatcttgggcaagacactttccatctctgagcctcagttcacccatctatggaatagaagagcttgcactagacaaccttaaggtgctccttccagctgtcacctcccagcatgagtgccaggtgctgcatatcagccacttccctagttgtcacaattttaggaacagtggctctggagccagacagcctgtgtggaccctggcttttccttacttgtaatgaaactttagcaagtcagctcctctccgggcctcatctctaaaatgaaacagtcgtcccttcatccaggggtgttgtgggatgaaatgagaaaatgcactgaaagcacttggaacaagcactcagtggatgtccatgaaggaggaggggtggcgatgtacttcatccttacaacatcagtatttttttgttttatggagataaggaaactgagggataaatataaataaataagcttcccaaggttacaccaccaaaaggtggcaattagatccccggatcctgggcttctgccccctgcatggctcagggcagcttgcattaactgaacactgcctcagtacctccaactcatcttggtgccatgggaagcgtgaagcaaggttgcagcaattgattaatctttgcatttttcaaaaatgcatctggaaattgataggtgcacattttgatcacctgtcaaatgtcttagtggcccaaatgtttctagaagaaggcactgttagcatggtggtggctgatgggtgccctttgaagaggtggggctggcaagcacgctgaccggcaggaggtggaagcattgccttcagggacaatgtgctggcagatgcagttccttcctgacagccaggcccaagctgtcccaagctccagcatctttacagtccttcaaagttctcaggaagccagttaggcgatgttccaggccattgtctttctgaaacttgtgtccgaagtttaaaaggaaagcctgaagcccacaaaccccatctaagcctcatttcacaaggtttcagagctgttcttggcttggccacccttgtctcctccagtgccccacaccctgcccccggcagctcctcaaggaacctggcagtttcctctcctagggctcttctgtgcttggctagcttctccttgctttctggactcaggaggccttggacattcctggacacctcttcctgcaggaagcctccccttgcttccaagtctgggtgaggtgctctctcctgtgttcccataagccccaagggggaaccctgtgagatcacttatcacataccattgactttcactgttggcacatgtctctctccaaatagacagtgagtgagttgtgtagggcaagggcctggcatgaaccatatctgcatttccacctcccatcccagtgcctggcacccaggggcagctcggatcaatcagctgaattagtgagtgagtgagtgacttggtacagaagcaagccatacagtgtacaagagtccatgaagctcctctcaacccctaaagctaatggatttggacatagaacaaggggaaggagggagttccccattcctctgtctgccctctgtacccctcgccctccactccagactgtttgcagcttacccccccgccgatggtgccctcttaggattctatgcccttgtgtatgctgaaccccctactggaacctctttcctttcctttcccactgggctgactctggctcagcctacagagatgaacgcaggctcttaccttcccttcaagtcaggtggcctctcctggggcagccctggcacccccacagattcagaactggtgacactgtgttctaatgctcagctgtccagtctgctagagcaggagcaatcccaaccagcaccaagccacccaccccccggatgagtgacagcttctccagacatattccatgaaatgaattaacgcatctcacaccttgcaagatggcaggggtacaaataaggtcctttatgtaataatatcagaactaagataacttcttttaagcaaaatatagaagcctttaaaatgtatatgaggaaacattcatatatatacatatatatatatatatgtatatatatactttaagttctgggatacatgtgcagaacgtgcaggtttgttacataggtatacatgtgccatggtggttggctgcacccatcaacccatcatctacattaggtgtttctcctaatgctatccctcctccagccccccaccccccaaaacaggccccagcatgtgatgttcccctccctgtgtccatgtgttctcattgttcaactcccacttatgagtgagacatgtggggtttggttttcggttcttgtgtcagtttgctgagaatgatgaacttttataaatgtgataaagctgtgaaaattgctcatattgcctgatgccaactaagccctcaatcaatgtgagttattgatttatttaccacttcctgtatgccaggactatgtcaaactcatcacaggcttcatctgatttcatcatggctataaaataagcagatggagtgaccgaagggttatcattgttcccatgttatagatgctgaagctggggcttggggacatcaagtgacctgtccaaggtcacacagatggatggaggaggagctggggtgggaactcaggtcctccggtcacaccatcacctcctcacctgaccactccctgttctctcccaggaccacgccccctgggtcccctacctgagtatcgtgggcattctggccatcatcgcctctttctgcagtgggccaggtaaggcaccccaccctccccactgccccgcccagggactcatggcatcaccaagctggggggctctcctcatacagatggggaacccagagcccagaagaagcaaagcctgactggggatgtgtgtctgctgcctttcttttggcccgatttaaatgtagccgactgtctgcagtctatcccacagaaggtgaaaatggactcacctgaagatgagtgggagataatttcccaccacacagcaagagcagttcatacgcgggagggctctgatccagaggtgacactggtttgtgttgaatcaaagacaaccaagtcacagtctgtgcctaagcagttaccgtctatggtgaaagatgtggcaataatcatgtctaagacatattgttcattgattttgtgttatacttggctaagaacttgacctgtgtgagctcatttaaggctcaggacagtgccaaagaagacagagatggaaggtgacttgcatgagcgagtaggtggagtggcctgactgccaggcccaggccccaaccaccagcttacatggtagctgtgtgagtgtgcagctggagtatcccagcctcagtttacctgggactcacttctagccctgctgtttcctagccatgggtcagtaggagagacttcttctctttgttagcctcagtttccccatctgtacaacgacaaggatgcaatgcaactgaggaccctaccattccctggccctgtgtccacgtccagcagggacctccagcagagtccaaggtcagactgagaaggggggctcagggcagggtctgacacagccatgtgctctctcatgggatgatattcatggctgttctttggttgtgtttcttggtggatgcaaacagtaagtttctatcagaacaaagggaactgaacttctgtttctccctttgtgttgctgattctcgtaagccattacattccaggttctattgcattcatggtggatggaaagtgtccattcaggacatcgggatattataataagatggcaaggtggcaaggtgggccatggaatggttggggagggcatcaggtgcacatacatgcacacagcacacacacacacacacacacacacacacacacacacacacacacagtgctatgagggtggtcagaacggctgcaagaaaaagaaagcaagcacctcccaggcagggcagcgaattagaggatgaacacacagcacatgttgtagtttacagtggacgcgaggagtaaatgtgtttagtcttccagggcatctgcatcacaacctcacatccacatcttcacatcagtgctctggaggtgtccagcctacggccctatgctagcctggggacatgcgtgagcaaaccagacaggagcagtctctgctcccagaggggcttgcctctggtgtggaagtcccctctgagatgtcagctgctcagtgaggcctctcctggccacttattctaaaaccagcacacacacatttactatatacactcacacacacatgcacacctaccctctatctcatcacccatcatagcattgttcacaggcatgttggtttcctgcgtactcatttgtttaatgcagacatgggaagatttttcctgcaaagggccaggtgtaaatacttttatttcacagaccatgcattctctatcacaactactcacctctgccatggtagtgtggacacagccatagataacgagtaaatgaatggactgcatggttgtgtcccagtaaaactttatttacaaaagcaggcagtgggctgcatgcggcctgtgtgctgcagtctgtctttaatgtgtgtctcctccaggctagaaaataagctccatgaaaggacctggtgtgtggttcacaatcttatcctgataacctagaactgtgctgaagacatagtaaggctccacaagtacttgttagagagggaataaaataactgagcaaaggctggcagggaagatgtgtgcttttgtgagcagcgtaacacgggagcctgccctggcagcagggtttttcaaaacaaaccttggaggagagaagaagtggagagagcagaccccttttcctgcagtatccctgagctccagggaagaggcagctggggcttaatgatatcagaaaaatatgaaggtggcactagccaattgcatggagcaaaaggattagtcaagctaataccaagattcttttcagagaaagaacaaatataaggttgaattccattcttatcaatttctcaagcctttattgagcacctgttgtatgccaagctggagggagaggagagcaggggtaggcaggaggaagataaaatagaaccatattttttttcatgggatacatgttgcttttttattttaagttccgggatacatgtgcaggactcgcaggtttgttacataggtaaatgtgtgccatggtggtttgctgtacttatcgacagcaattaaggtattaagcccagcctgcattagctatttttcctgatactttccctccctccactcccaccccagacaggccccagtgtgtgttgttccccttcctgtgtccatgtgttctcattattcagctcacacttatgagtgagaacatgtggtgtttggttttctgttcctgtgttagtttgctgaggataatggcttccagctccatccatgtccctgcaaaggacatgatcttgttccttctcatggctgtgtagtattccgtggtacatatgtaccacattttctttatccagtctatcattgatgagcatttgggttgattctatgtctttgctattgtgaatagtgctgcaatgaatatatgcatgcatgtgtctttataatagaatgatttatattcctttgggtatatactaagtaatgggattgctgggtcaaatggtatttctgagaaccaggtttttaataccttaaagtcaaaactgaagggtttgtctattatcacatacattctcccacactttcctccatccaacaaatacactgttgcacagatggccaatggcttcttaattgccaaccctccaaaaaatggtcttgtatcttcaagcccaactttactaattaaaaaaaaaaaacatttctagccaggtgtagtagtggaatgtacctgtaatctcagctatttaggagactgaggcagaaggctcacttgagctcagaatttttaggttacaatgagctatgatggcagcattgcactctagccagggtgctagagaaaaaaagcccatctcttttctaaaaaaattgtttaaaaaagtaacatgctcctgagcaggcaccttgaatgtttcacatgtgcagtctgaattctgagtcactaacagcatgtatcagtcagtgtaacgctagctgcctaacaaatatgtctctgaatgacagaagcttcacacaatagaaatccatgtctcactcatagaaccacccatggctagtgtcccaggtagatgagcacatgcacccagtttcctcctgggctgtggctctgccaaccccgagtgtctctggtctactgcatccagtaggtgaaaaggagaaagactgtgcagaaagcttcttaagagccctgacctggggtaacaccctcttctccactcgtattccagtggtgatgacaagtcccatggccagccctggatgcagagttggcacttttacatcagcctctcctaaagtgcccagtcctggcctgacatctagaaggttgtcaggacgtatttgcaggtggtttaatcatgaccagggaactcagatagaaggggctgagtaggcactaagctgtaagatgtggactgggaggtgctgaacccacagggcacccttaaagtgattggttaaacccagaagcagtggcttagggcttcccaggctctgtcctgttctttgcccagtccttgccgcacttgctcagtttccactcataatggcattcagccactagcctttcttgagcatcaactttaacttagacactgcaccagctgccttatatacatcacccctactgtgcaagatgggcttgcaaattaggattaccactctcatctacaaatgaagaaactgaagtccacaggggttaggggctcccctgataagaaacagctagtgagtgttggagctaggatgtgaacccaagtgttaaaaatctatgctgttttcgttccacgacaaacataagaaattcacctctacacactaccctggactttccatagcacattcacatctgtccccaaatccagtctctggtaataacttttattgatcacttactctattccaggccctgttctaagtgctttaattttcacaaaaatactaggtgaatataagataatagagtcagattttcaaatctgtgtatgtgtgtgtgtgtgtgtgtgtgtgtagatagcttgctgttcttctttgccacattaggatgcatagttgtccagatttaacatatgagggctctaaaaaggacatacatgcatcacttccatgaaagaagctattttctgcattttatattcagataatttttcagctaacactgacattttccagcaagctagccccatagctaaaccttaccatctaagtagaccaggtatagcccactaaaaacattgtgaatataaggactctcccttattgttctgctaataaataccatcatgaggttggggtaggaagtttatgtggagaatggacacggccatttatttccctggtttctgtctgtctgtcctagaggatagaagatggtttatagatcagctgctaaatccttccttcccaaactaatcctttttttttttttttttcttgagacagagtctcactctgttgcccaggctggagtgcagtgacgcgatctcagctcactgcaagctccgcctcccgggttcacgccattctcctgcctcagcctcccaagaagctgggactgcaggcgtccaccatcacgcctggctaatttttttgtatttttagtagagatggggtttcactgtgttagccaggatggtcacgatcacctgacctcgtgatccgcctgcctcggcctcttatagatgaaaaaaccaatattcagaatgatccagtaatttttcccaaatcacatagctaagaggcaaatgctagatttaaatcttcaccatcttgtcctagaacctcagctctttgctaaagattgagtggaattatgcccattttgaaatttacttgcaaggttaaaaactattccaaggagaaatggcctacacagagaattgaggataaggggagggggctcctgcttttatcttcccaggatggggttactcttgatcctcataaatcagtcctgtttgtgtctacgtggaaagaaatacttttgtcttttgtttctagttgtcagatcagcttggctgaggatgaattaaaagcatgttgattttcatggttccagccattcctgcttcaggtattatctcaatgcagaggtcaagaacaatctttggtctttgtctcttaaattcaaagacacctaaatcatagcacttggttttgaaatgaagtctgtgctgacacatgcagatcttcacaattaactgaggcggaacacaacatgggaatgacttcagcgctggagggaggtcatctggcagatgaggaaaccttccaggggctgagatgaattagaattaaggcatcccaagtttggaaaagaccgtaaagatgttctagttcagtcatttatcagaagcttaagtcctagtcatggtttccctgccaggaattccttcagccatggcttgattgcatctattgacagggaacccactgcctcacaaaacaggcaattcaattgtccacaggtcagatttggtccctggcctagtttgtgtgacccaccagcaaagaatggcttttgcattttaaaagggggaaagaaagaatgcatgccagggaccacatgtggcctgaaaagcctaatatattttctttctaactttttattttaaacatgtgtcaacccctgctatagttcctcagctctgaaatttggaacttgggagagggctagctggtgaggtagggaaggaggaatttccaggcagtgagagcagccactgccagaatataggaagaagttcatgtcaaacgaaccttaaataaaccatcagagccacagcagtggtgctcaaacattgctcagtcacctgggaagcttttaaagccctggtgctcaggctgcactgaaggccaaccaagacataatcttggagggctagggcccaggcttggcattttctaacactgcatgattccaaggtgcagccaagttcaagaaccactgggctagagcagtttttaaaccctggctgaatatattaccatcacttggtggcttagaaagaaaaccaaagcaaacattgatattcaggcctcatctgatgacagctaagtgctcgtcaggaaccactccccggagtgcagggtgagacacagaggaggagtcaggagataagctagaagcaaatctcagagcgtcttggctgttgcactaaggatttgcggttttatggaactcactagaggtctgttggggagtctgtgtgcatgaatttcacagggcagacctgcagtgagaagaaactggaggcagagacaccagccaggggcctggagcagccagcccagggcagttatctgggacagtgccacccctgcaaaggtgtgggcattgccactatgataagtgcaggtcatgagggcaagaaagctgtatgtttcatggtgtgatttaatgcttctcgagttatctttttccataacagctgttttcccagaagaaacggtaaatgtcagcattgtatctgagtgaaaagttgaccttcttccccacccatgcacacaaacaagccagattggactcatctgcatatctgcctgaagttctttgctaaccaaaaatcactaagcttagccttctctgttttttttttcctaagccctcccaagactttttgcaatgatcctgattctgttccaagtgtttgcaactgtggctttcttttgactgtagaacatgctgcatttccagggctttaaatgctgggctccccatcagtgtctatgggactccctggagggaaggccacctgcacctcccaatcccagatcacctgtcagcccctgccctccgcttcctcaatccatcttcaaccccctgtgttgacccagcacctgggcctcgctggctagcaatgactttagccacaagatggaccagggtttagaagcttcatttaaactcacattgacagtgtacagtttaaagcctcagggaacttacctgtctaagaaaagctgccacttagaccatgagaccatcttgcatcttcctaagtggacagggaagagcaagtccccaggggagccacccgggaaagtgtggcaggaagatgctcagagctgaatggcagagagactcatgggcctgctctccatgattaaagaagagggatggatctcccaggagagggccaggaggccgcctgaggcagcttctgtgaggaacaggtcgatgtaagaagacttgacaaggagttgaaattaggtgaaagcaaagaaagaaaacaagagaggcagtttcctgctgcatattttatttgtgtgcataaccccaaggcagtggcagggaagtctaataaatgaggcaaaataaaagagcttcaccttttaaaaaaagaagatcgttgccaaaatgtgtcaattccagttttaaaaatcacatgaagccctgactctgtgcctggcaccaagttaagtcctctatggggagtttgtgtttaaatggagtggacagatgcaaacaagatggagcggtaaggccactgccattatcaaggtgcgaattaaggtctgagcaccccagaagatggagcggtcctgatggaagatgcctcagcacataccttgcttggaaaaaggacccctctggaaagactgcagggtcgtatcagcatttgacagaacctatgtggtcgtctctgcctgccctgcctgccctccctctctatcccgcattctccctgcactgcagccatctggagccacaggcagctgccccctgccccacacgcacaaacacacacacacacacacatacacacataaatacacacacacacacacgcttcatggtctcagcctttgcatgtgctatttcccctcttgcaacaaccacccttattcatccatttgaggtgtggcttctcatcttcaaaaagtcagctcatactgcatcttgagactttcttagaaacagcccgcccctctgggctcccacagccccctagattaactcctagtgtatccccacccccaccccattacaatggccatggttggtcagtcctcctaacatcagggactgcttcaaagacaagaaccttgtttctatcacctgtatccaaacacacagcctgacagtgggtcagcactcaataaatgcttgtatttttcatgaattcattcaaaacatactcattaagttcctactgtgtggtgtgtggtgttttctaccaccacagctcacaccaaatgtgtgtgtgtattttgacaccaaacacatgttttccacaccacctcttcaatttgtctccaccaacaactgggtgtccaacaattcagctcaattctgacactgcctccccagagtgtcagaaagagttaaagggttcaatcccacaagactgccctcacttcagacaccaaccaaaaacagagtcccagggagccggcacttctgctctgctgactacaaattcaggggttcccaaggctaccctcaggtttgataattatttgctagcatgactcccagaactcaggaaagtgccctacttacaattacagctttattatagaggctgcaactcagaaacagccaagtggaagagaggcatacagaaggtatgggggtgcatcacggggcatggagctttcatgccctctgtggatacaccagcctcccagcacttcagtgcgtttaccaactgggaaacacctcaaccccatcatttagacgtttctatggaggctccattatataggcatgattgattccatcactggccactggtgactgaactcagcctgcagcccctctcccttccttagaggctggaagatggagctgaaggttccaaccctccaagcatggccagcgctgccttgaaaccatctaatgacccacctgagtcaccacattaggggttcattataaatgacaaaagccactcttgttactccagaaatcccaaggcttttaagaaatctgggccaaaaactagggacaaaaatcaaatatatatatattgcaattttatatatatatatatgtgtgtgtgtgttatgccacagtgccagccctgggctgggaattgaagataaaaggatgagcaagacagtgtctctacccccacagaggaagaggagagggacagggcacagttgagaatgaccactatagacattctataggaggaagggggctggcactctcaactgcattggctgctggccccggctgaccccgaggaggaaaccctcctgcaaacagtgttgagaatcccagccaggctcttaggattgcacacagcaggtgtgccccaacaggagcctggtgagatccagaaggggtaaaggctgtgtccagcagacccagaagagcctgggacaggaagatggcaggagcatcagataacataaagagtcaaagccacccacttgtatgacattatctcaatgccaggcctgcacctgcaacatctggaaagaagaaaccatgaaacatcctggccctgccctgcaagtgaaagggctcagtcctttaactcctcctatgctggaggagcccacagaagagacagacctgggaatgaataagtattgcttactggatttacaggaggcaggagagggaaaaaagaaggaacccatgtgtgtcaaatgcctgggattcgtccaaacattgttcatacatgatccctttcaattctctcatgccagcaaggttgaatccatgatctcaaaagaggcaaggtggagtccagactcaaccctagatatgtctgcctctgaatctcctgccaggggggcaggcactaccccaagttgggtgggagggctctgtgcaccagcctgcactgccccaagagggagctcagccagcagacagcaaggtctccctgcctgggatggggtgcttaggcaggtacgggcacattcttacttgttgaatgaataaacaagtgaatgaacaaataatagatgaaagaaagaaccctatccgtggccttggcctcaccccaattaccttaagtatcccagcactttagggggagtcgaatcagatgtctcctttcccctcaaaagttagggaattgtgtgcaaagcagaatgacaaattgctttctaatcctccggaccaagcagaaagtattgcatagaaggaataaatatatgcacattaaaataactatagctataagttaagagacataatgacaccaacttggcatatagtcataatttttgaaaaactgtttaatgaaaattaaatggaaatgtctcacaaatctagacttaaaactaaatagtagccattgctcaggacacatcaatgtctctaaaatgaattcgtacagaaggtgagaattaactccagcattggtgctagtccctgtctagaaacaaagactcagactccacacccattaccacacaggcttttagggaagggacttaaaagatgagctatctaaaactaccctgtgaactctaaactattatataaatgtgaaatttcatccaggtccagcaggaatcagggaatcaggagatacagtcaagagggttttatttgtttgtttgcttgtttgtttgtttgttttagagatagggtctcgctctgtcacccaggctgaagtgcagtggtgtgatcatgactcactgcagcctccacctcctggactcaggctatcctcccacctcagcctcctgagtagctgggacaagtgcatgccaccatacctggctactttttaaatttttttgtggggatagagtcttgctatgtttcccaacctggtctggaactcctgggctcaagttatcctcccaccttggcctcccaaagtgctgagattacaagcatgcactgccaggattttaaaagcagttctgtgaatggactatttatagccctgtgggtagggatagggaaccagagagagatggaggccccttgggacgaacaacagtgggaagcttcaaccacctcaggggtaaactaattttcattaaatttctccataacagaagaatataaacactaagaagtaagatttcatcaggtagggctaagcttttgcagctctgcaaaccattgtgatatttaagacttcttgccacctcccaagaaccagttctcacccctgtcgacaaagcatggcagagattcatttccgcttttatcaaaaactattttgagattctgagaaccaaacaggcaaattcaacaatgtgatgtgctcttgcctatggctttgtttggtgccccatgtcagaccccacactctgatgtccttttacagggcaatgcccagtgccaatggaggttaagtcaataacattgtaattagtccttcagccctgggagcacaaagaggaataagaaatgtcccaatcaggagcttggagttcagtttccaagtaaagaagaggaagaagtagtcattggctttgtcactggggggaaaaggggaggtggatagaggaagttgagactcagagcggttaagagctttacctggattacacagcagtgaaccacaattccacttcctatcagtttgactccagagccagagttcttaaggtctacaataggcaactaagctaaaggcaggtcccaggtactaagggagcacagaggagatgtgtgtctgggtgaatggatgtcaggttacctagaggaggtacaacttagactgatttctaaatatcgagtcagagcaagcagagccaccaagtatgggttctcagggtgtgcactgcacaagaagacatttctaaagacacagcatcccatctgagacagacgctaacctatggccatttctaaagacacagcatcccatcttagacagagagtaacctatggccatttctaaagacacagcatcccatcttagacagagagtaacctatggccatttctaaagacacagcatcccatcttagacagagagtaacctatggccatttctaaagacacagcatcccatcttagacagatgctaacctatggccatttctaaagacacagcatcccatcttagacagacactaacctatggccatttctaaagacacagcatcccatcttagacagagagtaacctatggccatttctaaagacacagcatcccatcttagacagacgctaacctatggccatttctaaagacacagcatcccatcttagacagacgctaacctatggccatttctaaagacacagcatcccatcttagacagacgctaacctatggccatttctaaagacacagcatcccatcttagacagacgctaacctatggccatttctaaagacacagcgtcccacattagacagacactaacttatggccatttctaaagacacagcgtcccacattagacagacactaacttatggccatttctaaagacacagcatcccaccttagacactaacctgtgagaacatgggtgccgatgtggggatgtgaggtctcccagccaggttctgacacaacaggactgcaccatctcctacatcaactcacaagcaaaacagtcatgcacacagctgggattacacaacatccacatatactgattcacacacatgcacatacacacatgtgcactccgttctccagatggcctctgagcttcctttctagcccactctcagaggcctgattctcatcctctgcgcggttccaaaactggcatggtgctccactttgtgggaagggcacagagcttaggtgtacactggctcacgggtggggtaagcagacagctgtgggggtacacatgtgcatctgcagggctgctgccatcagagagggcatctggagaactcccctggcaaggctgggcctggccacagggtgtgatcattctgtttattcaataatgtactaacttgtaaaatattttatttgagaaaggggcatttttttttaatagcaaaagtgccatttgagctagaagtggacctggaggtagccagctaaagggaaaaggaggaatgtctgagtagaggacagacatcagagaggatgctaatggaagcctaggacacatgtaaaactggagagacgctctggagtaaaagggcctcaggggacatcagggtgcagggaaagtggtggccagatcatcgtgggcctcacaggctgaaataattaaactttgtccttgtggaagtgggcagccaccaaagaattttgagctgggacatagcattatcacactggtgtttaaaaagtctgcagaggagggaataaaccagaggtaaaatgtggaatatgggagaggcttgggaagagtgaattcagaaagatcactaaggaatttgtatcggttagctatgactgtgtaacaaataaccgccaagcctcatggattaaacaacaaccagttattattgctcgcaagagttagtcagtgtggcagttttgctcttctggcccaggcttctttgatctcagctagatgatttcctcctatctacatccagctggcaggtcatctgggcaccagctagtccaaagtagcctcactcattggtctggcactgagaagggtaacttgaccacatgtccatcactgtcccacagactagaccaggtttgtttatatgatggtggcaaagttgcaagaaaagaaggggaagtgtgcaaaactgcctgaggcctgggcttggaactccacactatttctgctgcattctatcagccaaagcaagtcacaaagcccgcccagattcaagggatggggaaagactttccctcccattggaggggctgcaaagaactgtggctattctacaattgcctggaggcagtaactgtagaataggcaagagatgagaattatgggctttccttcacttacccccattccacaaataatcactgagagcctactagaaagtgggcctccttctaggcctggagatgcagtggaggagcaaacacacaaacacacacactcacatgcatgtgcacacacatagagtctctgcccttagggatcttaccttcaataacagtcatgggtcagggtccccactgggaacatatggtacactcaaactggagtattctgaggaatgttcaataaggacacaaattgctatggtgcaaaaaggctataggggaatgttgaagaccttgaccattccagcagtctcaacatattatggtcatttccaagggtccacccctctagctgttagctgtgaagaaaacaaagcaacttaatgaaagttaattcatcaaaagtcaatgcactgagaggtcacattgctgaaagtcaaatcatagagaaacacaatttgctggatttaccttatctcttttaactatttatgaacaatgtacatttttgtgcatagaatggaatggttctaacagctttgatcagtttctaagttcttcatcatgtctgcgtagtgaattctgtagaatgttttttttgttgttgttccttctgcttcagttccctgttgttatagctggaggttagtaaacagagagaagcctcagccaagtggcataaaatatacttttatccacaaaaagaatatatatatctttccctttccaaatccattttattccagaaatttatgcatacaacaggaaataggatttggatagcaagcgatatagcaacacatttatcgaatttattcattcatgcgtttggaaaacaggagtctggatagcaaaggttcagatagtgagagggattcctgcacattcacagactgggtttcttttgttaacatatttttattcaaaaatgcatttaccagtctttgctttttgatgaattgaccttgagctgacaatgtgactttcattcatggcatttctgagccctcattcctggccaggacacagaggtaccacatcccactgcaccctgccccaactcacaggagagatggtctgggatgctcttggaattttgctgtgactttcccaaaatctacagtaagttggacaagtccctgtccctctctggcctcagtttcaccatcagtgaaatgaggggatgaaccagattaagggctctctaactacatggctgcacttcagaacccccttccctggggaaacatcccccacccgggtccctggatgaggagggacctcatccaggttctgctgaggaggcctagggacagcatttccacatatttcctgaatgattcctcagcagccatcccagcccaagccactttcctgagcatggaagcctccagaattggtggccagatctaccaaccttgtggctgtgcaattcacctcattcaatcctcatggcagcccaggagacagaccatcttattcccactttgcacatgaagggctgagtttctgagaggtcataactcataggttttatggggcaggtgcccctgaagtcagtgggttggcagtgtttgtgctcttagctactgtaatgggttgagtagtatcccccaaagattcttgttctctcagaacctcagaatgtgaccttggttagaaataaggtcattgcagattactcagttaaggatcgcaagatgaagccatcctggatttagggtggcccctaaattcaatgtctggtgtccgtataagacaaggagaggacacagggaagagaagggcatatgaaggtggaggcagagattagagcgagcgatgcatctagaatcaaaggaacaccaaggattgccagcagcaccagaagccaggagagaggcgtggatggtttctccctcagagtctgcagagagaaccaactctgccaacaccttgattttagacttctgcctctagaacaatgacagaataaatttctgttctcctaagaccccatgtttgtggtgatttgtgacagaagccctagaaaacgaatatagccactaagttggcaggaaagtatttcctaatcctctacatagctgtagatgcagggtaccagggctttggaaatgagtgatttccaccatctgactcttaatgccaaacaatggtgagtgggcaagctgcctgccaaggttatggtgcactttctgctttttcaagaagaccagggaacttttaaaattaataatattatcttccaagccaggcacagtggcttgcacttataatcctaatgctttgggaggccaagataggaagatctcttgagtccaggagttgaaggttgcaatgagctaagattacaccaatgtactgcaactggggtgacacagcaagaccccacacaccccccaaaaaaatcttcctaagttaagcacttggtcagcgctagatacttggccacactcaccctaatccttacaaagtctccgcaaggagaccctcctctccccatgaggacaccacagctccagggagccctgcttgggccacatctcatggcacatagtttaggtggcccagccaggatttgaacgcatgcctgcccaactccaaagtctcctttttccagccgttctcccttgcattttcacatgttcggttttagtacttatcactttcccgcagcctatggcagagttaattagtgagcttatcgcctgaaacttgaatgcgaaaacgtggcagtgttccttatgattttttgccaaaaccctccagaaaacctctcccctcagaagcagtccaagcaaatgctgctctgagaaagattttgagcccttcaaagttttggtgcgtatgctggggttttcaacagaaatgtagaaaacctcaaaactggctctgcagtccttgaaatcagtgacacctgtcaggctcataggtctttctcgtggtttctgtcagcagctgtcttcctcttcactgtcacttgggcaatccctgggaatccagctgaggaatttgtcacttaattattccttgcagctgctgagatggtgagaacacagtcctctgttgggctgtatccatttcctgtggctgctgtgacaaagttccacaaatgacagcaatgtgttctcccacagttctgaggccagaaggcagagatcgaggcttcagtagggatgcagtgcccctgcagaggctctgaggggagtcccttccacacgcctctcctggcctctggcagctgccagtgctccttggcttgtggccacatcactacacagtctctgcctccaccttcacaggccttcccctatgtgtgcatcccaaaactccatcttccacactcttacaaggacatgtgtgattgcatttaggacccaggtcctcctctcaacatccttaacctaatcatatgtttgccatttgagtaatatttgcacactccaggatgaggacatggatgtatatttgtggggccaccactcagcccactgcactggactagagataagcatctgttttctcatatgctttgataaacactttggcctcctctaccaaaaacagttcattcaagttagatcctagtctattggacacctacttactgtctgccagtcactgtgctaggtctaagctacagagatgagcagaggacagccaccagacccttgggagaaagattggcgtaaaatcaaataagagtaataattgacatattgccaagccatcccatctgcctggtgtgtcagataagagtcccagagcaggaaatggttggccgtggtctagcaaggtgagcagggaggagttcactgggcaaatgtgaggagggggcattgtaagaggaaggaggagcacaggagcccagggccagaggcaggagactgacactgtgcctggaattgggaaccagcagctggtgaaagtgcaaaggtagacagaaattagaacacagaaggccttaatgtgtagaactgccctgaagccagtgggaagctactgttgggttttaagcaggaggcatggactgaccaggtttgcatgtgagaattgattctagaagctgggtggagacggaggttgatgctgagacctgaggctggagaccactcccccgttccatccacttctcagcctccgttttctctgtggaaaagtccagatcccgacttatactgtctctgtcttacggattagtgtgagagtcaaatgagatcattattgccaataggctctgtcaatacatagaatttagttgaccattttcattgtcttcacttgtgggttaaataaacactaaaataaaaacatcagggagcctggctgagcagggaataacctcttggaggaaggaaaacattcccctttatatgtcagcaactttgaccctagagggaatcagaacccatgcctttggggggtgttcctgcagacacagagctgttctccccctgggaacctcaccactgctcaaaatgtaatgcaaacatgaactgacttagttatctcaatgttcaaacttgaaaaaaaataaacattatgttccaaaatcttcagcattcgtcacaaaattgctgaggggagaagttctgctctgggcttatgaagcgctcagttaatcccacaggtatgggggttcctggggtgacagagggagagcttcaagctggctgtcagctccacagacaattcacttctcatatcccctatatatgagctcctcaacaggtgacaactggggtgcagaggactctagggactttcttgtttagtttatgccattttatgaaggtgcaggtacccaattgaaataaatgggtggatagcatttccccttcagggtagtaaacaattctggggaagaagccctggttagctggatgctttaaagtcaagggctttccagccaggcaggagttgattattatcaggtcacctggcttctaattacatgatgggccacctgcccaagggagtttatgggaacagctgcctgccctgccacagtggactagtgaaggcaccaggctgcactgccaggcgactctgaggtcagaacactcctgagcccctcctctgggcatggccccatcagagatgagtggcgctctggtaagggagacagatggaacttgactaatgcccaccagaacagaccgctttctccagcaggaacatagcagagggcttggaggacaacagaggagggcatgggactatcccgggtcaggcgcaaatccaccacttggggatctttcagctccaaggctgacagaggctaaagacacgcctggtggagaagtcagcatgggcagaattgccgaggtgtgactgtgcaaggcacgttctcagaggcctgtaattgagtgtgtctgggcagtgcattccagggcctcgggtggggggggcacgcatgtgagttgcatgtgtgaattcactcccaccagttcacagaatgggatcagcatgcagaggcttaatgtttagtcccctgcataggggggcagtccattagatctcaggaatattatttcaacccctacatcgttttaagcagttgatcattagcccatctctctcccaggcagtcaggcagtcagacctccatccacggtgtccccagctctcagggggtagtgtgagtccctcttcccaggcttgggttgagtgaggctcccctgtactccccatgatggggcgagggaaaggggcttatggcttagcaatagccgcccgtctatctctacagaaatcttccctgcttctccgctttctcttccattcctaatgtcaaaataatcatcatcatcttcttcatcattatcatcattatcaccaatactatttattgagtacttattatgggccaagcatggaattaagtactttacctgcattatctcctttcacaagaaactcaagagttagttgagaaagaaagggagacattctactccagccgcctcagctgacatgagaaacccacatggctgcagagagtgcaggctgggttggggagcggaaccaggccttgaaggaaacactgcgtctactttctttcttctttagcagctttaattaccaagctcttatggaagctgagggaattggcattaactctgtttcaatttgtacttttgcaaatgagatgtagttacatgacaatgattcacttctgtgaggtgtcaaaaataaactgctaggatggaaaagtgcccattgcattcacacgctgcccattgtttttctgttaaactgaggaaaggcaagattcacgctgacaaaaagttcttgaaggactactgttcgtctccccatattgggagcagtgtgaccagcattcaggagattctaggctccaaaagtggatgtgtaaagaacaaaagatgattttcccagacagccaacatgaagtggggaggactgtgagctcagagtccacccaccatggttggaattctccatgcaaccagtagagtggtgctggcctgttcccaccctcatgcatcagtttacccacatgtaaaatgggtcctaggtgctgtgaggagacaacatacatgaagcgagttagatgcagctcacacgcatggatggggagtacgtccaaggtgctggctgccactgctttcctcacagctcctgccttaggaggagtaatggcagcatcgtccccgtatccatggatgtgccattttgcctgggatcccaggtctcagccccatcttccttccccagttctcgggttgtcactgacatgagcgtgaatactgggcagttgtagaaagaacaaggaggcacgtgtgactggaatggaatcaacagggtcaaagtgaaggaaaactaagagagcaggaaggaagcaaactccatggccacagagcttggtcagttcagcagctggatttcaaatgcaatgggaaacgcttggcgggtttgcatcagaggacagacttcatctcaattctatttcaaatgatcacatgggctgttgtgtggattaacatattggaggaggtgtgcccagagtgttctcaacagaggggagctgccctgagccagatctttcaataataataataataatattaataataataatggtataataataatacaatagtaattagcatccatgttcatatccattctgttggatcagtgcacccattttacagatgagaaagctggggaataagtaacgggccctgcatattgcagtcagtatcaaagcaaggactggggccctttcccccatgccacaagtccctccttgccctcctgaatggcttgaggaatgaaaccactacctggaggcagaggggtcctgggtgaagtgctcggctgtgcctcacttctctgtatcacatccttgcgtctgggagccatatgctttgaaatgctctgtttgccaaaatggcaaatcatgggccccggggccagattcctgcaaaccagtgttcctgcagggaccttgggctgtctcatcaatccaattgtggcaaatcttcaaagaccgtctaacaaaaccagctcctgcccactcccttcctttatgtcctggaaagggtgggaaacccagccctgccatgtggcatcgagagaaagacatgagcttgggtcagacacaggctacacctccagccatgtgtgatgtctttggaaagtcaccagcctccctaagcctccaccttgagagctattatgcaagaagaactatataaagactgctaagcgatatgtatggtgcctggtacacagaaggtgcttagtgagtttgaatttccttctttgcctccttgcctttattaaggcagatttaaatgtactctgtaacaatataaattataaattcagagttctagaaagaaatgataaatggtctcatacaaatttgttttgttcacaaacccaccaaaaggatgagcacgtgatagtttaatgatgccattacatgacttactagagaaaaatctatgacagggtctctcgacttcagcacttctggcatttggaactggaaagtattttgttgttgggggctctcccgcgcatggtctgatgttgagcagcattcttggcttctgcacattagctgataggtgcacctacctttagctgtaatagccaaaaatgtctccagacattgccaaatgttccctgggggcaaaatcactcctggctatgaaccgctgttctaacctggtgttttggaagaagcataggcttgggactcagaccagtctggctccacctccttcttaatgtgtgatttggggcaagttggtctcaaaccttgtgggttgtgagtcaaaaagtggggtactcaagtgttcatgctcacagctcagaagaggtggaagcaggtggtactccaacctttctcctggcttccagccaagacctggccaaggcaccatgcccaaggcaccagaataatcaaggataatctccctatctgaagatcctcgacttaaccacatctgcaaaaccccttttgccatgcgagacaacacaggcacagggtttggggttatattctgtctaccacagcatcctttatgctctaagtatacaaggacaggaagaaaatggaaatatgaaatggcattttctctcttttatgcttcccagatggatagcttgtagagaagctgcagaatttgtactcttccaggcttgggtttggagagctgggaccctgcttaacagctgtgtgaccttaagccaggtcccatctatagtatgaagatgatgcacagtttgcagggtctgagtttaaaacaaatctctgaaaggtggacaataaagttccaactcatagaaagcactcaagaaatggcgactatgataagaatttccctaagctgtggttctgccttctgtcttagggaaactaaccctgatggaatcgcccttggagagcagaaggctgtttggggcagctcccctccagctctacagctctgggcacttgcaggaggtcacttctgctgtcaagaagctttggggacatgagtgtcttggctaaatcaaaccagccttccagaagaaaactggttctgagagggcatcacactggatgtgccaggggttgtttttctaagacagtggcagcctgtttcttgaaatggctgtgtacacaaagcaatccccaaatggcaaagaagaagccaagaaaccaaagaaaggggcagacaagtccagtctgatggtatagggtgatttgttaggggaacttgcagactgaagcatggtcttgggaagccacaagacaggtagatctctgtatggcaaccccccagtcccagggcctagatctggggaaaaagtgtatgcactctgggaggaatgtgtaggtggctgcaggcatcacagtctttgatttctgcaacagcatcaagagttgttttggaggaaacttacagtgaatagatgtttctacataaagagcaatacatcaactcgacttcttggaggcattcctggacgtggggttagtcagaagttacatggtggattagcatttaaagtaaagtcactcttgttcccacatagcctctgatggaaattctcaccccactgtgaagtctcattcatcaggtctagcgagcaaaagagtggtcagcggacatgcattctctcaccccttaggtgcttccctttgcatgcccaacttctttattgaaacaaaatatagattaaaatataaaatcaagcttgtcagaattatgccttaagagggcctatggggaggctgtcttaatgaggaaactaatgcatgtgctttaatgcaggattttctgaaatatatgctgatcattcacagtcatttttccccttttatatattctcagtcatgccccaaattaattcattcaacaaaagattttagctgggcacagtggctccgatactttgggaggctgaagcagaaggatttcttgagctcatgagttcaagaccaacctaggcaatgtagcaagacctcatctctacaaaaaatttaaaaattagccaggcatggtggcacatgcctgtagtcccagctacttgggaggctgaggtgggaggatggcttgagcccaggagatcgaggttagagtgagccatgttcatgccactgcactccagcccgggtgacagagtaaggccctgtctcaaaacaaaaaaaatttttgaacacatactatgtatcaggtactacactctgtactgatgacacagaagtagagtcagagacatttctcggtccccgtcaagctcataatccaatcaagaagacatgtacactgataacagttggcctccctgggcggggcacattcattgtgctttattgtccaatgcaatagaaaggagctggaaaagcaaggttgataggcaagagcatttgttaattaaaagtattaatcaagcacttcttatgttgatccaggcacaggagataccccagcgaatgacacaggccactacaaatgtatatttatagagccattactggtaagctaataaatattgaggattactgaccagtgctaggaaggaataaacagggtaaggggctagggtgatgggaggagaggactgcttttgtgatatggacaggaagggcctccgtgagaagctagcgctgcaggcaggacttgggtctgagaaggaagccaccctgtgaggatgtaggggaagaatgtgcaaaggtcctgaggcaggaactcgcttggaaggctcaggaaaggctgcagtgttgttagcataggggataaaaaacatattttcttcaaccctcataggtccttagttgaaacagacccctgtaacaaaagacagactaacacaagaaaaaaaatacagaagtttattaacatgtatatttcacacatacatgggagacacccagggaatgagtagtgctcaaagaagtggctttaaattccagcttcgagaaagaacagtaaatgttgaaagaagcaacaagacaaaggaaaagaacgttgagtctctagtgacagcaacttgggggaaaacaaataaatagcagatcgaggtgggttagggaaactggttcatgtaggttcctctggtgtaagctccagacctataagcatccaaagttgtcttcactggttaccctttgttctccctggcagaagagggtgggagcagaatatctcttgtctttgtaaatctatgtcctgcttttaggcaaatagagggaaggcagagagccttcctgcatctacttctttttaaatgccttcagctcaacagttcttcgtgttttggggtggaatattatgatgttccatattagcaaaggaaagagatgaagttggaaggatagtaggggccggaggatagaagatctcataactccgtggtaaggaatcaggaattttactttcaataccatgggaagccattggagatttgaagcagaggaaggatttgatcaaaatgtgaaagatgtgtctgtactttaatcattaattcagcaagtagtttttaagcacctacgacatacttggttccatactagacccaggggatgcaaagatgaataagactctccggatgaggacacagccagattcattcattcattcattcattcattcattcacttatccatatttattgagcccctataccagaaactattggtatagaggccccatatgccaagaggagcccctatatggcagataatgtagaaattggagcagtgcatggagcaaaacaaacaaacaaaatccctgccctcaaggaatggacattctgttgagggaggcttattgtaaacacatgaaaatataatgtaattatatggtttggagttgtgtccccaccaaatctcatgttgaattgtaatccccagtgttggaggtggggcatggtgggaggtgattggatcatggggttggatttctcatgaatggtttagcaccatcccccctgtactgtccttgtgatagtgagttctcactatcatcattttaaacgatgagatcccatcgtttaaaagtgtgtggtacctccccaccctctattttgttcctgctgccatcatgtgagacacctcacttctcctttgccttccaccgtgattggaagattcctgagacctccgcagaagctgagtagatgccagcatcatgcttcctgtacaacctgttggaaccgtgagccaattaaacctcttttttaatataaattaccagtctcaggtatttctttatagcaatgggagaacagactaatacgtgtagcaataagtgctcagaagagaagtcatgcaaaatgaggaggagaatgatggagaaaatgctatcttagggtagccagggaaggcctctccacagagttgatcatggagcagagatcaggagacaagaaggaggcagccacgcacacatctgcgcatgagcaatccaggcagaggagcagctggtacaaaggccccgtgtgtcattcagcattcatgatcgcagctccgaagatgcatgcaccagcctcaggcttcagggaggacttcccggggttgtgatatctgatcaggggcctgggagacaatcgatactcatatttgggctccatcagaaaactggactctctgtcaaaaaggaatgagttgcccatcaattgaggtgtacaagggagccaggctggcctgaagtccagccctagatgggaaaggtggggccctgaaagggacaacgtcactcctaaagggacgaaatgaatgagtcttgaagccaagttcaaagtcagtcctgtcctggggaaggcagggtttcagctcatcagttcttgttccttcacctgttcgtttgtttactgggtcagtcgttaattcatttctaaatactcctgttcatgtgttcccacacccatccattcatctccccatcttcgttcaacaccctcacaaagtacctcatctgtgccaggtctgtcgcttcaccactcatgaatccataaggatgacaagtagtgtccttctgtgtgcaggaggctgtgccagatggctgggcaggggctgtgggaacagaggaagaccccaacagcctcgaaggcagggaagaggtagtgatgtgcagtgaattgaaaaagttgagtcatttttcaggcagacagggagggaggagaaggaggaggaagggcatttcccacagagaacgcctggtactacccagggggcagagagatagcaggtgccatccaacaggaactgcgggctgttctcactccctctgctgtgaaaagatgaatttctcctggcaggaagaagccaggctgtggaaaggggcccagactgagcagctgtcagggctcagcaggaaggtttttgctctccacaccctcaggagctgggggctgagtgcagccaaggggtattcagcttttggatctggaaatggttcggccttgcagaggccgcttgtcacagccaactggggaaagatagcacacctggggctgccggttctgcaaagagagcaggcgctccctgacttccagcaggggctttgatatcagcattaatatatgtgacagcaataggagctgcaggctgtgcaagttggaggaagacacctggaaaagaaaaataagctcacttttcactggaagaaacttccaagagaagtcagaaacagtagcaaaggctgatgaggtcacttgtgcacagagtgcttaaagcagacctcacttcacctgttctgtcaccctcaggatctcctgttttaatctgaacaagggcttcagtctctatgctccctcacttggcctcatggctggtataggagaaaaaccatttatcaatttctatctctaccacaaattaggtgaatgactttaggcaatccatctttctgggccttagtttcctcatttgtaaattggagataagaccacctacctagaaagagtcttaccagtcaatatagctctgcatggaaggccacactgtaggtggtcagcacatggtagatgtgtttgtttaaggtgttcaccttgacggagaggaccccgtggacagcccaatagacctggcttcaaatcccacctataatagtcagggttctttagagggacaaagctaataggatagatgtatatatgaaaacaagtttattaaggagaattgactcacatgatcacaaagtaaagtcccacgatagaccatttgcaagttgaggcacaaggaagccagtggtggatcagttcaagtccaaaacctcaaaaatagggaagccgacagtgcacccttcagtcagtggccaaagacccgagagtccctggcaaaccactggtgtaagtccaagagtccaaaagctgaagagctcggagtctgatgttcaagggcaggaagcatccagcccaggagaaagatgaaggctggaagactcagcaagtcagtgcttccatcttctcctgcctgctttattctagcagcactggcagctgattagatggtgcccaaccagatggagggtgggtctgcctctcccagtccactgactcaaatgttaatctcctttggcaacaccctcacggacacacccaggaacaatactttgcatccttcaatccaatcaagttgacactcaatattaaccatcattccacctctgcctctgccttactagctgtgggaccttagctaagagtttttaccttgtgccctcatcagtagtttgccggggacactctcagattatgcctgacatcctgacgtgactattaataccatccccccttacactctcaaaatgtctgattttggaaagtaaacagcatagtgtctctactcatcaataaaatggacagtgccacactcaaggacttttatgagggagaatgaagggaatgcaaaggaaaaaccctgataaacatggaaatgccacccctttccaccatagcagccttgataaagtgcatgcatggaaacatcagtccattaacaaagagaaccctagacagtcacaaagacactaatgttgaaatgcgttcacagcatcaattaacctcagcattgctaaagtatcaagctactgccaaagtccagctcctgcccactccatgcccccaggtctacttcatatttgaacctctgtacctttccatctttcacctcccctctttctactcagtgcttccctatgcagatcaatttagtgtctcagaaccatttacaactcagtatgttctttctccccatatcataatacaataaacccttttaggtaatcaagaaataattaaattgtgatactattagagtgaccaactgctctgatttgctgactctgaaggggtttctgagacatgggacatcctatttttaaagctgggacaataagtttgttcccctaggtaccgtggcagtgtagattagaaaccaataggagttcagtaaagggcatgccagagtaggcttcagtggaggggatagcaggactttgaaaagctgggaagtgtttctccaagagaccctaagacacagattccagtgaaggcagtctgtttggggggtgatcccaggagacatcaggagggagtgggcactgagtcaggcagggccaggcaggcagccatggagtgcatttcagggcaagttcctgctgtgggcacctgcagtgtgattctctggggaactctgggagactgtgggggaagacaactgcatcatctcacaggaagcattagggcatcagctctcttcagtccaccctggagagaagctctgtcagttccacagcccttctggcttgtgaaaagccaacaaaagcctctgccagggatgccagccggcaggtggatgtgggacagcctgagatggtgagggaagatggagtaaagaaccagtcatccacatctgccccagcattccagggtctgagccggagaacaacagaactgcacaggatttgagacactgtctggcccagggactgtggctccttccgggctctatcttcagtatccaaccctgcgccccctccaagcaggaactcagtactttttgttcactgaatgaacaaacaaatgctctgcagctgggaaaaccaagacctagactgagggtgcgatggcctcaaatcacaggaatgagtgggaacccaggttctgagctatgtcccctggatccttttaccctatttcaggcagccttataactccagcacccatacagagaacgcttttttctttttttaacttttcgtttcaggggtacatgtgcaggtttgatatataggtaaattgcatgttacaggagtttgatatacagattatttcatcacccaggtaataagcatagtatagtacctgttttttcagtcctcaccctcctcccatccctcaccctcaagtaggccacagtgtcattgttcccttgtgtccatgtgtgctcaatgtttagctcccacttataattgagaacatgtggtatttggttttctgttcctatattagttgacttaggataatggcctccagctccatccatgttgctgcaaaagacgtgatctttttcttttttatggctgcatagtattccatggtgtatatgtaccacattttctttatccagtctactgttaatgggcatttatgttgactctatgtctttgctattgtgaatagttgctgcaatgaacatacacatgcatctgtctttatggtagaacaatttatattcctttgagtgtgtacccaataatgggactgctggatcacatggtatttctgttttaagttcttcgagaaattgccaaactgcttccacagtggctgaactaacacattcccaccaacagtatataagctttctcttttctctgcaaccttgccagcatctgttatttttttactttttaagaatagccattctgactgatgtgagatgatatctcattgtggttttgatttgcatttctctaatgattaccgatattgagcattttttattattattgttggttgcgtgtatgtcttcttttaaaaagtgtctgttcatgtcctttgcccatttttaaatggggttatttgctttttgcttgttgatttgcttaagttccttacaggttctggatattagacctttgtcagatgcatagtttgcaaatattttctcccatactctgggttgtatgtttactctgtttatagtttcttttgctgtgcagaagctctttagtttaattaggttccattagtcaatttttgtttttgttgcaatggcttttggcgtctttgtcataaaatctgtgccagggcctatgtccagaatggatatttcctaagttttcatccagggtttttatagatttaggtttttacatttaagtctttgatccatattgagttgatttttgtacgttgtgtaaggaagaggtccagtttcagtcttctgcatatagttccccaattatcccagcaccatttattgcacaggaagtcctttccccattgcttgtttttgtcagcttgttgaagatcagatggttgtaggtaggtggccttttttctggactctcttttctgttccattggtatatgtgtctgtttttgtaccactaccatgctgttttggttactgtagccttgtagtatagtttgaagtcaggtaccatgttgtctcctgctttgttctttttgcttaggatctgggctatgtgggctctttttgggttttatattaattttataatagttttttctaattctgtgaaggatgtcattgatagtttgacatgaattgcattgaatctgtaaattgctttgggcactatgaccattttaacaatactgatttttcctatcataagcatggaatgtttttctatttgtttgtgtcatctctgatttctttcagcagtgttttgtaattttcattgtagggatctttcgcctccctggttagctctattcctaggaattttattttgtatgcttgtgtggttattgttaatgggactgaattcttgatcttgtgctcagcttggatgttgttggtgtacagaaatgctactggttttagtgcattaattttgtatcttgaaactttgttaaagttgtttatcagatcacgaagctttttggcagagactatggggttttctaagtataaaattatattgtctgcaaacagagatagtttgactttttctcttcctatttggacatcttttatttctttctcttgcctgattgttccagttgggacttccagtactatgttgaataggagtggtaagagtgggcagccttatctggttctagttctcaagggggatgtttccagcttttgcccactcagtatgatgttggctctgggtctgtcatagatggctgttattattttggggtatgttccttcaatgccaagttgtggagggtttttaacatgaagggatattagttttatcagagccgtttctgcatctattgacatgatcatgtaatttctgtttttacttttgtttatgtgatgagtcacatctattgatttgtatatgtcaaaggaatcttacatcccagggataaagcctacttcctcatagtggataagctattggatgtgctgctggatttggtttgctaggattttgttgaggatttttgcatctatattcatcaaggatattggcctgaagttttattttgtgtatgtatgtgtctctgccaggttttggtatcaggatcatgctggcctcataggatgagttgaaggggattccatccttctcaattttttggaatagttttggtaggaatagtaccagctcttctttatgcatctggtagaattcagttgtgaatccatctgttcctgagcttttcctggttggtaggcttttaactgccaattcagtttcagaacttgttattggtctgttcagggttccagtttcttccttgttcaatcttgggaggttgtatatttccaggaatttatcagtttcttctcagtgttcataatagtctctgagggctttttgtatttctgtggggtcagtgataatgtctctttgtcacttctgattgtgtatttgaattttctctcttttttaattagtttagatagtggcctatcagtcttatttattctttaaaaaaatcaactcttgaattcattgatattttgtattttttgtgtgtgtgtctcaatttctttcagttcagctctgattttggttatttcttatcttctgctagctttgggattggtttgctaattcctctaggtgtgatgttaggttgttaatttgagatctttctaactttttgatgtgggcatttagcactgtgaacttttttttttaacactgttttagctgtgtcccagagattctggtatgttatatatttgttctcattaatttcaatcaatttctttatttttgccttaatttcatcattcacccaaaagtcattcaggagcatgttgtttaattttcatgtaattgtatggttttcagtgatcttcttagtaaagatttctatttttattgcactgtgttccaagggtgtggttggtataattttatttttttgtcaatttgctgaatattgttttatggccaattgtgtggtcaattttggagtatgtgcaaatgagaagaatgtctattctgttgtttttgggtagagaattcagtagatgtctgtcaggttcatttggtcagtgttaagttcaggtcccaaatatctttgctggttttctgccctgatcatctgtctgatactgtcagtggggtgttgacatctcctgctattattgtgtggttacctatgtctccttgtacgtctctaagaacttgttttatgaatctgggtactccatgttgggtacatatatatctagcatagttaggcattcttgttgaattgagtcatttatcattatgtaatgcacttctttgtgttatttatttttgttggtttaaaatctgttttgtctgaaattagaatagcaaccccctgatttttttctgttttccattcgcttggtaaatttttctctatccttttactttgagtctacgggtgtcactgaatgtgagatgggtgtcttgaagacagcatatagttgggtctggcttctttatcaagcttgtcactctgtgccttttttttttttttttttgagagggagtttcactctgttgcccaggctggagtgcagtggcacaatctcggctcactgcaatctctgcctcccaggttcaagtgattctcctgcctcagcctcctgagtagctgggattacaggtgcacaccaccacatccagctaatttttgtattttagtagaaatggggtatcaccatgttagccaggctgaccttaagtgatccgcacaccttggcctcccaaagtgctgggattacaagcatgagccaccacacctggcctctgtgccttttaattggggcattttgcccatttacattcaaggttaatactggtatgtgcagatttgattctgtcatcatattgttaactggttattatgcagacttgattgtgtagttgttttatagtgtcactggtctgtgtacttaagtgtgtttttgtagtggccagtaatggtctttcctttccaaatttagcactcccttcaggaacttttatatggcagatctggtggtaatgaattcccttagcacttgcttatctgaaaagcatcttatttctcctttgtttatgaagcttagtttgactggctacaaaattcttgattggaatttcttttctttaagaatactggaggccgggcgcggtggctcatgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaagaatactgtatataggcccccagtatcttctggcttatagggtttctgctgaaacatccactgttagcctgacggggttcactttgttggtgtcctgcctcttctctctagctgcctttaacattttttctttcattttgaccttggagaatctgacggactatgtatcttggggatgttcatcttatatagtatctcacaggggttccctgcatttcctgaaggaaattttcatggacaatatcctcaaatatgttttccaagttgcttgctttctctcccttgctttcagagacaccagtgagtcatagatttgctctctttacataatctcatattgctcagagattttgttcattctttttattcttttttctttatttttgttgactgaattatttctgagaaccagtcttcaagctctgagattttttcttcatcctaggctattctgctgctagtacttgtgattatattatgcattcttgaagtgagtttttcagctctatcagataagtttggttttttcttaaaatggccatttcgtctttcacctcctgtattgttttattgaattccttagattccttgggggttttgactctcccaaatctcagtgatcttcattcctatccatattctgaattctatgtctgtcatttcagtcatttcactatggttaagaaccattgctggggaattagtgtggtcatttggagataaaaagatactctggctttttgagttgccagagttcttgcactggttctttctcatctgtgttgactgatgatcctacaatctttgaggctactgacctttagatagggttttttgcttttatcttctttgatgcccttgagggtttgattgcagcatgaggtgggttcagttgactgtcttcatttcaggaagattttagggagccaacgctcagctcagcactcctgggtttcatgctctggctctgggggactgacattgggcccctagatttgttctctggcccctcaaggttaggaacctgctacgctgaatgggccgaggtgttcccagcccaatgaccacaacacttcgatgggtgtgccagccaaagcacttcggcagtgggatccatgctcgctcacgtgtgccagcagctgcaacagtgcagtggggtgcacgtgcattgcctggggtggggcaccagcaggagttgggtggtggtgttcctgcatatagctgcaccagtgatgaatggcagcagcacagcaggggtgggacactggtgggggtggggttgccagcacctgtgctagcccttgcaccagtgggggtggggcactggcaggggcagggttgccagtgtccatttgtgcattcatgctggcagtggcagcatggtagggtacccatgtatcagtagggggcacagcagggtacgcacatgccagcagtggtggcattatgtgatgaatgcacacacatgtgctggaagagagggaggcaaggtccactcacagtgcaccagcaaagcgatgtgggatggtgggggagtggggcacgaatgagtgtgcaccagtgaagggaggctgcggtgaggggaggctgtgggtgagctggtgcacaccagtgggagccagtctgctagagttcttcgatggtctgacatggtctgctggcaaagaagccatgaagagggtcccagggaagcaccctggttgggcatctgatactgccctctgggcacaaccaggctggggccccaagagagtccagcagatggggggcattcagaatgtaccggcctcatcccacaggcaaggccaccctgctctgtccaggtctgacagtcacactcctagaggagcatggcaagccttggggaatgggcatcactggccatgcttcactgcagatgttcccacaccaaaccctctgggcaacacacaggctggagtcctgcccctgccacctgtctaagcagttctccctgtcgtctcaagtgtctgtgggggttgtggggtatcctgctgctaggattctggaggtccatggtgagagcgggccattcctcacctgttcaactcatcccttccccaggagtcgctgggggccaggaaacaagtcccattgctcagcagccccgtgcagggttcccagacttccctgcttcagcccagcatctgtatcctccctctatccactctcaatgccttctctctgaagatgtggcttgagtgtgccagtcttcctgatgtcccggtctctcggtgggagatgttcctcctagctcgaccatcttttatctagtcactcttgcttttctatttcaacaccccctcccagcaccatgctcatccaaaaaggaagaatgttaaaatgcgcccatgagaacctaccagcaagactgctgacctccgtctctattgaaacagaaactcctcaccaagcttagaaacaggtcatctgagtgtgcttaactcaccaccaaacagaacacatcactgtaggtttgttctgagagactttaattgtgttttcttacctgctaattaactgtccacactcattatgctgtagcagcttcctctttttaattagaattaacagtcaatttggcctttcatggcccatttgctcctgagactcttcaaaaacatcctctcccccagacagtccaggatggtaatgttcaagcctattgattcaactaaagaacacagattttaaatcccactggaagaaagtctatgtcaaaacatgctaattgatagtcaagaggaagaaccactttacatttccctagagcagagttcaggaaacaatctaagtctcatgactgatcctacacaaattcaagttagaatcaccatgtatggttgttaacaatgctgagaggcacgaacttcttttcacaaacaacttcccttttgtttctggagttctgaactactgtttcctaaccagtgtcccagtctgcctccacaccctccttctgctgacccatatcccactctgcatcggggacacttttcaaatcacaaatctgatcctgtctttctcctcctaaaaccctccaacaggcctacagcttctgcctgcaaactcctgccccaagcatggcctcctagacaccctagaatccacccctgctggcccctcacaagatgcctctcctgtcccacctccccatcgcagcccaggctctcactgaacgtgcaccctggttagccctccatctcctcaactgcataaagaatttctggccaggcacggtggctcacgcctgtaatcccagcacttcgggaggccgaggcaggcggatcacaaggtcaggagattgagaccagcctgaccaacatgcagaaaccccggctttactaaaaatacaaaattagccgggcgtggtagcgggtgcctgtagtcccagctactcgggaggctgaggcaggagaatggcgtgaaactgggaggtggagcttgcagtgagccgagatcgtgccactgcactccactccagcctgggtgacagagtgagactcggtctccaaaaaaaaaaaaaaaaagaatttccactcatccttaaaagatctgtttaactgtcatcattttcccttcatctgcacattcagcaaacatctgtcaagcacccaagagacagacatgattggctatggggcaagcaacagggagaaaaagagacaaaatgcctgccctcgaggagcacaatgaacaagcaaaagataaatgcaaagatgatgatgcaatccatggaaataaataaacatgaggctgtgatcgagaataaggtagtggtggagggacctgccccttttgcctaattaatacatgctcatgtctcatgcccattcctggagaagtctcctttccattttttttttttttttttagaaaacacatcccatgtggtgagaccacaggcttgtgtagttacttatgctggctacctggttgggctgtgtagaaggggaaaaaggcgccattgcttctttatcctatactgggagccaagctcatgtgaagtaaattacccatatccttgtgtgccttgaaatctttccaaagctcgggggcatttccagcagtgggaacagtctaagcatgggtgggcaccaggaattcctagggaggacacagtagagcagtcaatcaggctagtttggaagtcctggatcctactcctctgaaacactgggagtctcactccacctctctagcctcagtttccccacctgaaatattgggttggggctggcctagggggtccctaagatattttctgcctctaacttttgcagtgtctctggatacaacaggaggaaaattcctttgctctttcagttcagaccagtgactcctgataatttgatcttccttgcccaagatcaacaatgtctgatgccatatctgatgacattttatcactccttttctaaaataattagaaaccctacaaagggaaaacctttcaagaacacatagaaagtgctcaataaattttaactatttttattattactgcccaatgaaggagaacgttaatcttgtgctcagggctggttttcttgactcagtggacctcagatgctgacggctccttgaaggcagaagttgaatcagctttctgccaccattgatgccccagcatgggttcctggcacgtagtccgttcccagcaaacactgaggggattaatgacaggcagaagaggaatcgccgtaatcattgatattgattgggcctttgccaatatggtttggctctgtgtgcccacccaaatctcatgtcaaattgtaattcccatgtgtcaggggagggacctggttggaggtgattggatcacggaggtggtttcttttatgctgttctcatgatagtgagtgagttctcatgagatctgatggtttaaaagtgtatgacatctccgccttcactttctctcccctgctccaccacagtaagatatacttgcttccccttccctttccaccatgatcataagtttcctcaggcttctccagccgtgcagaactgtaagtcaattaagcctcttttcttcataaattacccagtctcaggtagttcttcacagcagtgtgaaaacggactaatacagccacacattaaacatgttgctaagcattatctcatttaatccccagtacagacctaagaggcaggaactcctgttctgtcctcattttatgtacaagaaaatggagagccagagatacgacttacctgtggttacacagcttggaagtggagaggtgggaatttaaactgggttaaacctggtgactaagagaaaatatatctaaaggattaagtgacatatggacacacttgtggagatttttaaggagatttctaggcatttgggggggctttagaaattgatgatagtggttccactggaataattttaataaatatgaattaaggaaaagtttgggtgtgcactttatttcttttatgtaaaaatgaaattacaattgagctttctctggttacttgggcaagagttagtgccaatggtcttagctactagcctggctacctccacatggtaataatttgccatgtgccaagtaagcactatcaaggtttcgactttactgagattttaaatagctcattaaatgagattataggcaaggaaactgaggtctagagaaggaccaaagcctctcacctggtggtcagcagagccagaggagcccactgagagtcagggtgagtcaaggctctgcaaggagaccccaggaagcatctgctatacctcctcatccctagttgctcagcagcctcccctgcctccctacctaggaagcacatgcctgagcaggtgggtgtctaagctcctctcagaaatgagaggacagacctggcatacatcctgtgaggggaggagcttcctgtgtgcactccagtcccaccctttccaacatgctgcagggcatgagttctatttgctgatatatcttggctgttgtcatggaacacatctgtttgggagcctgtgcattttcaaattctcaaatgtctctcctagagaaagggcagaggagagagtctcttacctgggtccggatctcttggattcggagccaagtctatcatttactgctcgtgccaccttgagcaagtcactctctactctgggtcgcaacttcttcaccgttaaatggagttagaataactgcctcccaagatagttcttacatcaactagtagagtctgcaattgcctagcacaggacttgacatgtaaatgtcggatggaaatggatgaacgaatggatgaacaagattaagtctatttacataaacaaaacagaatgcccgtgaagagttttcaaaatgactgtatttcaataaaagaaaagagctatttttaaacatggtgcttaacggaaaatttatttaaaggattaagtgacatatggatacacttaaggaaatttctaagggggtttataggcattttgaagggctttagaaattgatgatcagggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccggtcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaagaaattgatgatcgtggttccattggaataattttaataaatatgaattaaggaaaagcttgggcagttgtcctttatttcttttattcaaaaataaaattaaaattgaacttttggctgggcgtggtggctcacgcctgtaatctcagcactttggggggccgaggcaggcggatcacgaggtcaggagatcaagaccatcctggctaacacggtgaaaccccatctctactaaaaatacaaaaaattatccaggtgtggtggcgggcacctgtagtcccagctactcaggaggctgaggcaggagaatggcatgaacccaggaggtggagcttgcagtgagccgagattgcgccactgcactccagcctggacaacagagcgagactctgtctcaaaaaaaaaaattgaactttttctagggtacgtgggcaagagttagaaaatagagaggagggagaaagggcctaaagataatatgtaggaaacattgctggaagcagaaataacaaagctggctttacagaaataccacaggtgtgcattgctaagcacagtctcatttaatgcataaaacaaaactaagtaggaactattgttatcttcattttatagatgagaaaactgagaaccatagatacatgtggtcacatagctagtaggtaaagtgatgggaatttatatcaggtttatctctggagaaagaaaggtagcagattgttcctcactgtagacaccagggcgctgtcgccacaagacagcttggttgttagaccagctgagctgtagcacagattcacagagaacagagatctggaggaaaagtcagttttcaaaaagtaagtctcatatgaagaacgtgcataattcaattccttttcacttgaacataactaagtataactattaggaatttaccaatgagggggaagaatatttctttgcttatgaacatttctgaaggaaaaataatggcattactaatgaagtagataatgtctcaaaattattaggaatatttttaggatatctacagaattttttaaattacttggcaattctttacatagaatactcaattaatcagcacgtattttctattttcctggcaagaagggagaaaaatgagtgggggaaggagagatggagagaaagaaagaggggaataaaataaattcaaggtgagggacatatacctcaatccatatcacctcttgttattctgtaaagaaaggagtcagaaggactttttttttttttttttttttttttttttttactaaatctggctcttccaccaagtttcattaccttgagcaaatacatttccctctctgagcttcattttcctaatctgtaaaataagagtttttattttacctagagtcctaggcagtatcataggattctatgcctcaaatgcatggattcaaatctggtttccttttccacagtgcatgtgctactaaggcaagagccactatatgttattggggaaggccttttctgccaaagcaaattggtgggcaaaccacccactcaggaaaaacagttagtcaacaagtgtggctcagtgtccatgggatccaggagccaggaagcttactcagatcacaggatgaatattctcctggaacatgcttcttctgaataataataatcatcattaaaagctattgagtgttcatcacacctcagacacaattcaatgtgtattctctgcattaggtcctttaagctttgcaatgaccccataaaatcaattccattgtccttgctttacagaggaggaaagtcgagccagaaaggtgaactaatgtgcccaaggtcacatagagcctgcaagtggcagagccaagactctaacccagatggtctgattcaagcagcatgctccaaactatagtatcagacccccacccaggcccctaactatagtgttacaccctcaccccaggcccctaactttagcataagacccccactccatgctcctaattagagtgtgggacctccaccccatgttcttaatgctagtgttataccccaactcctgaaactagtacttaggtgtatatgatataaacattttcttcactgttgttattagtaatggctacctgattattgcaatagtcaatgagaagttaaacacttaaggaatagatggcatagcaaagattcttgttatcttccccaaatccctttgtccacacccctttgtgattctcagacagacctacaactgctcccgtatgtggctttttgcttgaggacttccccagctctctcagcccacattgtggcaggccaaaagcactgctcaaagtataacactcaatgagtgactgatgagacatggtggataaataatccagccctcctacccctcagactgggtaactctgagatgtgttttccacagtttcccgagggtcccagttggattaagatgtgacttcccatggtggtgttgctaataacatagcccttatccacctctttcacctccctgcactcttccctgcatttcctgggatcaactggcacataaactgcttctcagggtctgcttctggggcaatccagaataggatactcaaacaagatagcaaagaagactctaataagataacaagatgagtggacccacatacataattatttggggctaattttcaaagtttaagctatattggactgttgggcaacatatattgagtactgtgatatgaagagtaccctgtgcaagacacattggatacagacatgacaccttccccatctttctgttcttttgaaatgagaggtgccatcaaaaggacatggtcagaagacccaacttcatgtcctatctcttccagtcacaagcaggactagtaactgggcaaggccctctattccctgaaatttcagtttccgaatctgtaattacaattcataattcatagtttggtcatgaagaaagatttgatgagataaggtgtgccaagtatttttatgaataaaaaagtccacaaaagtaaaggtcgcaaaccacagaattttaaagaaggcactctcttggcaaaatcctttgtaagaagggattgttttcacctgctctttaattttgaagcatatgattttcagatgagcagcacctacacacctaccacaagaaataccaataacttacctttgaaaagctaataatcaagggattttaggtaaatatggtcatgtatagacttgttacagaaccttcctcctgcaaatacctaagaaaatgagcaggaaaagagtcgttaaaatcaataacaataccaacaaagcaaacctttacacagattgaaaaaaaatggccagcagtaaccaaacaaggaaatatatcacatacctagaaaactagcagccaataaaggataattctagcataggagattctgtctccactctttagaaaacagcactgaccagagaaggagattttatgaaccctaagaactcttgctaccaccttgattttatgggggagacagagtgagcaggtgagtcagcaattgcagagaaagatcaagaagataccttccccccaaacagccctctcaaagggtcctggggattgccacttcctaagactatgtcctaatttgaggaaaccagttaaaggccactggagtagaatatgcccctgacaacatggaatgggttccggtgcatgtcactttacaaaatctaagaagagagagagaagaacccagatcctccataaagggctgctgacacccctaaccaatttttctacccaccccacccctgccacattttcccataatttattgaaaacttactgaaagttagtactcagatctcaaactgtgatgtgaaagccaagataaactagaagataaaaagaaaaggtgtcaaagatcggtcttccatcatatcacagcaggtggcaatctggacaaagtagctcactgcaataaggataagagaaatggaggacaatgcacagggaaagagccaacctgggaaactagaacaaagaagaaaggaaagaaagggagagaagaaggaagagagagatttcccagagcatacaatatctatgcagaaaacaagagaacaaagtcgctcacgagatggccaataggaaagggaaacaaagctgatccaacacaaggataatgggtgtctctaaagcaaagaatccaacatgtagaaaataagacattttcaaaggtataacataagaagtaaatgaagagtggatctgcagctcaaagggatatgctatgttctacaaaaagttgctataggaaaatcaacaccagaatatgatttggttctgtgtccctacccaaatctcatctcgaattgtaatccccacatgtcaggggagggacttgtaggaggtgattgaatcatgggagtagttcccccatgctgttcttgtgatagagagggagttctcacaagatctaatggtttcaaagtggaagtttcccctgctttctctctttgtcctcttttgatatggtaagacgtgtcttgcttcccctttgccttcctccacgattgtaagtttcctgaggcctccgcagccatttggaactctgagtcaattaaatctttattctttataaattactcagtgtcaggtatatctttatagcagtgcaaaaatggactaatacaaccaaaaacatcatagttaatgaatttcaaagataaagaacaatttcctcagggttctaggtagaaaaaggcaaacacctaaaagacaaatatcccaagtagccccaatcttcttcacagaacatttaacatcaaagctaaataccaaaatacaaatggagatcatctctaggtggaaggcttagaggtaatttttgtttcctttttatactttgtcatgttgcatgctttaaaaaattattttacatgagcaaatattattcatgaaagtcagaaaaaaacaataaaactattttcattcttaaaaacaaaataaaaataaaagaaggcctgcctgaaatgcattctgtttctttatcaaaccccattctttctcattttaccttggattggaagaaagagaccttaaaagactcttaggaaatcaggccaccaaggccttcagtaagagagataaatgaattgcagggtttgggagagcattcagataaaactatgaagatagctaagttcttttcaagtattttaagttttgttagtatcttagacttgcttggggcccaagggagtagttaaaactcatgctgtggagttacccagagtcactgagtttgcagcttactggtgatgtgctcttgaaaaaattacttaccttccacaagcctaagtttctttgtaaagtaaatggaaaaataatagcagtaactatcatatcatagtgataattaaataagataatatatgtaaagtgcttttttaaacttttatttttaagttcggggtacatgtgcaggtttgttacataggtaaatgtgtttcataagggtttgttatgcagattatttcatcacccaggtaccaagcctagtacctatttgttattaatatttttcctgatcctctctgttttcccaccctccagtaagccccagtgtgtgttgttccgctctatgtgtccatttgttctcatcatttagctcccatttataagtgagaaaatgtaatatttggttttctgttcctgcatttagtttgctaggataatggcctccagttccatccatgtccctgcaaaggacatgatctcattctttttttatggctgcatagtattccatagtgtatatataccacattttctttatccagtctatcattgatgggcatctaggatgattccatgtctttcctattgtgaataatgctgcaatgaacatacacatgcatgtatctttgtatttgtattcctttgggtatatacctggtaatgagattgctgggtcgaatagtagttctgtctttaggtctttgaggaacggccacactgtcttccataatggttgaactaatttacactcccacgaacagtgtataaatgttcctttttctccacaacccagccagtatctgttatttttttagtttttagtaataggcattatgactgttgtgagatggtatctcattgtggttttgatttacatttctctaatgatcagtgatattgagcttttcttcatatgatttttaaccacatgtatgtcttcttttgaaaagtgttcatgtcctttgcctgctttttaatgggttttattcttgtaaatttgtttaagtttcatatagatgctggatctttgtcagatgcatagtttgcaaaaatttctcccattctataggttgtctgtttactctgttgatagtttcttttgttgtgcaaaagctctttagtttaattggatcccatttgtcaatttttgcttttgttgcaattgcttttggtgttctcgtcatgaaatctttgcctgtgcctatttgccgaatggtattgcctaggttgtcttccagggtttctatagttttgggttttacatttaagtatttaatccatcttgagtgtatttttgtatatggtgtaagggaggagtccagtttcaatcttctgcaaatggctagccatttatcccaacaacatttattgaatacagtcctttccccattgcttgtttttgtcaggtgtgtcaaagatcagatagttgtaggtgcacagtcttatttctgggttctctattttgttccattggtctatatatgtgttcttgtaccagtaccatgctgttttggttactataattctgtagtattgttttaagtcaggtagtatgatgcccccagctttgttctttttgcttagcattgccttggctattcagtctcttttttggttccacatgaattttaaaacggttttttatggctctgtgaagaatgtcaatggtagtttaatgggaataacattgaattcataaattgctgtgggcaattttaacaatattagttctttttatcaatgagcatggaatgtttttccatttgtttgtgccatctatgatttctttaagcagtggtttgtagttctccttgtagagaccttgtaaaatgcttttcataatgcctgccacagttaccatcatcatcttcaccagcagctacagaagcaccatcgtcatcatcattaccatcatcatcttcttcatcaccatcacttcttgctaagaaaccttgcatatattactccccttctcttagcttcagctaactcatcataaaatgggggatataatggagaggagtcttgattattattattatagtatctaacacctattgagtgcccttcatgtacaagacttatattaagtgtttgcatttagtagttcatttcatgctcacaaatatccccagtagcaagctcctactcactttacaggtgagagaattccgttctagaaagatttagctgagataggacttaaacctgatcttactaacaccaaagcccaagctccagtccactatgctttaccaccttctctggttgggaagatcaagggagataatgggagtgaacacacctgtgtacaatggagctgtgcaggctcctcatggttgcttagggcttggtctgaaggcctagtgaaagagaggatctgatatcaatgtaccatgaattccctggcatcctaattatttgttctttcatcaatcctgcaaacacttacagagcacctggtatgtgttcagcactgtgctaggatcaggagtcttaaccaataaacaagtcatggcctcaagccctgaagaaacaaagagatgtaccaggaggcaatttgtcagtgttctactgcattgtacattgatgtaccgcattccattgtaccagcctcagaagtactgagttatccacaggtgcttccaaaaacacacctaggaaagacacagaaagtgaaacatcatcacctaaccctgttcaggcttcagaattgctgtgaactgattcccagtggtgttagctgcaggaccaactgagtgtgtgacacaaacactttctgacaatgaaatattttgcagaaccaaaggctggtttcattacatttcagtgtgtaaccattattctcacacagttcaatagatacctttaagatatagagtctaatatttttgtagtgaacagcatatcaaatcttgtcaaaatcaacttttgagcatttaacttatgtaagtaaatattgatggagtatctactctgtgggaaatgccagacaaatggagatagtgcctgatcagaggggctcacagtgtagtgggaggtgaggggacgctccattccgagttgtttttgatttgttggagtgcaagccttgctggcatcatagtggggtgataacggtgaaaggtctggagagattcagacttgagttggccttggctttgtggctttgtcaccctgggctgcttggttgggtcggcttgctaagtgattgtgtatgtgcaatgcttaccttgaaagctttacctcaatggagcaattgtctccaaattcagacccttcctttcatctcacctgccgtgatctgagcccccctaaacaaccattgcctcctccctggactgccccaacagcctgctgcatcctctcctacaccctccaggcttttctccaaagagcagtgacctctgtgaaatgcaaattgatcacctcaactgctgcatagcagcccaaagtggttttcttcaactgcaaacccctctccatgatctacaagaggctgcttcattggccctgctcacatttgctacctcaccccattcctctctgcctccttcaggtgtctggacagattggcccctgttgtagactttggcccaatcctttcacctgtaggacctctgctggcccctccctccactcggcatgatcttccccagatcttcaggagccaccttcccgtcttcaatccacatctccaccatctcctccccagagcatccttctccacccactgccaaaatagacagtgcatctcctccagaatgcttatcacattttgtatttatatgtatttattcatttgctcactccccttttttatttttatttttttatttccataggttttttggggaacaggtggtgtttggttacatgaataagttttttggtggtgatttccgagattttgatgcacccatcacccaagcagtatacattcacccaatttgtagtgttttataactcacccccctcccaccctttcccccgagttcccaaagtctgttgtatcattcttttatctttttttttttttttttttttttgagagggagtttcactcttgttgcccaggctggtgtgcaatatgcttgatctcggctcactgcaacctccaccttccaggttcaaatgattctcctgcctcagcctctcgagtagccgggataacaagcatgcaccaccacgcccagctaatttttgtatttttagtagagatggggtttcaccatgttagtcaggctggtctcaaactcctgacctcatgtaatccactggcctctgcctcccaaagtgctgggattacaggtgtgagccaccgcgcctggccccagttgtatcattcttatgcctttgcatcctcgtagcttagctctcacttttgagtgacaacatacgatgtttggttttccattcctggactcactcccattttaatgaacaagtcatcccagcagacaagggttccgcatgaaagcaaggacatgttgcttttgacctcactgttggaacagccccagcacataaataattgttggatgttgacacaatgaatgcctccagcctagtaatttccaaattgtgttcactgtctctctagagtttagtaaaagtccctgagggatttcccatccattacccactctgtcttgtctgagaaacacccaggtgtagatctcattggcagagtggtgactccagctggagatggggaggttcaagtgggatcccagcagtcatgctgagccctaggtcctggtctgggcacagggcgtgatcactggtctcactgtacaggatatggaggaaaggaagggtatagacctgagaccacatgtgagtttggaaatgtgtagggttggcttgggttgtggtggtgactggaggctctcctggcatcagaaagtaaagggtaataaatgccctgcaattgcacaggacagtctctcaaaataaagacttgtcccactgcaatgccaccagggcgactcaggaactggggcccactacacatccagtcaaggggcaggggtgggggggttctaaagtgtggcagatggagatggatgctggaggcatgaccttctcagagtgattaattccatgtcctggctcacacactgcaggtggcatcccgttcatcttgactggtgagttcttccagcaatctcagcggccggctgccttcatcattgcaggcaccgtcaactggctctccaactttgctgttgggctcctcttcccattcattcaggtatgactgacaaggagtcttttgcccatggggttccctttgattctgcagcacttgaggggtgattcatagagcagaagttgatctctctcctctcaactggaaactcatgctattttcctaaggaaggaagaaactatgctttgggcaaaacctttcatccctttctctttcctgtgccttcctagagcttccctaaatgctgtgggctctttcagagggtgtgggctacccattgctgacggtatgcaaggactcctaggttagcaactcaaacctacaacctacttatcatttttacaatgtgctcatcactgtgtaagacaaattccatctaatagttccagtgcacactgcaaaccaccacccatttaacatcctcattgtcatcatcataaccacagctaatgggatcattgtcccaagggtgacagtgatcagtaggaaaatgcccacatactcaagaatcagatacaagtctttttgggtagggaaaggatctgttcattggaaaccgaattcattaattcaacacatatatatgttgagtcccagctgtgtgccaggcacttttctaggcaatgaggatacagtggtaacaaagcctgtgtttcctggttctggagctgaacggggaaacaaaagaggcataagtgctattttaaatggggcaatcgtgaagggctctggaaggaggtgaccgttgcgcagaggcctgagtgaagtgagggagcagagctgtctgggaatggtgaagtcctggctagaaaaacagcaagtgcaagggcccttaggcagggctaatatttggcctgtgtaagaaaccacccagaggcctatatgactgaaacagagtgagcaagaaagatgggtgagagagaggatcagataagagggttatctgggagcaggaacacaaaaggctttgcaagccttctgcacagagcaaggggcccagaagcatttgcagaaggaggatgaagcttccctgctcaaatgcccaccagggctccctgctgccctcagtgctgggtggtaccacctggaggaggtgagaatccgtcatatacatcaccacccattctcaggagctatttcaatcctgtcttcctgtcttcctcccctcaccaactattctggacactcagttctaagtccgcctgctaatttactagtgccaagcccaacacatcccagagattctgctgccagcttgggtgagccaaaggtcagtatttgcggcactccaagccccagccaccccagcatggtggctgttcctgcattcacagttacggagcagttgctctgtgccgcaccctcccccatgcatggctttctgtgcccacatcaccctcacacagtcctgagctggagtttctgatccttgccactgtacaggcaaggaggtccaggaagcagacatggtcagcccaggtcccacagtcagcatcaaacccagtttctccacttcaccaccttgtgctcaacttccctctccatccatcacttgctacagcctcctcgtctcagagttagaaggctgccacaccctgtaactttcaagacatctttgtgttttagcaacaaacactctatttctgaaacgtaagggctgctgggggctccatgagccatggagttagtcaagatcccacactcatttattcccatcctgggacaccttcacgtggctgcagtcagaacataacaagtatcttttcaattgactttaaaccttaagtggctttttacagtttggctcaaagccagcagagccaggtgtcagtaaaatcctcattattgtggcaaaagttaacttcaagctgcttctgtcaacatggttcccccatcacatttataaattaagtagagaagttccagcaccttcacatggcccagtactgagatttgtatgtccgagaagcaggccactatcttctgagccactcaggggtgtggggtgtgaaagaccttgcttgcctgccacagtttgagcattaacagcaccaacatgccactttagtatagtgttcactgaacgcttgctgtgtgcccagagtgctccaccgctgcctgtgctaggaggtagtgcctgtatcactccctttgacaggcaaggggatgagctcagagagatgtagtaacttccaaggtcactgcacttccaaacctagataattttttgtatttctaaaaactggaatcaattctttgttttgttcttgcttctcttgcctgtcatttatgagccttttcttatgcctgtgggcattttcgaaacaaatcccctctggaaacagttcctgagaagctgggtatgtccagggtgtctgggttttcaggggtcattcgggaaacattgcaggtgtgactattgatgaaccttcatcggagcaggaacagccaggctggacatacagatggagacactgggcaggtagatacgtttagtattttgtgaaatgtcagcctcctgacccaagcctgggaaggcacccacggttaatttcctttccggagaggagcttagcaagttagagagctgggctcagggggctgctgtgagcaatgatcaatgcattagagaaatacagggctaacaagttctgagtcacatcccccaaccccagcccaccacagccccactcacgcccgcccatgggagcaacgtgtatgtgttctagatgccatacgtgaaccatttctgacctacctcccttctgaaaaccagctcagccacaatcaagagctactgtgttcatctactcgggcctcgggccgccatgaccaaatagcacagactagggagcttcaacaacagaaatttattgtctcacaattctagaaggtagaagtctgagctcaagggcttagcacggttgatttcttctgaggcccctctccttggcttgttaatggctgttgtcaagttcacaactacaccaattgttatccccagggtcaggttccagctcatgctgaggtccgaagggagtgggtggatgagcagacagctggaagaacactcagggggccgtaggcaggtgcaatgtagtctctcatgagaagctcactcacactagttctctcacactgtccaccctgtcttggctgcttagtccagcagctcccacacatggctgcactgccagcttgcccttcaaggtcagcagcttaactctttctctgggcaccagaactcaagctatgtcctggctcccctctttccattttgcagatggacagctctggttttctctctctttctctgggcgccagcgcaagagtgcatgtacagtgtcagcagggcagttataccttttacagacaacagtggtgtagggccaagggatgcccttcctatgttatggctacatggctgtgataacaagtagagttatacacctgccctctaaactcactgagtcactctggatgtttacctcagcctacccttgaccaaagcacaaccatgttccttgcagctgtcttctccctgtgtcctcgcatggtctcccttctgtgttgatctgtgtcctcttctcctctcttatgagaatagcaggatattggattagggccccaccctaatgacctcatttcaacttaatcacatcctgaggtgctagggcttaggactcaacgtatgaatttcaggagggacgcagttcagcccacagcagccaccaagagaaactactcacacaacttgattgtttcacttattccaataagtatcagtggcaaatgtattccagcccccaaacagacccctaagaagcctgggcttcttcctcagaataaaatgtctgagccagtagagccacagacaacggcacgaatcacgcctgtattgaagcccatgtattagcggagggcgctgagcatgctcctcaagcatgggtttcctctccaagcctgggtttcctcacctgtaaaacagggaaaatccttagccttctcatcaccaacagagaagggaggcaactatggttgtggggaggagcccacatcccttcatgctcacctccacactctggctctgggatcctgttggcagcatttgctgtggtcagcatcagtgttgcttgggccatttgttataaagcctgcgaaaaacactctccagtgtggagtgccaatattttccgattcagagaaaattgcatgcaaatgtatgcctctttgattctactcgagttataaaatgcagtttgagctcaataaattctggaaaagagcaaattattcttttcaacctgaagaatattgggtcatatcctgagtgcctaagcagagtgagacgggcaggactagtcaaactttttctgagctttttgtttttcttcaacttttattctaagtttggggtacatgtgcaggatgtgcaggtttgttacacaagtaaacacatgccgtggtggtttgctacacagatcaaccaatcacctaggtattaatattaaacccagagtccattagctattcttcctaacactctccctccaccacaaccccctgataggccccagtattgttcccctcaatgtgtccatgtgttctcgttgttcagctcccacttataagtgagaacatgcagtgtttggttttctgttcctatgttagttttctgagggtaacagcttccagctccatccatgtcactgcaaaggacttgatctcattcctttttatggctacatagtattccatggtgtatatgtgccacattttctttatccagtctatcgttgatgcacatttgggttgattccatatctttgctgttgtgaatagtgctgcaataaatatacacatgcatgtatctttataatacaatgatttacattcctttgggtagatacccagtaatgggattgctgagacaaatggcatttctgtctctaggtctttgaggaatcaccatgctgtttttcacaatgattgaactaatttaaactcccaccaacaatgtagaagcattcctttttctccgcaagctcgccagcatctgttgtttcttgactttttaataatcgccattttgactggtatgagatggtatctcattgtggttttgatttgcctttctctaatgatcagtgatgttgagctttttttcatatgttttttggccatatgaatgtcttcttttgagaagcatctgtgtgtgtcctttgcccactttttaatgaggttgttttttcttgtaaatttgtttaagttccttatgaactctggatattagacctctgtcagatggatagattgcaaaaactttctctcattgtgtaggttgtatgttcactatgatgatagtttcttttgcagtggagaagctctttagtttaattagatcccattcgtcaatttttgcttttgttgctcttcttttttttttttttttgacatttttgtcatgaaatctttgcccgtgactatgtcccgaatggtattgcctagattttcttctagggtttttatagttttgggttttacatttaagtctttaagcatcttgagttaatttttgtataaggtgtaaggagggggtccagttttaatctttacctcagtctctcaagtagctgggataacaggcgactgccaccacgcctagctaatttttgtaattttagtagagatggggtttcacaatgttggccgggctggtcctgaacttctgacctcaagtgatccacccacctcagcctcccaaagtgctgggattacaggtgtgagctactgtgctcggctgagccacatgttcttgactgaattttgtgaaactgtgagaataatcctcacgacacccatcaggtcccttgggaaaagaaagccaagcaagaggcagctgtgtgggtgtcagagaggtcctaggaagccctgtttgtggcctgggatacggcaggaagcctctctgagcctcagtccatccatccactcactaagatactcagagcatctactgtatatcagagactctccgggctctgggaatacaagaaaaatgatgactcctgccttcagatagttacctcttggtagggagaaggttaataaacaggcagttgcacactataatgctgcatagtgatgagtgtttttgaaggcaatgaagcagggctgggaggggctatttcaaaatgagagtcaacgagaacctctctgagaaaatgacctttaagtcggatgaagaggagtaagaaagcaggatatacagaggcctaaacgaagattattccagcaagagagaacagcatgtgcaaagattctgaggcctaatactggagggaaatcataaaggcagtggagttggggcaaagaaagtgaggagagtaagatcagagaaataagagggacacatggtcggtggccttggaggccatggtgaggactttggctttcctgcaggtgacttaggaagtcatggtgggttttgagcagaggagtgacaagttttgtcctttgtttaacaggatcactctggcttgtctgttaagaataatcttaagattatgcttaaagtgaaaagcagggaaatcagttgacaagctattgcaaaaatccaagcaaaacatgatggtggcttgcaccaaaattaggttacaatagaagtgatgacaaaccctcagatttggaatacatttcaaggtggagcaacatgatttcctgatggagcagatgtgggtgggagagagagagagaagctcagcctgcctccaagtgtttttgttggcataatcaatcagaaggatggaggtgccatcagcagagatgaggaaggctagagcaggcagttttagaggctccactttggacttgataagtcagatgtccattccgcctgcagatgggggtgtggaggatgttgaatgcaaaattgatatatctcatttcatcttcaaaacaatgtgtgggtatatatcaccatgttgcaaatgaggaaacagatgctcagtggattgaaattctatcttaaatggcacatcataagtgttagaacaacatgtgagtaatgggatcaggatttgaatcccactcgactggcttcagagcccatactctcccccttctccacactactcttgaagtctttgtacgagcagaaggcacagtctcaagagctaagcacccccaggtgtggaacatttactgcatgtggcactttaaagggaatgtctcatttaattcatacaacaaccctacatgtaccatgattatcctctttttcaatcatggaaactgagggacaaagagtctcagatttagtaaatggtagatctaggatgtgatccagggatcaagcttaagcactttgccattctccaaaaataaatgtttgtcaaatcaaagaatagaatggaattgactaaaatctggatattgcttcttgggaaatattattcaaagacagtgtcaccttatctttggatcagtagatgtttgttgcatataatagtcacaatcctgacagctgggacccagaaagtcttttatttctggaatggtggctcatgcctataatcccagtacctgggagaccaaagcaagcagattgattgaggctaggatttcaagtcttttattccacaaatatgtcctgagtacctcctataaggcacaggagctacagaggtgactgagtcactgagaagctcaaggtctagtgcagttggcagggttattctagtccaaacactaatcaggatacataaaacggagtgattgcattgagcatttctattttttctgatctctcttatttgtgcaaggccgcctcagagtatcaattagtgagttagatcatttgcatattagaaaaaactggcattaccttggcctattctgtgctccacattcttcctatgaactaaggcatttctcttcccttttgatgtcattcttgtctcatgtgtatagtagaagcaaggagacaatgtggttaattgtaaatataagcttaagctaatattcagcaagcattccattttgctttcgtgatgattaatttttaaatgccaaatttgcaacaacaacaacaaaaaagtgccattttctcatctttcccagagtttgaagctgatttattcaagccttatgtgataacacttcatgtagggtacacttgccttattgagccagcatcacacatggtgttttgtctaggagtattggtatatgaatgtggagctatcttaaaaatctgtgtagagatggtttaacagcaagtttactgattatctatttgagggtttttgtctctgcctttccacagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaacattgcaactgtgttagcattattcacaactgaatctcccaaacccttctggaagctgcaaggaatcactctatgtttcagtagacccagcgttcttctatataggtagatgacctgccttcttcatgactcaacccatgatttcaaaatgaaattggggaaatagtaggttaatgctttatcaaagaaaaatcaatttggtctgataggggactcaacggattagagatcacagactgaggttctagtcccagctttaccacaagcagccttgacctgccctcaacctgggtcccagtgcctcaatgaccctaggcttccatccctgatataggctttcagaagtcagtggaaagattattcatagtgcctaagaaatgcctgtttccaatatttgaccttgtggatctcaggctttggagagcctaataccaacacaccagcctgcagattttgtctttcccaaactgtgttccaggaatgggctcaaaacttcagggctgacgctgtcctcaccccagactattagagtcctgtgtgctcacagagaacatgaagaagagcaatgtgtagaagacttaactttctcataactgcagcagggactgaaaattgacctccatccaaatgaaaaataatgttgaggatgattctaaagctaaacctaggcttggtgggaaaaaaaaaaaaattgtgattaattggtgatctctgccacaagtgtggggctcagagtgtcagcacatgtacctcatgtttaccaagtctagaagagatttctctgaaaaggtaatgagctgtcttgaaaaatggggagttcaccatcactcaaagtgctcaagggaagactgggtgattactcatcttgactgttgctaagaaaatctgtgtcaactttggaggaaggtgtttggaatagatatgttgaggggctcttctaactcttacatgctaaagttgtttgagtaagatctacttacagcctgccatcgtaatgtgtggcttgtggtttgggcgatttcctatacttgcttctaaaatgaaacaacgtgtcctaaagtaaagtaaagtgcacttgaattagcaccagtgtgtttgaatttggtatctcataggagtggggccagagaggacttgacttagcaataccactagaatccttttggccataatcccttgggtttgctcagatcattcttgaccatggcagccttaggcaaaatttgagttcagttttccttttctgtggagtattctttcatcactgggccactcctttggttaattgccaactcaatgcactatgccatccagctttgggttggctgaaaaatttggacagtgtttgtcaagacgaagagaaagtgaggtgtgggttccaaaagtgcctgagaccaaaagagccaaagacagtgtaaaataaaagtcttagctttttggtgttctcttttatttggagacttgagaatttaggcaataaatatttattaggtacctatcatagacaaggcactagctacatactaaagatgtatcagtaagcaagaaaatatactgccctcacctgcaaaagcccatgtctaccagagaagatagaaaatcaaagcattaactgtaaagttgtcatcagtactgtactttatagtacagtaaattgtcatcaatacagtgatatagaaacatgccacagggatgactggggtgagaggtgagaatcaggaaaaccttcccaaataagtgacagaaatagaatggggaacactatgactgtcaggcaataggccaggaattattcttacatgttattttatttgaaaagctcatagagccatttctcactccattttctactgcttataacagaatacctgaaactgggtaatttatagacaaacaaactttttttttttttactgttctggaggctgtagagttcaatgtcagggggacatctgacgagtgccttcttactggtggggcctcttgccgtcctgaggcggca

SEQ ID NO: 13210 - DNA, 109925 bp, Human
tctaataagaaccagaactcagagcaatggctaacttcagatgtggccctattttctcatatgaagcttgagatcttcttccaagctcattcctgttattggcagaatttgaaattatattgaaattcagttctatgtatgaaccccagattgaaaattccctagaaaaaaagctgaagggaaccattcacattttaagtagtcaagtaacaagatcagatttctgtttcagaaataccgctctgacagcaggtgcaagaatggggtgtgtggcggggatgtggagagcggctgcacagctgggaggatgtccagtgaacgggcttaatgataactcaggctggatataggggaggcctaatttaagacagtagcagtggggtaaatagatggagggctgatttgctagtcactaacaggcagcagcctcaggtcttggtgatgggggctgatttgctagtcactaacaggcagcagcagcagcctcaggtcttggtgatgggggctaatttgctagtcactaacaggcagcagtctcaggtcttggtgatgggcggggtcaggggcggagggcggctgtgtcacaggggggcagagctgcaagcaactcttttggtgccaggggcaagctgcggaaaagagaactcagagttatggggggtgtggggaagataactcctggaggaaactctgtcatgcccccagcccatcctcctacgaactagccctggaataattaggtgaatttgaaaatgtcctccgtaggcgggagttctattcggggttacctgcggcctccccggtcctggatttcagtcctctaggtatttcctgagtagctcttaataatacagaagcccctttccggtgtaggtcggtaagaagcactgcacagaaatctgatgcgaagtggggtctcctagcggagagggaggcaccttataagtaatcactaatccaggttgagatattaattattgatgtcaagaaatcgggcttttattatatctttttaaaaactgtgtcttgaggccaggcgctgtcgctcacgcctggaatcccagcactttgggaagctgaggcgggcggatcatgaggtcaggaattcgagaccagcctggccaacatagtgaaaccccgtctctactaaaaatacaaaaattagccgggcgtggtggcacacgcctgtagtcccagctactcgggaggctgaggcaggagaatcgcttgaacccgggaggcagaggttgcggtgagccgagatcctactactgcactccagcctgggcgacagagcaagactccgtctcaaaaaaagaaaaaaaattgtgtcttgagtagaattttaatgtggagaatgagctgttcggtaaatcaattcttccctttgcaaagctgtaaaacatttaaaacatttggccagggtgacatgggcacagaaggggcagacaggaggtcggcagccaggtctgtggaggagtagccagaggtgcaggaggccgcgtcagcgtcctcccaatcagcctctgctgagggagtgccgcgcgcggcgagccgcgcactccccttgcctttctcccggcggctggtactcgctcttagagatctgcgttagctcagagctaggctcggtgccgcagaggcacctgaggttccacgactgcattccaggccccgccccttcatcgggatctggaaggaggagcgccgtgcgcgcccgcgccggcgcgagcgttgaagctccgcccccagcttctacctccggttctatcccggcgtttcgcccttccccacagacctctgccccggacccatttccgaggcgcgccgcatgcgccgcgcaacccaggccacgagcacgggcgcgtgcgcaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaagctgagcaataacgcgcagaactgggtaagctggggacgaaggcgagacggcgaggagcggaggggctgtgggagcagctcgttccggagccgccgcctctctcccgcctcctccgcatccatccttccagcagcgcggaggtgggttccggggctgcggcgcctcccggctggggccgtgtgtggttgcgaggcagaggggcgcggcgcagggtggggatctcgccctagcttggcgcagcgtgcggtccgagccaccgttcgtgggaagaacgccccccctccccagcgcctccgctcaggtaagacccccaggaaaatccttcacccgtgaactggcgcttgctgaaacctccgggtgctgaaacctgcggctgcagaaacaggagcttcctgcataccttggagtggcctgaagatctgcaaagaaggcggaggcgggcgccttcgacgcgttcttggtttttcttggctctgccagtgcggttggcccaggtttgggtccatctccgtgtctttccatttctgagtttcagtgtgaaaggagagtacccaacaatgtggtcattcatgagttgagactgccctgaactgaggttctttgtgtctctgtgttaaatcggaatgtttaacaagtaggagtttggaagactccattcctggtgacagtcaggtatgggaccagtcctttataacgtttagtaatgactgccagttgactttgtaaagtgctgtgtcctcataacgttgcttacttccttaatttctctgtgatgagaaagagccttatcttcctttgtaagtgtgcagcagggaagggcccatctttggagtctggaaaggcactggtttaagtttagacggaaacgttatttcacagtccaatggaataataaggtttaaatgcaatgtctcccaaaacgttacttgccctagatgaatcaaagaaaaaaaaaaaaaaaacaagcaatttcaggcaaatgttctttggaagtcattaatttaccacatctgttgttattgttatcatgagttgtttactgattcctctctccttttatttaactctatagatggtaaggaggggaaggagatttaaaagatgaattagaacagtggaaagagcgctggactcctggcctggtctctcatcccagctttgccatttactagctgtgtgatcttgaggagagtcactttactttttcgaacctcagttgacttaagggtataatagtatgtacttcacgggattgttttgatgaacaaagaagacagatcatgaatttgaatgtgcggtgaaaccactgccttgaaactcagactcagtttcgcttctcttaccttaaggtgtttcacggttagggaaataaggttggcttacttggggtatttacagatgatttctgttacattgtccatttatgtactcatttatttattaacatttgccacatggtgcgtattctatgtagagacttgtgctagacatggtggtgaaaaatgtgggacttactgcttgccttctggtagttcatggtttgtgttggggttgtgacatttgccaagtggtgaatatgtctttgtggtccagagtgagtggcgtaagacagaagttttattgcaatttagaggagagattagtttcgcctgggcgttttgggagggtttatggaggatttcagatttctgagtcagaggggaactgcatggataagtgttgggaataaaaattactattttttttactccagaaacattgacgaaacttgtttgactgccctggagagtttttgttgggaagtggaggtaagggtcaatagggaggctggggctccgtgatgctcttgtgtttggctgcagagaagacttgattctatgggggatttttgatggggctagaattttaaattttctgatccttgtaaatttttctctccctcatggaacacccgtcatctcttcctctctcatatttaaatcatcttaataggcacaagtgtgaagaacccatatacctttaaaattcctatcacaggataaaattggtaatccaggaagaatgttccgctgaagaaatgtagaccctggtaggacccagatggggaagccctggagaccagacaaggttatagtaaggtttaaatgaattaatagatttgaagcctgcctggcacatgagcactatttatgttcttgttaattcatccagtgtgaggggctgaagggctggggtaaggtggcagtgggactagaggagtagctgcattaaaaacatttaaggaagagttgagaggaccgactagatttaggggatgaaaaagggaggaatgttagaagatgatcctgaagttttggtctgggaagtggggagaaaggttgttacctgtgtggaaattgggaagtaggttgggcacgggggtaagggtgatattagttaaacacaaaggagagtttagtgtgtgccaggaacagtttgaaatgttttacctatattagcccattgagtttttgttgcatttctgagggtgaatattatgagagacagtggttaaaagcaggaccctggagctgactgcctgggctgaaatctggactccactatttattaactatgtaacttttggttggtcacttaatttctctatgcctctatgtgcttatctataaaatgagaatgatagcctcacagggatattgtgacaattagagttagctcttactgttatcatcctctattacaattagcatttgcattttatagatgacaaaactgaggcacagagatgtcatggagcttgttagtgctggacccatttttaaacctgttgcatttgagggacagccttagtagagatagtctatagaggaaatatgagccatgtatataattcaacatttactagataccacattaaaaagtaaaaagtaaccgcgaaataaatttcaataatatatttaacctactatatcccaaatgctatcatttcagtgttttttcaatgttaatataagttcaacactatcataattaataaagagttatagaaatctggagtttttttttttacagttagtacacatttcacttcatactatccacttttcaaatagtagggacatgtggataacatagttacagaaattgagttgtgctgaggttggaagtaaaggtttcatagttaaatttgagttaaagaatataaggaaagtaaatgtgagaccaaatactaagctttggataatagctcctgttaaggattaggtaaaggaagtgtactcgtgggagacaataggcaaagagatgggaaaatgtagtcttacagctctgggaaatggttagaattacaggaagttaaagttgtccatatacctgtgggaatagtaaagaaaaaccaagaaattgacttgctcttggagctgcctcttacttcagtctgataaagcgtcagatataatgaatatcattttctatccaattgaatctttctccaatgggaccagttttcatctgcccttggggatgtgttagttgggctgagggaaatttgggacactcagttcaggcccaggtgtcattcacccattttgtagaatcatattgggctgaaaccctgttggacctgccttacagtggagtagtgtcctaaaagaagcgtttgaaactggacgtgacattaagaagcatatgcagtctctggtttgcttttccattcacctttcacaactccctgaatttccatagctccagcccaactttctgtccatatcatacatcctcatggttttacacaagcctttccttctccctgggatgcctgttaccctttgtcaggggctgaaatgtttagagccttggaccattttaccttaacaaatgtgtggccctcataggtacatatgttcacttgctcgtgggctgaattgtttgtgctcttctgcattatgttgcattctctctgctattatgtatcttgtgatcatacttcattatagatgttttgtatctacactgagcttttcctgatataacagaattggggataaggggcagatgcaaagtagctcggtagctctgatattgaaatccttagataattcattagtatcttacaaaagcttaagtaacggaataagctccatatgtgggaggattcagattacggttttgtcacttaccatctgggtgatcttgggaacattatttaactccttcatctctcaatatcctcatctgtaatgagataataaaacataactcatagtgaggctaatggtgcataccatatggggttatagtgaggtttaaagaagttaatatatttataaaactatggttcctggcacatgagtactattcttgttctaattatttattagctcctcaaatatttaacacttaaactttgtatgtgcctttgttccaggtcctgaggatgcagtggtaaaaagacagaaaagtgtcctgtttcatggatattacattctacctgggagacagttaattaaaccaaataaatgaatgaaataattctcccttttaccaattctatctttcccaaacagcttgtctccttatatgtggatgtttttcgtagaaggccagcagcacattctggatttagctgaatactcagatgatacaaaaatgaaataagaacagagaagtggaacagacagccaaacaagaggccaatgtacttgtccttcagaggattggcctgggtgtggtcaggggcaggcattggtcttttatttcccccatccccaggtttaacagagaattgatctttctaccctgggaagatgatactaaaaaaattgcctgatgaaaagggaaacttaaacttctaccaataacagcaataagacgaatgatagtgaggtctagatctgtgttgtccggttcacgatccacttgtggcaactgaaatttaatgaacattaagaaagtaaaaaattctatttgttagttgcagtaaccacgtttcaagagctgcgtatgtggttagtggccacaggaattggacagcacagtatagaacattttcatcatctcaggaagctctattggacattgcagatctagatgaagctttgtgatggctgctattttttttttctacttatctgtgtgtttatgtattcaggtatttttactctgttcccaagaacaggaaatttccagagtgagtggatactttgagattttagttttgggcagttttgcaccctggcttctggtagcatgtccagcagtattagcctccccttagcgtagttgcttcttcagatttgaagtgtcaatatgcttcccagcctgggtgtgttacattgaattttgaggagtagttctctatgccagtggttctcaatcgtgagattttaccagccctagggggcatttggcaattctggagacaattttggctattctacttgcgtatggagggggataattcttctaacatctattggaaaagatttcttaaaaaaacctaaatttctaaaaaaaattcttaaatctgaaatgcaaatgtaaaatccagttgaaaaatccaattgttgtggcatttttttcccccatcagcctggaagttgccatttcttactctgagatggatcagttactcatagcataccaataacaagacaggaaaaccccaatcctgaattgttttgaaatcagattaagtaattagttcaaatggagggagtgatttttctttttggtgttaagcggtagtagagagaatgttctcagggagactattgcagtggctatagagacttctgcagtggagttttgccgtaggggagagagattgggctcagttccaaatacagtaaggaaaagtgggaatttatggtgagggagcagggtgggggtcggtggatggaaaattactaagaggaaacattaagaattagggagtattctgactaaaacgatttaacagggttcttgctgaaggcaggcaggccaaggtgatcagacatcattgggggatggtgcagcttgaagagtttggtcagctatggaggatgggggatttctgctaaaattggactcttgaagacgtgcccgaggatagggcccagttgaaagagggttcagaaggagcctgcctagtttgatcaaggagagaaatcttgtcggtggtaatcgtttctgtgacatatcttttcctaaagacacagttgttaaattttaactgaataatgatggtggaaataccagacattatgtagagaaattcagtatctgtctttggatgaatgcagccattgtgcaggctgttttctcttattcttctctctagttactttggtgcttgcataccttacctctgtctttgtctttcatattttttttttcttttttttttttgtttgagacagagtcttgctctgttgccagactagagtgcagtggtatgaccttggctcacggcaacctccacctcactggttcaagtgattctcctgcctcagcctcccgagtagctgggactacaggtgtgcaccaacatgcccagctaatttttgtatttttagtagagatgagattttaccatgttggtcaggatggtctcgatctcttgacctcgtgatctgcccacctcgacctcccaaagtgctgggattacaggcgtgggtcaccatgcctggcctgtctttcatatttttaagtgtacaattcagtggtttttagtatagccagagttgtacagccatcaccagaatctaattttagaacatttacatgtccccaaaaagaaaccttatacccattagtagtcattccccaggctctgcattttctcctagcccctgacaaccaataatgtactttctgtctctatgggttatgctattgtgggctttcctagaaatgaaattatataatctatggctttttgtatctggcttttgtcacctaggataatgttttcaagcgtcatccatgttacaacatgtatcaactagcctggccaacatggtgaaacctcgtctctactaaaaatatgaaaaaaattagccacgcatggtggcatgtgcctgtaatcccagctactcaggaggctgaggcaggagaatcgcttgaaccagaaggcgaaggttgcagtgagctgagatcatgccactgcactccagcctgggcaacagagcaagactccattttgtatttttttttttaatagttcattcattatatggttgaagaaaaaaatcccattgtatggataataacacaactttttttttttttctttcccgagacggagtctcgctctgtcgcctggctggagtgcagtggcacaatcttggctcactgcaacctccgcatccctggttcaagctgttctcctgcctcaaccttgcgagtagctgggattataggcacgtgtcaccacgcccagctaatttttgcgttttgagcagagacggggtttcacaatgttggccaggatagtctcgatctcttgacctcatgatccacccgcctgcgcctcccaaagtgctgggattacaagcatgagccaccacgcccggccacatcttctttattcatcagttggtggacatttaggttgttcctactttttggctatcatgaataaatgctatgaacatttgtgcataagtttttgtggttagtcttatgtggttttaatagttaatttcaacctttgaggtggacattagtgtattttggctgcccagtctctgaacctcccttgtatgtgtggtgaatgcctcactgtgtttgtgttaggagacagggtctgttacagatgaatgatttctttatttacctatgtataactagttctttttatgaaatgtttttgtttttattgtgtcctgagtgtctagaaaggatcaaacaacaaataatgaatgaacagatagtcccaggcccattctgacttctaggagtgtcttagggccggaattcccagttggaggtaatggaatggagggcccttccattaaaggtactgatataaaaacctattaaatatttagaagttctttaatctttaacagaatagttggagagccgtaatgtgtatgcagagtgtatgcatgacagatggtactgatgagataagcatgctagtaacttagtcctgattcaggacgtctgtggtagggcctgagatttgcttcctaacaagcagccaggccatgccagtgttgccacacagcatattttgtagtagcaaagttttaagagtagccttttcaagttgttttctcaacatcctccagggatgtatgatcttcacttgctttttatcattgacttattaatatttaaaatattaatttcagttattagttaactctgtgaactaaaggttttaattatcaagaactctgtgaactaaagatttcttttcattgtattctacagtctctcatttatccatattgttacgatctctacagtttcatccatattgtgtctagggacataaaagaaatgtgcctgttaccatttcagggatttctcattggaggaatacactgtttatcagtttagggtgggtgataggatggatgaaagatgttgaagtccacaattatgcttagtatttggtatatgctttgtgtctttatacatttcacttaaaaatgcacaattctttataaaatgatgaaaaattcacaaaatatgaaattctctaagtagcatcacagagaagttgattttccttacaggcaagtggataaaataacaaaacggccatgtggaaattaagatgggtcaaaaagggccacttgtgtcattgatgaggatggaagtttgtagtatgtacagaaaatgcataccacaaatatcagaggacatgcaatattagcctagtgacaggattgttagtcatttagttctaaatgtagtaaatattaaatggccttgcaatgaattattccatttctgctagatttaagatttccaaatatcagtcatcatttcatttgcaagttacacagagaaaacaaaccatactttaaaataaatgtcttgtatctaacttttatgagtactgactagtaacaaaggaggttgggcattgtggaaaatatggataattgtaactcattgtaaagaacatggctgtgctttggtcaaggataggtcgaggcaaacgtccagaatgactcagcgagtttacagcgcaggtatataactccacttgttatcacagccatgtagccataacatgagaaggttcatcatttggctgtaagccactattgtctgtaaaagatataattgccctgctgacattgtatgggtgcgcttgcacccagagaaggagagagagagccagagctgtccatctttgcagatggacaggagcgagccaggacacagctcgtcttgctcacacccagagagagagagagagatttaagctgttgaccctgaacggagagctggccatgtagctatgtgtgggagctgctggactaagcagtcaagacaaggcaaacagtgtgagagagctaatgtgagtgagctgctgatgagagagctgctgagtaaaactacctttcacctgcatatgcccctgagtgttctttcagctacctgctcatccacttattcggaccccagcatgagctggaacctgaccccgagcaggacactcatagtccttgacctactttctaggaaataatatataggcacaagaagacaaataaatgtgttaatggtacataaataacaaaagaatgatatgggcagtaaatgttatagggacttcctaggtacacatacttacactgagccagatatacatatatatatatttttctacaaagcacccagactattaagtaagaagcactaagcttggtttctctctcctgtgtatggaaactagggcacagaagactcagtatagaaatgtactttaaaaaaaaattccaacccagaaagccaagaatagaaatttagaggtggaaggaagtaactcattctcaacccttaatgagtcattaatgtcatgtttcctcagcagaattatagaaaggatttggctgaagtgggtgcagaaggaaggaaaggggaagtagaagaagattacatgtataagtggctgtggagtctaaaaattcaggcctaagtctaccactttgcaattctgtaaccacccaatgcgttcattttgcctgctgcccacaggcaaatttatcaagacagggtaattgcaatagagaaagagtttaattcatgcagagccagctgaacaggagacttttattattgaacaaatcagccttcctcaaaatttagaggccagagttttttaaggatagtttggttggcaaggcaatgggtgcagccagttcgttggggatgtaatcataggggtgtggaagatagtcctagtgtgttaagtacacttctggttgggagcacacaggtggttggtgggtccaggtggagccattgagagtcagaaatgcaaaaacctgaaaagacatctcaaaaggccaatcttaggttctacaatagcgatgtcatctgcaggagtaactggggaagttgaaaatcttgtgacttctggaatagtggctggtaatcatttatgtttacaccttgggaggattcaggctcctctcatctcctaacctggtggtcttttattagctttaaaagatggtttacttttggggaagtagtattatcatttaaactaaaaactaaatttctcccaaagttagcttgacccaaacccagcaatacctaagggcagtttggaggttaaaggcaagatggaggttggttagatcagatctttttcactgttaacaattttctcacttgtaatttttgcaaaggctgtttcaattccagtagttttataaaagtgctctttgatttactttgaaaaattgggagttaggacaatgtggcaattttttttaagtttattttttaatatgaaaaatattgttaaaaactttagctgaattaaatttaaaagagtttgagcaaagaacaattcgtgaatcaggcagcctcctgagccagagtaggctcagaggctccagtgcagctgcatggcagaagatttatggacagaaaaaggaaagtggtgcacagaaaatggaagtgaggtccagaaacaactggattggttatagctcagcatttgacttatttgaacatggtttgaacagttggccacatttgattggccaaaactcagtcattggcacaagggtggatacagtctgtttgtctccagctaggttagtttactacatatggagaaacctttaggctgaacttaaaatatgtaaaagaggtagctttaggcttaacttgatttaacaatatcaaacatacataaaccaaaaaaaatctccttatatccagagtactatgtttgctgccagaatctttttaaatgtaggaggcaagaaactgagggagcattctttttagagattaaaacagacggtctctacttaccctgtctgtattttttctcagccatattctcagcagttgatagcttgacagataatttttatgcattctagcttgatttgataagaaaagcagaagatattttacagagcccaaatcaattaaaattcattagatatatgtttcttcttgtctataaagagtgaagtaacttggaaaaatcctcaaacaaaatgaccaagccaaacaggttctaccagtataggcagcaaaatgtgtatagcaccctctgcaattcccttttagcagagactttagctcccttttcctccttagccagtatcaatgggagctaaagctaaagaggtgccactgcttctcaagatatacaaatgtctacttctgaagccctcttttttaagttcttggaaatgtagagctggtaagttgtatttgcttcatcagtttattgaaaagaaatgaatctagagactcattacaattttttgtaagtgattattaaatatgtaaaagtattttattggaaataaagtattaataattattgtgtaaataattattgttaatgagatgagtagatgggaaggggtgcagcttttgtggcatacctattaaaaagagttgtcaaattgtccctttggtcccagaggatttttcaggtaatggtaatgatgataataagattcagatgtgtgggagatggcatttctgctgtacaggattgcgaaggggaaggtaggaaaagagatccttaatctcatggaagttgaagatttgtatagaaatttaattccttaaaagtcaaatctgtgtattggtggaggtcagcaaaatgacagaatgggacttcccagtgcttgtcttcacacagaaacataaattgaacaactattcttgcacaaaaatactttaataaaagctaaggaaaccaggtgagagatgaccgcacctggatgtagcagagaaatcagaaaaaacacattgaagagagtagaaagaacagttttacatgacctatattactgcccccagcctgcaacctcaggcagcacgtggagaaagataccctttgcttaggggaggaagagggcagtaagcaaaagattttgcctcagaacccaacaccaggcccacctcagtgaaactcagtgcaaggcaggcccccgtagccccagactccaggatggtacctatggattgagcgtccaagcctaccctggtactaagcaggattctgcagcccaaggttccagctcctccaacctccaccaccaggccagacccaattgatgcaagttttagacttgtcttagggccaggctggccccagtggccctgggcttagagctacctttagtaccaggctggctgtcacaggcaggcacctgtggatacaggcttcaagctgtcccagcttcaggccctctccaggtttcagaccagctgagagccaggttggcccacacagccctgggcttcaggtctgccccagtacaaggccattccctgtagccccaccctccaggctggctgctgcaaccccatatttaagagatccaaggtttcaggaccatcccaatacatctcagcactataccagctcccattgacccaggctgtaagaccatttctgtggacccaggttccaggccagcacccatatgctgagcatctaggtcagctcccatggcttcagggcaggtcctgtgattctaggtaggcttcagaccaaccactgtagacctaggcttccacatccgctccagcaccagctgagctctgcctacctgctgacccagataccaggccagcctccctgaggactccagcagcaagcctgcctgtgcaccatgccagatggcctccccagattggacaggctgactggtgaagtgcttcccaaataaagccagtctacaaagactggaatcagtccctacctcttcattgtacagatattgatataagacaacaagaaatgtgaaaaaacaaggagacttaatactaccaaaagtatcaaaataaccttccagtagctgattcaaaagaaatggagatacatgaactgcctgaaaaagaattaaaaaataattgtttaaggaagcccagcaaacctcaataaaatagaaataattcagtgtattctggaaaacaacaaatgaccaacatgagaaatttaacagattgaaattattaaaaaaataaaaaattctagagctgaaaaatttaatgaataaaatgaaaaatgcaatagagagcatccatagaagcactgatcaagcaaaataattgtacttgaagacagatttcttccatagttagaggaggaaaaagaagaatgaaaagtaatggagaaagcttacaggatttataggacagcatcaaaagtacaaaaattgaggtataggagttcaaggagaagagaaagagggttacaaagcttatttaaataacaacagaaaactttccaaatctggggaaaggtataaataagtacaggaagatcaaaagttctaatcagattcaatccaaacaagactacctcaagacatatagttaaactgtcaaaaataaaagaggattctgaaagcagctagagaaaagcaaatcacatacaagggagttccaaaaatgctagcagcagacttttcagcagaaattttgtagtccaggagagactgggttgacatgttcaaagtgttgaaggaaaaaaaccctgccaacaaagaatactgtattcaacaatgctgtaattcacaaacacaaacatacagacttgcctagacaaagctaagggagttcatcactaccagacatgtcttaaaagaaacactaaagggagttctccaagctgaaataaaaggatgctaattagtaacatgaaagtataaaactcactggtaaaagtaagtccacggtcaagttcagaataaatactgtaattgtcgtgtgacaataatttatatctccagtatgaatgttaaaagacaattaacaatagtgacaataatttgttaagggatgtcttcactgttgagttctaccaaacatttaaagaaagattaatgccagtctgtattagttcgttttcacactggtataaagaactctctaagaccaggtaaactataaagaaaagaggtttaattgactgacagttctgcatgactggggacgccccaggaaacttataatcatggcggaaggtgaagaggaagcagggcacatcttacatggtggcaggagagagagaacaaggggggaagtgccacacttttgaactatcaaatcttgtgagaactcactatcacgagagcagcatgggtgaaagcacccccatgatctgatcacctccttccatgtcgctccctccacacatggagattacagttcgagatgagatttgtgtggggacacatagccaaaccatatcacgattttttctcaaactcttccaaaaaattaaagagggaatacttccaaatttattttatgaggccagcattaccttgataccaaagccacaaaaggacactagaagaaaagaaaatcacaggccagtgtccctgatgaacatagatgcgaaaatcctgaacacatagtagcaaactgaattatatagcacattaaaggatcattcctccttatcaagtgggatttatttcagggatgcaaagatggttcaacataggcaattttttcttttttttttttgaggtggagttttgctcttgtcacccaggctcgagtgcaatggcatgatcttggctcactgcaacctccgcctcctgggttcaagcaattctcctgcctcagccttctgagtagctgggactacaggtgcatgccaccattcccggctaatttttgtatttttagtagagacggggtttctccacattggcctggctggtctcaaacccctgacctcaggtgatccgcctgcctcggcctctgaagtgctgggattagtggtgtgagccaccatgcccagctaacatatgcaaattaataaaggtgatgcaccaccctaacagaatgtagggcaaaaaacctatgatcatctcaatagatgcagaaaaattatttgaaagagttcattaaccttttatgataaaaactctcaacaaattaggaaaagaaggaatgtacttcaacgtaataagggctacatagttcaagcccacaactgacatcatactcaatggtaaaacaggaaaagttgaaagctttccctctaagatcaggagcacaacaagggtgcccactcttaccacttctattcagcatagtactggaggtcctagacagagcacttagacgagaaataaataaaaggcatccaaattggaaaagtagaagttaaattgttcctgtttgcagatgacgtggttttaaataatatggaaaaccctaaagatttcaccagaagactgttagaataaataaatttagtaaagttgcagaatacaaactcaacattagaaaagtagtagtgtttttatattctaacattgaagtacctgtaaaagaaataagaaaacaatctcatttatagttgctaccagaaaaataaaatacttgggaatacatttaaccaaggaagtaagagacctgtatactgaaaactgtgaaacattgatgaaaaaaattgaagacagaaataaaaggaaacattgtatgtattcatggattgaaagaattaatattgttaaaatgtccatactacttaaagtgatctacagattcaatgcaatccctataaaaattccaaggattcttcacagaaatagaaaaagcagttctaaaatttgtatggaaccacaaaagaccccagataaccaaagcaatcttgagcaaagataacaaagcgggaggtattaacattacttaactttaaaacacactctgaagctatagtaatcaaaacagcatgatacagaaacaaacatataaaccatacaacagagcagaaagcccagatataaatacatgcatttatatttaattgatttttgacaaaggtgccaataatacatgatggggagaggacagtcttcaaaaaatggtgttgggaaaactggatatctgcgtgaagaagaatgaagttagacccttatctcacctcatataaaaaaaactcaaagtgaattaaaaatttacatgtaagatcagaaagtctaaaactgctagaggaaagtaggaaaaaagttttatgacactagtttaggcagtgatttttttttttttttggatatgactccaaaagtacaagcaacaaacatgaaaatagacaaatgggagtacatcagataaaaattgtctccacagcaaagggtgcaatcaacagagtgaagagacaacctacagaatgggagaatatatttgcaaaccatacatctgataaggggttaatatccaaaataggaagccaaacaactcagtggcaagaaaacagtgcaattaaaaaataggcaaaggatctgaatagacattcctaaaaggaagatagacaaatagccaacaggtatatgaaaaaaggctcaacttctctaatcatcggctcaacttctctactcatcagggaaatgcaattaaaaccacagtgagctatcacctcacacctgttagaatggctgttataaaaaagacaaaagtgttggtgaggatgtgagaaaagaaaatcctagtgtgctattgtgggaatattagtatagccattatggaaatcaatatggaggttcctcaaaaaattagaagtagaactaccatatgatccagcaatcccactactaggtgtataatgaaaggatgtgaaatcagtatgtagagtagatattggcattctcatgttaattgtaaattgcagcactatttaccatagtcaagatatggaatcagcttaagtgttgaccagttgataaatggattaaaaaaaagtagtatatttacacagtggaatactattgagtcttaaaaattatacaaatccttttgtttgttaccacatggatgataaaatgttaagtgaaataagccaggcacagaaagggaaataccatatgatctcacttacatgtggaatctaaaaaagttgcacctgtagaagtagagagtgaatggtgtttatcagggactgcgaggtttggggtcgagtgggggtcgaggaggatggttggaggagatgttggtcagagggtacaaaattttatttagatacaaggattaagttcaaaagatgtataacatggtgatgataataacaatgtatttctgaaaatgctgctgtggacatatgtatgtacaagttttatgtgatcatatgttttcatttcttgtgagtataatgtaggcatgggattgtttggtcatatgataactctgtattgaacattttgaggggctgctgttttccaaaatgactactattttcgcaacaacaaatatatgaggattccaatatttccatatcctccccagtacttgttattatctgtctttattacagctatcctagtgggtgcaaagtgataccttattgtagttttgatttgcattttcctggtggctaatgatgttgaatattatttaaataatgtggcttattgaccatttgtatgttttctttggaggaaagcctgttcagatactttgaggcctaagtaattttatgctttttttttttttttgaagcagctttgggagaacatgaagttataaccagtacattccacttttttcatttcagaagtagctatctcatgatacccataggcatctctttcacactttctttgggagtctactcaaatgtcaccttcttagcatttcttgattatcctctctaaagaggcactctgtttccttttttaccctatgttatttttctacagtgcacttatcactctctgatgttgtagttaagttttattggtttacattgttccccagtgggatgtaagctaattgagggtagtgaccttgttttgctcacatggcatactagtagggcctcagtagatactatctgaatggatgaacgaataaatgaatgtgtgaaaggactaggctctggagtctgccactcactagttttgggatctccggcaagttatttaccatttttcagatttaaaatcttcatctgtaaaaccttagtagtaagagtacctatgtcattggattgctgtgaggattaaatcagttggcatgtggaaagcagtaaacaccatgccagtactctaaggaaaaaaaaaaactgttttatctttttctttgcttttggcatgttacatagacttttgtgtgtttgcaaggaatatgtgtttgccttttaaaggactcatgtaaactagaattttttttttcttttttttctagggaatgcagagagcaaccaatgtcacctaccaagcccatcatgtcagcaggaacaagagaggtcaggtggtggggaccagaggtggctttcgtggttgcacagtttggctaacaggtatggtcaagagagagaaagcagtttattttaaaagcagtgcatataggtaaccttggactaggcgtaagcatatttaaattttgagctctgttcttgtatttggagcatcacgacatataactgacatagttgcttaataatatttcttgttatttttttttttgttcttttataggattgctgttaaataaaggtaaaaaccacaatgaaccttaaaactactttttcatagatagcacattaaattctacacacttctgagtgcaaataagatctggattctgctctgagaagctaacagtgaaaaccatacgtcttagtctattttatgctgttataacagaataccagagactgggtaatttatatgaatagaaatttatttctcatagttctggaggctgggaagtccaagattgagggactagcatcttcttgctatgtttgtaatacagcagaaggcatcacatgctgagaaagagcaaaagattgaactcacagcctcaatcccttttatagatggattattccattaatgagggtggagccctcatgacttaaacacctccgttagactgcatcattcaacactgttgcattgaggattaagtttccaacacatgaactttgagagacacattcaaaccatagcatggtacaaccagaaagaatgagtggcaagaattttcacaaagtgaatttctattattcagcttttgctatggcctttgattgtttccctagagtcttgtcttttggcttagtcatagcaggctggtgagtgactgaattgatacagattttgaagtagctttaaaaacgatggatgctttcacttctatgaattatatttaaaattttgatacattttgccacattgcccactaaaattttatcccagtttactctcctaccagcagtatgggagggtgtttatttcccagtgtctttgtcaacagtggttgttaccagttcttaaaaatttgtgctgattggcaaaaaagttactcttttgtttttttaatcatgtttcatttttagacaggtctgtttgtttttgtatgaaagaagatacactctcacattcttcccatttcctcattcttaattccagacagttaaattgttacatttttattgcccaggtttatagcacttaatgggtcaatagttggtagcttcccatcagttattttactatgacatgttcactcatgagctctttatttgaatggtctttaattgtctgtatttcattgttaaataatttttgcaagatggccttccattaggttctgaactcctggaggttttatgtttgagaatgactaccttttatgccaacttggctgggtaaaatatatatttggttcatactttcttggtcttggaattttaaaaacagtactctattgtcttctggcattaaatgttttgaataagtgtgagcctaatcagctttttctttttaggagcgttccttttttcatctggatgactaaggaattacttatttccctgtaaaaatacagggaaatagaggcttttgtctttctcagttaggtccttatctgcagttgatttttgtgtatagtgtgagggacagatccattttcgtttttttccatgtggataatcacttatcccaagaacatagatttatgagggtgtcttttttctctgatctgcagtgtctgctttgttttatatcaggtctccacttatgtgtgggccctctgctctgtcccactgatatatttgtctgttcctctgttaatgccacatttcttagttactgtatttttataaatcttgaaggacagtggagtaagtcctcttaccttgttcttcatcagcaatgttgacttttctttttcattgtgacttcctttttttttttggctcttagtgttgtctaaatcttgtaatagatttaaccaattcccctgaactctgttgttatttagtttgggattgcattgtatctaagattaattttgggggaaaattgatctttagaatattgggtactctttttcttgaacgtggtgttttccatttatttcatcactaatgatacttataaataaagcttatctgattttttggtacttgctctgtggtctagtatgtaataagttttcagtcatcaccttgcccccaccctatgccttcctcaattgggacgggatggctagaattggctggagttggtatttcccttcccccaggtcagttaggttccaataaaacctcagcaggttaggctttggttaaatagtttctcctgagttcagtccttgttaaaaaaaaaatctggtgctctggtgtatttcagaatggaagcacttggggatttttctccaatatttactgtgagaacctgattgagctcctggaggtgaaactcacaatgttgtggggccctccctataacgaggttcctttgaaatttttaactctcggacttgtccacactgagccttaattaattcatcaattacagtttaggtttttctgtgtgacactggttcccacagtacttttccccacagtgagtctctgctgcagtcaatagttactcccttcatttgcctgtctccccattcatggaggcagtggtttgccccctgtcctcccctcacggatccaagaagagttattctgttcaggttttcacttgttcggatgtggtggtgactttcaagctcctcccatgtggacctggaaaacttgtagttttcataaacgtgtatttgaaaagaatatgtattcacctgatgtgtgcagtattctgtataatagattaagcttgtcagttgtggtgtcaaatcttctgtagccttcatatatatgttttttgataatgatgttggacatggaagtcaagatttgtttttttcttgcaattcagatgcttaacctggatctgcccaagctattgagtgatttttgtatgctgttttgctagacgtgtttcactttttatcagattttattttagggaaattttgttgttttgtgtttctacattggttggtatattaacttcccagggctgccataacaaattaaccacaaaataggtggaagaaatttattctcccacagttctcgaggctagaagtttgaaattaagtttgtggtgaggttggttcctcctgtaagtgctgagggagaatctcttctgtttcccccttggcttctgctggtggctggcagtccttggtgtgtggacggatcactccaatctctttttgtcttatagccttgtaagaacaccagctgttggatcaccctaatccagtatgacctcctcttaatttgattgtgtttgtaaagactctatttccagataaggtcaccttctgaggttctgggtggacatgaatatttggggaacactattcaacccagtagagctggtttctattcttcaggtataccagttatccatatcttagatttggattgcttatcttgtattatcagtttcctctgactgctctgttgactataattatctaaatgaaactgtttatatcagtaattcaattttcaacagtgcttatttgtttcaaattaaatatgcacttaaaacatataaatacacatgtatgtatgaacagacacttttattataatttaggttgtttttgttgtgtaaaagtttagagtttcaaacttttttttccctgatacttgatgctcaattggtggttaaaaacaacaattcaaaagaaataacgaacaacctttttcaccctagccaccatccctttgttccacctactgttactgtgtaacaatttgcctaaaacccagtgttgtaaaacaattgccatttaactttgcttaccattttgaaggtaagggatttaaaagggctcagataggcagctatgcttagggcttgcttggttgttgtcatgctggcctgggccacagtcatctgaagtttcagctgggcaggatgtccaagatgacttactcagatgctgctggttgtcagctgggagcttagcgggctgagagtggctggtacacctgcttgggatcacgttagcatggtggtctcaagggatttagtcgctggcttctcccagtaatgtgaccaaagaaaagctgcatagcattttgtgacctagccttggtagtcacacatcatcgtgtcactatttcactacattcttttggctgcaggtaagtcctaaggccagcccacattttagggcagggaattagtacctcttgatgtgacagtagtaaagtcacattgtagacacttgtaggatgggatattcagttgcagccatctttggaaaatgcagctggctacagtcattaatatcggtttttaatgtataaagcaactgacactgtatcgatgctctcaacatatcctcctcttcttttttttttaaatttttctttaaggtctgggatacatgtgtagaacgtgcagtttgttacatgcttgtggcacggtggtttgctgcacctgttaacccatcatctgggttttaagccccacatgcattagctatttatcctgatgctttccctcccctacctacccccactgggaggcctccacctccccaccgataggccctagtgtatgttgttcccctccatgtccatgtgttcagctcccgcttatgagagagaacatgcagtgtttggtgttctgttcctgtgttagtttgccgaggatgatggcttccagctccgtccatgtccctgcagacgacatgatctcattcctttttatggctgcatagtattccatggtgtatatgtaccacattttctttatccaggctatcattgatgggcatttgggttggtttcatgtttttgctattgtaaatagtgctgcaataaacatacatgtgcgtgtatctttatagtagaatgatttatattcctttgggtatatacccaataatgggattgctgggtcaaatggtattttctggtactaggtccttgaggaagcaccacactgtcttccacaatggttgaactaatttacatttcctaccaacagtttaaaagcgttcctatttctccatagcctctccagcatctgttgtttcttgactttttagtaatagccattctgactggcatgagatgatatctcattgtggttttgatttgcatttctctaatgatcagtgatgttgagctttttttcatgtttgttggccacctaagtgtcttcttttgagaagtgtctgttcatatcctttgcccactttttgatggggttgtttatttcttctgtattaagttccttgtagattctggatattagacctttgtcagatgggtagattgcaaaaattttctccacatatgcaaatcagtaaatgtaatccatcacataaacagaaccaataacaaaaaccacatgattatctcaatagacacaggaagggcctttgataaaattcaacatctatgttaaaaactctcaataaactaggtattgatggaacatatctcaaaataataagagctattcatgataaacccatagccaatatcatactgaatggacaaaagccggaagcattccctttgaaaaccggcacaagacaaggatgctgtctctcaccactcctagtcaacataatattggaagttctggccagggcgatcaggcaagaaaaagaaataaagggtgttcaaatagaaagaaaggaagtcaaattgtcccagtttgcagataacatgattctatgtttagaaagccccatagtctcagccccaaaactccttaagctgataaataatttcagcaaagtctcaggatacaaaatcaatgtgcaaaaatcaagcattcttctacaccaacaatagacaagcagagagccaaatcatgaataaactcccattcacaattgctacaaagagagtaaaatacctgggaatacaacttgcaagggacgtgaaggacctcttcaaggagaactacaaaccactgctgaaggaaataatagaggacacaaacaaatggaaaaacattccagcctcatggataggaagaatcagtatcgtgaaaatggccatactgcccaaagtaatctatgtattcaatgctattcccatcagactaccatttgatattcttacagaattagaaaaaaactactttaaatttcatatggaaccaaaaaaaagccctctcttctattttttttttattccagttagccttctgtactaccatgaattctttcaagagcattggtacattagactttagtattttatctcttgttttagaactatcttggttatgacactcgccaagttggcaagtaatagtgcataaatgtactctttccttctctttgtttactgagtaaatactgttggtataggaaggtgagttgaaatgagggtgttctattaaaattaattatattataaattggactcccagataattgtatcaaggtggtttgtgagtgctgatgatctaggaaaatggaggtacctttgtaacatttctttcttttgtcctttctttttcttccctcaccagaaataatttgggcatatgactttgttttaaaatttggcatgcagctttagaaaagtggtaacgagaggacaaagtgaattcccaaccatgtctgctaataaaattagttaagcctttctgaagtttatcagtgatttctgatacgtttgctcatagatatttcattaaaacaaacacttattatgtttaaactgtaggtgttttcctaggcaagaggtaaatcttaaagagaaatattagataagaacattactgagagattgctttgcataatgaatgtatttaatcctgtgattgcaattttttatatctcttgagccaggagtttgagaccagctggcgcaacatattgagaattctgtctctacaaataataaaataagttggatgtggtggcatgtgcctgttgtcctagctatttggaaggctgaggcatgatctcttgagtccaggagtttgaggctgcagtgagctatgcagcctctgcactccagcctgggtggcagagcaagactcttgtttctgggaaaaaaaagtattactacatagttatccttctaactttacacatggaatctgtttggactgtttaattttaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggtatgtggtttttgtgccattgcctttctgcttacatttattgagaatatggtatcaggcaaagcacatactttaaacattgatatgtgctttgaggctaactctactcctccccagctaccatctctttgttcctgtaacataggattaaaataacctaaaacatttctatgctgtgactttctaagtaaatctggttttgataaaacctgcttttaaaaaagccgtgaagtataacacagtcattgaatttaagccaatggccaaattatttcaggctcaacttttcaacttaataaacctatagtgaatacttgacagatgtcaaactccggagaaaatctaactttcttaacatgtgccctaccatggcttctttgctcagaattcgttgttcttagcttgcatcatagttcctcttattttagagactgcagcaacaacaaaccatgtttgtgtatttctctgaaaaaattatgtcatttcttatctcaggatttttgtttcctccctgcctggaaagcactcttctccctcctgttcctgttttcacagtgtcagctgacttctagttatagatggagacttaggttaggtaccttaacacattattttattttcttcaacttttattttaagttcagggctacatgtgcaggtttgttaaattggtaaacgtgtgccatggtgatttgctacacagatcatcccatcacctaggtattaagcccagcatccattagctattcttcctgatgttctccctccccaaccacaacagtcatcagtgtgtgttgtttccccccatgtgtccgtgtgttctcattattcagctcccacttataagtgagaacatatagtgtttgattttctgtttctgtgttagtttgctgaggttagtggcttccaactccatccatgtccctgcaaaggacatgatatcattccttttttagctacatagtattccatgatatatatatatatatatacacaccgtgttttctttatccagtctatcgttgatgggcatttaggttgattctatgtctttgctactgtgaatagtgttgcagtgaacatactcatgcatgtatctttgtaatagagtgacttatactcatttgggtatatactcagtactgggattgctgggtcaaatggtatttctgcctcaagatctttgaggattcactgcactgtcttccacaatggttgaactaacttacattctcacctacagtgtaaaagcatttctttttctccacgagctcaccagcatctattgtttcctgattttctaataacagccattctgacgagtgtgagatggtatctcattgtggttttcgtttgcatttatctaatgatcagtgatgttgagctttttttcatgtttgttggctgcatgtatgtcttcttaagagaagtgtctgttcataccctttgcccactttttaatgtttttttcttgtaaatttgcttaagttccttgttgatcccattctgtaggttgtctgttcactgtgatgatagtttctttttctgtgcggaagctctttagtttaattagatcccatttgtcaagttttgcttttattgcaattacttttgatgtttttgtcatgaaatcttttgcctgtgcctgtgtcctgaatggtattacctagattttcgtctagggtttttatagttttgagtttcacatttaagcctttaatccatcttgagttaatttttgcctatggtgtaaggaaggggtccagtttcaatcttctgcatatggcaagccagttctagcaccatttattaaatagagaatcctttcccactgcttgtttttgtcaggtttgtcaaagataagatggttgcaggtatgcatatgttatttttaaaaacccaattcattgactgttgatattgatagtagctgtagtggtaataatattaacatttattgaacacttaactgtgttctggtaactgctagagtgcttttatgtgaattaactcaagtaattcttgtctcctagtggggacacaaggaaacaaaggtgtgcattgcccaaggtcacacactatacttgtagaagagcacaggtttgcatccagacagtgcgtctcctgggcttagatgctatgctgcctccaaaccccactggctccttgacagctgggaccgtgtcttatttgcctttgtaatcttgatgccaagcccggctcttggaccatattatatgattagtgtttgttgaacaatagcatactcccttgggaagccctgatatcagtgaataagcgagttagtatagaggtgagaggcagggtctttggagttggaaacaaaggggctgaaatctcagctctgccagttattgctgctgtggccttgtccagcacacttaacctcctgcagttcaagtaatgcctacaacatagggttgctctgaagattacgtaagtcatgtgtttaaagcctcagcacagtgcctggcatgtaataactattcaataaatggaataaattatattagcacaattctagtactgtatcataaattttgatggttacttggactttttttttttttaaacaagatttgacctgtaagaattatggataagtgttagattgagtattatttacacaggttcacttaattgaaccatggcaggagtcctaaaacattctgtaaaaaccatttcttgaaacccttgggtcattgccaatatatcagtttaaagtgtataaataataggagcataataagagttagagttcctgaatccttggatatacacaattttcataaaaatatgatattggcattcttataccttctggtgggaatcttgcagctctcggaaaagggggaggtctataatacctgttatggagagctatcagccgacacctgggtatctgagagtgtgtgctgatctgctttgtggcccccttgtttgtatagtgtggagcaaaatcttcgttgacctcatctataaaagcactgataatgaggtttggactatgtttagggcatctgaaaatccatgaaaatatttggattgaaacatgcaatacaggacatgtgtatttttctgtatagtcatgattatatttgttcattcaagagaagtttattgggaatttccatgtcaaccactgaactgagcatattggttctgaaaattaacctgatacttcctattctgaaggagttggtagtctggtgggaatgcggagatgtgaagagttacaatatcttgaggcaagtgatgaagtacatatatgtgaaaggtgttatgagagaatcacagaggagctgctgcttgaaatgagtcatgaaggatgaatcagagtatactagttagaccagagggagaaaactgtttcagacagaggagacagtatagtatgctcaatggaatgtgagacagtttgtttttttggggaactgtaggtaggttggtgtgactgatatgaaggatgattgtgaggggagatggagctgatcaatttgcagaggctaggtggtgacttctgcactgctcagaaaggattttgccccaaaaggagttaatagtttgagattataacagagattggtatcattgggtttgcatttgagtgaggtcatccttgaagcctggattgagactggtctggaggtaggagactagccaggaggcttgccgtagcaccagctccttcagggaagaggatgtgaactcaagcagcagcaatgggactagtaaagatgggggcatatttaagggctcttgaggcttgagtagcatcagtaagacctggtgcctgcttgattgctgattttatgggagagcagaatgaagcatggtgctttctgaataaaggttggtatgactgagttatgaagtacaggataggagcggaggacatgcgtatttcatttttggtgggttatgtttgaagtgctagtggagttagtctaagtggagattaccactgggccatctaggaaattggttttagagtttaggaaagttgtatgggattgagatctagatttaggaatcattaactttattagttgaaacctagatgaggacgattagatacagaagagtaataagatgagagacagggatagaaactcattgacactttcctttaaaaggatagttagaatagtaagatcatagcttaattgctattccagacactaaacttgtaaagctgatgagatgattttaatatactggaaaaagatctatgatcatatgtagtgagtattctgagaaccctgagaaagcaaggggcctcatcagcctgagcatgcagggaaggcttcctggaggaggtcaccatggagatgtgctgtgaggaagcacattggtttgtccagaagagaggggttgagtgttgctggtaggggttgggttgtggcgtggggaggcctaaggtagaaacagcctgaccaggcaggtattatcaatagagcatcaagtgcaagactgagaatggtggggccaggtatagggctgatgcctcacattaagaaactcggattttaccccagtagtggcagagagtctctgaagagttcagtaggatggtcagatttgcatcctttgccacagtgtagattatggctttgagcagatccgagttagaagccagaagacctgtaatatgttgaggccgttcagacaagagaagtgaggttgaactagggaatagggaaagattgcaaactgggttggtgtaatatttagaagtaacatctgaaggactttgtgactgaattaatgtatgggaaagggaaggaaccactcttaggattgtgggtgtgtagtgaggtcttccttgatttgggaagcatatgagagaatgtaaacttgagagaaaagggactggatttagttttggacatgcttagtttttggcacctgtgatatatccaggtggacataggaagaatttggacatgtgtgtttaatttcaggacagaggtcagggttcaagcttcagtgttgatgtatgtgttgtagtttatactgtgaaggcacttgagagaaacgcttaagaactgtgtaaggtgagcagtgggctgtgatgggagtgtgggcaactccagtgttaagggatgggtgaaataggaggagcccaggaggagtctgcctaggaaagatcagggaataacattataggcatccataggcatagcagtgggaaagcagcaaagaggcctggtattttaaatactgaaaaggacctatggttaagggaaagtttttatatgatttgttagttcattatgctgaaaatttttttagagacaagatctcactctgtcactcagcctggagtgtagtgactattcacaggcacaattgtagtgtgttacagcctggaacccctgggctcaagtgattctcctgcctcagcctccccaagtagctgggactataagcgtgctacaccactgcccttagcagttgttttgttttaaatgggtgaacttcccttagcagttcatttgttttaaatggacttgtacttgtttgttgctggggagcagggaacccagcaaagggggaatgctgaagatttcaggtggagtagagagaatgggttgaacaggtcctgtaggagttcatgaaaggggagggaattcctagtatgtgaaggtaggagtggcagggagaaaaggatcattagtatgtagataaatttgtatgacagagaagagattttgcttgaaagagaagagattgagagcttattcttggagatttgttttttttttttttttgaaacatgaagtatggtaatctggtgagagtggaagtaggtgaggattgtcagagggaccataaggaagatggcaaatgctaaaatgagctgtgtggaaaaaggatggtagaaattgcagggaccagctttgaaaatattggcaactgcactttgattaatggagtataaatgtggagcaaagggagaatcaggttttgaagaccagaaagaagaaaaggttgatttacaaaggaaacattgttccaaaggacagagtggagagggcttagagggagctgcaagggtggttactagagagttgggagttaggagcagaaaagttaagtttggggagtgttagagaggagaagtggctgcagggggcttgcatttggcaaagaagtaaactagcctcaggattctgaatggatcttttttgtgaaattgctttcatgccagctcaggctgggtttgaatgtgatattagagagaagcctgatgacaccagcattcaggctgggctttggctcaggatccacgtagaatttgagtgaaaaagtttgtggtacattcattgttttccttctgtacctccccaatatcctgggttagtagaacagtatgccttttaaaattgtcatgaataataggaattaacctaataatttcttggatttttttttcagtttatatttaaaaacataaattttgtctatttcccactaaattggatgagaagcactttttactcatctttaatattaatatagtacgtttgtgatttgtgtgatcactttttattttatttttttttaaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtcagtaatattttcttcccagtttcactttgcttagatattttatgttcccatatctaggattgatattttctaagagattggagtgacttggagctccttgaggagagaatgtagtcttattacactgttctatctctcaggcatagcagcagtgcctggtgctggactaaatgagtcttgttgatccttttggaatcctgttcactagccagagttggggctcgggagttggcgaaaacctacttgataaaattaggtgcctaacattaagttggacatcagttgcctgctgccaccaattctactttctttgttccagggaaaatggaggaaatcccatagctattggaaaaaatgcctgaattataagcatcttgatgataaggataatgccttgtactttattacgatccttggaatggtcccttattcatttcatgtactattgttgaattagattgaattaacatatcactgattctgttaaaatatatacagctgaccctccacatctgtgcattccacatgtgtggtttcaaccaaccgtgaattgcatatattccagaagaaacaatataaaataatacagcaatttaaaaatagtataaataacaaatatagtataacatctatttatataacatttacattgtactaggtattataggtaatctagagatgatttaaagtatataaaagaatgaacataggttatatgcaaatagtacaccattttatgtaagggacttgcacatcctcacattttggtgttcacagggagtccgggaacaaatccgcatgattaccaagggacagctctacaccttgctttttaggttttatggtccgcttcccagagtttcaactgtgatggacatttagacattgagggagaaatttagaacccaactctgctctggcctttgatattaatcatactatttatcttgtagacatcccttgacttgtcctgttccattattgttaacagaaacaaaggacttgctggcaaaaacaaaacaaaaacaaaacgaaacaaaacaaacaaaaaaactaactaaagataccattgtttagggatcagtgagtcatgcaggtaacttttaagtttgccttcccagcagggaatgtgataacctgagactgtcacagaaactcccaggagctctctcagagatagattttggcattcagtttctggccctgaaaacaaaaagatacagtgggaaggaaaatggtagttattctgggttcttctgtatttgaacctgggaatgctttggcaattaggtcaggttccatctgctgtagtagcattagttccatgggcaaggctgacctccggtaatgccactatggagaatcagctccttgatggggactgctgcctgtcaaccctctacctcattaagctgttactttcttgactcagaaagatcaggctgcttaaccagaataattatgacaattggaggaaaacctgtttagcccttcagctcccatattactctctcaatggccagttttcacttcagtctttgtgtagaaatttggcacagaaaagcaaaatggtgtgtccaggatcctaaataaagtctaaaccttttacttactttaattttagttgattttgttgtttttgaaagaatggattggtgagggaggaaggtttgtcatcctggctggagtaggctacttgtgagcagggagatcatagtgaacacttgtgtgtgtttagaatttagcacagtacattgcccaaagcatacacctgtcacacacatagttaatgcttgttggatggatgagaaggtggagtgggagtggaatgttgaacacacatttgccaatgctttggcgacaaaaagagttgaactcttgtaaaatatttgaagagattcgagaccatcctcgctaacacggtgaaaccccgtctctactaaaaatacaaaaaattagtcagcatggtggcgggcgcctgtagtcccagctactcaggaggctgaggcaggagaatggcgtgaacacaggaggcagagcttgcagtgagccgaaattgtgccactgcactctagcctgggcgacagagcgagactccatctaaaaaaaaaaaaatttttgaagagatttactctgaaccaaatacgattgaccatggcccgtgacacagccctcaggaggtcctgagaacatgtgcccaaggtcgttgaggcacagcttggttttatacattttagagaggcatgagacatcaatcaaatacattggtttggtccagaaaggtgggacaactcaaagccaggtggtgcggggagcttctaggctataggtgagtttaaatgttttctggttgacaattggttgagtttgtctgaagaactgggattgatagaaagggaattgttcaggttaagataaagattgtggagaccaaagttcttttgaggtcttacagtggctacccttagagacaatagatgacaaatgtccccattcagatcttaatctctttaggattgggagggtctggaagaaaaaaatatagttttgttaataaagattctttaaaggtgcaaattttcccccacaaagaacagctttgcagggccatttcaaaatatggcaaagaaacatgttttgatgaaaatattttgattttcttcttgtcttgcaatgttatgccagagtcaggttggaaaagaagtcatgatatatagggttaaataaaacctatctgatgaaaatttgtggtttgtagggcatgactccccaggccccttagataggaatttgggcaagataaaaaatcagagtttagtcctcagctttctatttgcaaggtatgtatttggtgccaagtattcaaagatgaataagaccttgtccacaatgctcttgggtctcttacagtttgtactctataactgggagtgtgtttgtattagtccagtttcttgtttactttctcaactgttgactacattcccctgttgttgactacattcccctgagtagaggttgataaaatgttccttaggttaatgtgtgtgtgtgtgtgtgtctgtatgcatacactgatacttaggtttgccatggtgctggagttcctgattatagagttgcttatttttttaaaaagcttttacttgtaaatgatgcttagcaagttccctatcaactctatttcaaagctgtaatggtatatattccagcacagacaagattgtgtatattcagggggcctcaggcttttatagacctttacatgacatttatcggacagtcagtatatccttgtattaaccattctgataatctcaattattttcatgatgactgcttaagatagtttttattacctgcttaaatatgttttttctcacaatttacatttattattgtaatcacttatggataaattatctagtaggagaactccagggcttctaaaatgttaagccacctcttctaacccagtgcttgtcaagctttgctgcatgtaagcatttccttgggaactttaaaaaatccagtgccaaggctgtaccccagactagtgaaatcaatctcatggggtgggacctggtgattccagtatatcaccgcatttgagaatcagagcttaacagttagtgttcttaatcagaattatttttttttttcccagccattttcttgtgacccactgctaaatgggaataccggtaacgcagaaattttttcttgagttcagggctgcaggggatgcttagaaataggaaatagaaaaaaaatgaaataaatgggctgtaggtttgtagtatatatttttgaactcttttgctagctgtattttttaatattaatggtaatgattttaaattcatgcataccattctaacctaagaatgacctaagctttccgagatagacaagccttgaatgacttacgtgtggggtaaggtcaggggtataagataggaatagcgtatctttaactcagataaccctctctgggaaattgtcgtctatttgctcttttcttagcagttatatggtaacacatataccataggaaaaatctaaatagtggttaatactaaaattatatgtgattgtgtaatttattttgtgatctatttactatccttatttatgtttagtttaagcaaatagtagttcatttgtcttaaaacttgttatctgatggcagaagaagcctgcagagcttcaatttggccacagataattcttgtgaatgtactggacagattgacttagtgttagtttttgcattgagaaaaaaataatcttgtcaggtttggttttatgtccatgtcctgtagagaattgagatgccttggatcacctggtattaattccatatatcttcacaggcagcttgggcattttcttaagacaaaaaagaaagaaaaaaggtgacaaaagtagtagaattgattcttactatttgtggatttgatatttatgaatttgcctacttgacaaaatttatttgtaatctccacatcagtactcctggcactttcatggtcagtgcaacacgtccgacacacctgacacagttcccagcgaaaataaacaaggcagcactttgccttctggttttagttctcaaaccataaacaattattcttattgcagcctatttggtgtcacattttttacatttttgtggtattttaggtagttttacagtttaaaatggcccccagtgcaggaaaaaaaaaagtttaattagaaatctcccaagaaagatgcttcattactatagccctgtggcttgggggacagcgcagatactaacttcaatgtagcagagatctgcactgaaaaaataaactattttaattttattttccaccctactctattatctgttaccttttgcaggtttcactgggatcgattctgaatatgaaaagccagaggcccctgagttggtgctgaaaacagactcctgtgatgtaaatgactgtgtccagcaagttgtggaacttctacaggaacgggtaagagaggatgaaagaaggaatcatcagagaaaaattatatctctctcataatctttcccctccaaaaaaaaatggtggtgttaatattgagtaacatttgtattttaaatgcttcgaaatgccaacagtgttctgtgtctgtatgtcagtgtgtgaggtgttgtggggagcaccgtgaatgtacagtatgtgaaatatccccgtcagtataaacctcaggaggcttaggagtcagtcttgtactttaccagtaattttgccacagaaaaatacctaacagaaaatccagccatgattgttcagtcctgtaacttgatagtattatatttttccatttgaggtatacaaagttgttaacttttcttagatatttagagtgcccacattttccttgtgataacatgatgatctccttatgggtggattctagagagggacctgtggaggatgtaagtttctaggacataaggacctttgggtgcctgggcatatggaggcatgaagaggcttggggttctccagggtactcaggcccactaacaagtgcacggttccttcagactttagtctgggtttttagaagttttctttcccttgtgttttgtccatactaccctcaatcccctttccccatttcattggagggtcacatagttcactgtagttgaagaggatctggcctctatgtgggtggaggtcttgggtcagtgattaccctgtcaccttgtcatgcattcccccctttgctattcagtcctgacctaggggtacacagaaaaagacatcatctttcctcattctgtcctaactgtgggttttggagtttgaaccccctcttaatctgcaaaatcctgtaataaacctctttcatctagtgtatcttataaacctctttcatctagtgtatcttactggatatattagacatacaactttaaaaaaatttctttgtctgaatatattataaatgtttagcctttgagtttttccacattataaaatatctaccaggtaggtaacttgggactttccttcctaatttatttattttatccaaacattgtagctgaatatatagaaataatgtaaatcgatactgctctgatgtttttctttgtatttactgatcagatatcattatttgcaggccactgagacatcccaggaggttttatgcttcatcatctctgccttctaggtttctttttaactgacttctgcactcttattctaatcctattgttctacttgtagcttcctccttatctctccaaagctgtcccagcatccattctttcatcttccatcatcaaccacacattgattaaaagcccaccactgtagttatagtcctaggctctagtaatgcaaagatttatcagctgtgcctccatccttgagggatttacattataagtgatagaaacagacataagagtgtttaactcctaggaagtgtgttagaaatcatgatttcagttatgtctgtggcatactgggaggcacaggggctttctcatctgtttgttcatttttagaaaatacttttactgggcatagaattctgcatgacagattgttttttcttttagtgctttaaagatgttccatttttttttaacttgcttcatttctgatgagaagtctaatgtaattcttttctttgttcctctatgtgatttttttttcatgtctgaatttaagattttgtggtactccttggattttagtgggtttaatatcatgtgtctaggtcttgtagtagatttaggtcttttttcttactgtttagaattccccaacctgcttgggtagatatatatttttttcattagtttttgaaaattcttggccattatcatgtgaaatatttcttttgcctttttcactcttcttctgggactctagttacacatatgttgaataatatattgtcccacagtttttagatgctctgtttctttcatcccttttctgttaacattttagctttgataatttctgatttttatgtttgctgattccttagctgtatccaatatattgataggctcatagaaagaatttttaaactctgataatcattaaaaaacaattctgtcattatttgacttttttttgatagtattcatttttctgttgaaattctccatctctccatgcatgctgtccactttttcattagatcctttaacttaatcccagttaaaaagtcctatcttgaggagtgcttgaatctgggggggtggaagttgcagtgagccgagattgcgccactgctctccagcctgggtgacagagcgagattctgtctcaaaaaaaaaaaaaaagtcctgcctcatggtttgaacatgtgtgttatttctgaatctcattttgttgagatttctttgtcatatctcttgacagtgggtagtttttcttgctttcttggtgtatcttgtaattttttgtgaatgctggacactgtgtctagatgtacagtagagattgaggtagtgtttatgtcatgggcatgtttcattttctgtcatactgttactgtagtaggttgatttagccctcagctggatttggctgtccttattccttatgaagttattcttaatgcaccagaggcttcaaatttctgtagtggtgggctcttttaccttgtacttagtgtggggcctggcctgctcatgggtttttcttagtgttcctgcttcatcctcagtgttccctgtatgcctgtaccacagaaggagtcttcctcctgcttgtctctcagcagcatactgctgtggcttatcacttggtgctaggctcatgactgcgaagtggtgatgattctcagtttcctggcccaccttcagtcttaggcgtgacctgtgctcctgagtcttgaggtgggtttttctcagtgctccttcccctccctgcataacagctaatctctgctttcaccctgggaggcttggaggggagttttcttttcctcacatgcattagcatgttttatatctgttttgtactggctacctggtttgtatgaatgcaggatcttgggcccaaaagggtttccttcatctcctcctttgtggcagaccatatttgcttccacccctcacccagaaacagaggaccctgggaaggtttgagggtttcctttcctttttcattagcttaaggcttttgtggatatgaaagaagggtctggtgagtgagcatagtttttttgcctgtgccccactgaggaagactttttttagtctctagacctgctcctgatttatgttttgagcacctgccataggcatgcttgtgagtgagtgcaggaccccttgtgtctggtaccccccggtcccccattgtactaagcctgtcacactagtctacactcagcctttaaaagttttaaagacattttagctgttttcctcttacctgcctttattgcaactacctcttcctcccatgttctgctaaaggtaagcagttcatgtgcctggtcttttcttggtgggacttgtcactcttcggaagcagttcatctcactgctttttttcacctcagctctgcaatgggctcaagaaagtttatgattgtagattggctggccttttcacttgttaggtgatgctctcttttggaatctctgtgttttgttttcaatgcattgtctaccctttctcttcacttttactctgttgctgttgtgtatcgttttcttagaaatttgcataaaattctagttctagacatagatattaattccatctcttttttattttttttattttttacattcagctaatacttaaatggcaacttgatttttttttcttttttatacgttaagttttagggtacatgtgcacaacgtgctggttagttacatatgtatacatgtgccatgttggtgtgctgcagtcattaactcgtcatttaacattaggtgtatctcctaatgctatccctccccactccccaagccacacaacaggccccggtgtgtgatgttccccttcctgtgtccatgtgttctcattgttcaattcccacctatgagtgagaacgtgtggtgtttggttttttgtcgttgcgatagtttgctgagaatgatggtttccagcttcatccatgtccctacaaaggacatgaactcatcatcttttatgactgcatagtattccacggtgtatatgtgccacattttcttaatccagtctatcattgttggacatttgggttggttccaagtctttgctatggtgaatagtgccacaataaacatacgtgtacatgtgtctttatagcagcatgatttatagtcctttgggtatatacccagtaatgggattgttgggtccaatggtatttctagttctagatccctgaggaattgccacactgacttccacaatggtggaactagtttatagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgcctgttcatatccttctcccactttttgatggggttgtttgttttttccttgtaaatttatttgagttctttatagattctggatattagccctttgtcagatgagtagattgcaaaaattttctcccattttgtgggttgcctgttcactctgatggtagtttcttttgctgtgcagaagctcttgagtttaattagatcccatttgtcaattttggcttttgttgccattgcttttggtgttttagatatgaagtccttgcccatgcctatgtcctgaatggtattgcctaggttttcttctagggtttttatggttttaggtgtaacatttaagtctttaatccatcttgaattaatttttgtataaggtgtaaggaagggatccagtttcagctttctaaatatggctagccagttttcccagcaccatttattaaatagggaatcgtttccccatttcttatttttgtcatgtttgtcaaagatcagatgggtgtagatatgtggcattatttctgagggctctgttctgttccattggtctatatctctgttttggtaccagtactatgctgttttggttactgtagccttgtagtatagtttgaagtcaggtagtgtgatgcctccagctttgttcttttggcttaggattgacttggcaatgtgggcccttttttggttccatatgaactttaaagtagttttttccaattctatgaagaaagttcttggtagcctgatggggatggcattgaatctataaattaccttgggcagtatggccattttcatgatattgattcttcctacccatgagcatggaatgttcttccatttgtttgtatcctcttttatttcattgagcagtggtttatagttctccttgaagaggtctttcacatcccttgtaagctggattcctaggtattttattctgtttgaagccattgtgaatgggagttcactcatgatttggctctctgtttgtctgttattggtgtataagaatgcttgtgatttttgcacattgattttgtatcctgagactttgctgaagttggctgtcagcttaaggagattttgggctgagacgatggggttttctagatatacaatcatgtcatctgcaaacagggacaatttgacttcctcttttcctaattgaatgccctttatttccttctcctgcctgattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagttttagcgtgacgcattgttgaattgtgtcaaaggccttttctgcatctcttgagagaatcatatggtttttgtctttggttctgtttatatgctggattatgtttattgatttgtgtatgttgaaccagccttgcatcccagggatgaagctgacttgatcatggtggataagctttttgatgtgctgctggattcggtttgccagtattttattgaggatttttgcatcgatgttcaccagggatattggtctaaaattttctttttttgctgtgtctctgccaggctttggtagcaggatgatgctggcttcataaaatgagttagggaggattctctctttttctattgattggaacagtttcagaaggaatgttaccagctcctccttgtacctctggtagaatttggctgtgaatccatctggtcctggacttttttggttggtaagttattaattattgcctcaatttcagagcctgttattggtctattcagagattcaacttcttcctggtttagtcttgggagggtgtatgtgtcaaagaatttatccatttcttctagattttctagtttatttgtgtagaggtgttgatagtattctctgatggtagtttgtatttctgtgggatcgggggtgatatcccctttatcattttttattgcatctatttgattcttctctcctttcttctttattagtcttgttagtggtctatcaattttgttgatcttttcaaaaaatcagctgctggattcattgatttttttgaagagttttttgtgtctctgtttccttcagttctgctctgatcttagttatttcttgtcttctgctagcttttgaatgtgtttgctcttgcttctctagttcttttaattgcgatgttagggtgtccattttagatctttcctgcttttccttgtgggcatttagtgctataaatttctctctacacactgctttgaatgtgtcccagagattctggtatgttgtgtctttgttctcgttggtttcaaagaacatctttatttctgccttcatttcattatgtacccaatagtcgttcaggagcaggttgttcagtttccatgtagttgagtggttttgagtgagtttcttaatcctgagttctagtttgattgcactgtggtctgagagacagtttgttataatttcttttcttttacatttgctgaggagtgctttacttccaactatgtggtgcattttggagtaagtgcggtgtggtgctgagaataatgtatattctgttgatttggggtggagagttctgtagatgtctattaggtctgcttggtgcagagctgagttcaattcctggatatcctttttaactttctgtctcgtggatctgtctaatgttgacagtgaggtgttaaagtctcccattattattgtgtgggagtctaagtctctttctaggtctctaaggacttactttatgaatctgggtgctcctgtattggttgaatatatatttaggatagttagctcttcttgttgaattgatccctttaccattatgtaatgaccttctttgtctcttttgatctttgttgttttcaagtctgttttatcagagactaggattgcaacccctgcctttttttgttttccatttgcttggtagatcttcctccatccctttatttgagcctatgtgtgtctctgcacgtgagatgggtttcctgaatacagcacactgatgggtcttgactctttatccaatttgccagtctgtgtcttttaattggagcatttagcccatttacatttaaggctaatattgttatgtgtgaatttgatcctgtcattatgatgttagctggttattttgctcattagttgatgcggtttcggtctttacaatttgtcacatttttgcagtggctggtaccggttgttcctttctatgtttactgcttccttcagaagctcttttagggcaggcctggtggtgacaaaatctcttagcatttgcttgtctgttaaggattttatttctccttcacttatgaagcttagtttggctgcatatgaaattctgagttgaaaattcttttctttaagaatgttgaatattggcccccactctcttctggcttatagagcttctgctgagagatcagctgttagtctgatgggcttccctttttgggtaacccgacctttctctctggctgcccttaacattttttccttcatttcaactttggtgaatctgacaattgtgtgtcttggagttgctcttctggaggagtatcttggtggtgttctctgtatttcctgaatttgaatgttggcctgccttgctagattggggaagttctcctggataatatcctgcagagtgtcattctccctgtcactttcagctacaccaatcagaagtagatttggtcttttcacatagtcccatatttcttggaggctttgttcatttctttttattctttttttctctaaacttctcttctcgcttcatttcattcatttaatcttccatcactgataccctttcttccagttgatcgaatcggctactgaggcttctgcattcatcacgtagttctcatgccttggttttcagctccatcaggtcctttaaggacttctctgcattggttattctagttagccatttgtctaattttttttcaaggtttttaacttctttgccatgggtttgaacttcctcctttaggtcagagtagtttgatcatctgaagccttcttctctcaactcgtcaaagtcattctccgtccagctttgttccactgctgttgaggagctgcgttcctttggaggaggagaggtgctctgatttttagagtttccaatttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacagcggatattggtgagcagtaaatgttgctgcctgatcgttcctctggaagttttttctcagaggagtacctggctgtgtgaggtgtcagtctgcccctactggggggtgcctcccagttaggcttgggggtcagggacccacttgaggcagtctgtcagttctcagatctccagctgcatgctgggagaaccactactctcttcaaagctgtcagacagggacgtttaagtctgcagaggtttctgctgccttttgtttggctatgccctgcccccagaggtggagtctacagaggcaggcaggcctccttgagctgtggtgggctccaccaagttccagcttccaggccactttgtttacctactcaatccttggcagtggtgggcacccctcccccagcctcactgccaccttgcagtttgatctcagactgctgtgctagcaatgagcgaggctccgtgggcataggaccctccgagcctggcacgggatataattctcctggtgtgctgtttgctaagaccgttggaaaagtgcggcattagggtgggagtgacctgattttccaggtgccgtgtgtcacccctttctttgactagaaaagggaattccctgaccccttgcgcttcctgggtgaggcgatgcctcgccctgcttcatctcatgcttggtgcgctgcacccactgtcctgcacccactttctgacactccccagtgagatgcgcccggtgcctcagttggaaatgcagaaatcacccgtcttctgcgtcgctcacactgggagctgtagactggagctgttcctattcggccatcttggcaccacccacctccatctcatttttattggaactatagttctagtatttttccttttcgttttgattgtagttttgtttgagttttttgtatactgaatctatcttttttttaacttgaaatttgccatatcagcgttagaaagttggccctctgtatctggagttctatatctgtgggttccacatttgtggatacaaacaaccatggattgagaatattcaggaaaattaatacaacaatgaaaaagaatacaattttaaaaagaatacaattatatacttatataacatttacattgtattaggtattatatgtaatccagagatgatatgaagtgtatgggaagatgtgtgtagattgtatgcaaatgctatgccattttatatcacttgagcgtctgtggattttggtgtcctcaaggagtcctggaaccaattcctctcagatactgagggatgactgtacagttttattatttgttttgatttttttatatcttgttagtgattcataagtgttttataagatctcagaaaaatgcacatatttaatagataccattttatataattttatggggcttattaatctttgactataaattccagatacttcagacatgtatatgggattattaagcttaatttgctttgggtgccacaggtttctcccaccttcttcccgtctttctctctttaaattcataatcacttctttggggccctatttagaatagtgtcctttgggtttgacacttttcctacgtgtaggctctttttttttcttcagggaggaagataattttaagtttttcttgaaaaaaaaaaacttgattttgagaaaattttgcagctcttcacttattttttcactaatgtttttcctgttccaggattcagtccaggattccgcactgtattcagggttcagttggtttttaactataattctgtataatgaaaatacagattcctgtggtatttatgatgcacaggactttgcatcttgcttttattccctgatggttaaaaactgaaggtaaattgacactgtatgattttaggatcacactatcccatattcccctaactggttaccacaactccagttctgtgtgccctttagtctgtcctataatattcacaaagtaatctttctaaagtgtagtctaagcatttcctttttttcgctctaaaacacttactgatttttccattgtttatagaattgagatgatttatacctggcatatgccaggtgtggtggttcacacttgtaatcccagcactttgggaaactgaagcaggaagattgcttgaggccaggagttcaagaccagcctgggcaacatagtgagatcctgtccttgtctccaaaaattttttttaaaaagtagtcaggtgtggtggcacatcccagatactcaggaggcagaggcacgaggatctcttgagcccaggagtttgaggctgcagagagctatgattctgccactgccctccagcctggatgacagagtgagaccctgtctgaaataaaaaataaataaaataaaatgcatcaataaaaatcaaataaagaggaaagatgatttgtgttcacagttcttcatagtttggttccatgctgcatattttcttatttattgtccttatgaagttcaccgtagtattttctttctttctttggtgctattgcttgtcttatctctgtagtcttagttaatgccttcctcctaatttatttgtacctaattaatgactatgctaattgctcttccttgtatatggatactaatctgtattatgcttgctagacaatctgatgattggacagtttcattcaaggatattatccttgaaaaagaaggatagataagaaattaacatttgctgagtccttattataagggacatatttatagtatgttgtcttttaaaataacttgttctgtttatttcaattggaggaaagtgaccttttttcctaatttagcttccaactgtctctcacctgaattactgtggtagttttccaagtggtccttgtgctaagctcttttcatatgttgtttgattttattcatacagtaaacctttgaagtatttcagagaaatgaagaaacttgttcatggacatgttggattctgcatctagaatttcagtaattttcttatacctctggcttttactttcaggagtgttctccttacacttaagtgagatgtaattaaatctacatccagaaagggattctggttatgttcatttaggagagagaaattttcttttgaaaaactgttaatttttatcttaaaggtgggtggtgacaaaagaagaaatgcaaatgcctccttaatttgatagctttcttttggtatcaccctccttttcaatatttgttacatgcttttctgaataaatgacttcacttcccaatgaaagcacgcatatttctctgttgtacttagttgatctttttagttaatttaacagatagttaatgctatatgtggtaggcacttttgtggacactgcggatgtggcagtgaattaagcaataaacattccagcctcatggaccttaatttttggtcttcaccactgttattttgtttatagtgtatagactagaatgagcatatatagattcatttatttctcttcttttatactatgatgtagaatttaaaaatgcaattgaggaagaaatacacatagacacacaactatatctgtcttttattttcttttggttgtttttctcactaagttgaatcccagtgggcattagggcacatggagaaaccagtgaatacctgacattcagctcaaagttcatccttagaaatgccagttgtgcatttgcccactgtacttcattgcaaagtgacttgctataatgtgtacttttcatatcaaactccctctatccaggggtagcaaattcagttcatttaacttcattgttatcacaaagacatttgttaggttttccaaaggtgggctatgggaggacacatagtacaatctaaatatagattgggaggtgaaggggatgaatatatcaagtaccatgttgctttaaagcaaggaataataaccaaatttatgtagctttagagtatgtgtttggagtagggaggtgaaggttaggggtcctacattaaccagcattatgtaaaagaatatataaatgtgtgtgctgaaagcgaatgccatgggcagtatattagggttctctagagggacagaactaatggaatatacgtacatatatatgtgtgtgtgtatatatattttatatatatatgagtttattaagtattaacttgcatgatcacaaggtcccacagttggccatctgcaggctgaggatccaggagagccagtctgagttccaaaactgaagaacttggagtctgatgttcgagggcaggaagcatccaacaccggagaaagatgtaggctgggaggctaggccagtctctcttttcacattttcctgcctgcttatattctagtgatgcttgtaattgattagatggtgcctacccagattaagaatgggtctgggtttcctagcccactgactcaaatgttaatctcctttggcaacgccctcacagatgcacccaggatcaatgctttgtatcctttccatccaatcaagttgacacacagtattaaccatcacaggcagagatggagaccatcaacagtaacttaccagttgaactcttactgtgtgctaggccctgtgttaggtactgcagtggcattattgcatctaatttacattgaaattgagaagtatttataattatcttcattttgctgataaggaaacagattccagaggtgaagttatttgtcccagatagttcagttagggagaggtttgcacacagttctgattgattctgcagcctacacactcaatgtttctactactctgcctttactagtatttagattctttccatttctagtttatttctgaaatatgaatcttttctctgactctctttcacattccttgatcagttgttccctaactgtagttgggattaagaaatgggagaggcatgggcatttcattgaccttagaaagatttattatttcttgaatacttttaaaatacttgagcagatcaaagacaacactatctgggttggaaagaatgtttattaaagaaataaactgctcatacctgtgtccagctagtgtgaaatgcttgttctatgtaagtgcaataagaatagtgtttgtaggttatctaatttaccttggaaagaggcacattttgcctaatgaattatgatttatgtaagtcctaaaacctgaattggagtggtaaaaggttatactatatataatgacaactttatttctaaaataaactaagtaaattttatcccctcttcaagcttagttttgtaatacttttgaagactttttttctcacaataaccagttttttgtttgatctctgatatcatctggtatccagtgattcaatttaattttgaccctagctatgtggagttagttcagacctcacaggttaagggctcactcctatacactgccctgttttagacgccagcccaaatggggtgcccaggctacccactttcttgcctggctgattataaatccaaggtttcccacctccctaccctgtccccacaccaggtttgatcattggctaggacaactcacagaactcagtaaagtgctttatttgctacttccagtttcttatagactcagtaacagccagatggaagagatgtgcagggaaggggtggcagagcttccgtgctttctctatgaacttcaacccccagcccccagtacctccgtgtgctcaccaactgggaagctctctgaaccccatcatttagaagtttttatgtaggctttacgtcgcacatttgattaaatcattggccattggtgattgaactcaatctctctaatgcctttctgctccccagaggtcaggggagtagagtgaggctgaaagttgcaaccctgtgatggtgacttggactttctggtcccagttcccatcatgaagctgtctaggagcccttcagccaagagtcctctcctcagcactccaaaggcacattgatcacttaggggatttcaagggtgttaggagctctgtgccaagaactgaggacaaagaccaaacactgtatgtatttccaattgtataccagtttttattagagagaagaaagtactatggtctgggacttcccagagaatgaaggtgtttgaaaagcactgtcttcatggaaaaatagtggtaagtagagtttgcttttatctgttcctctgtattcctttggagagactcttctgaagtgaattgtacctggaattgtttaatggtcttcagtaagatacagtatttatttcattgtccaagaaaaatgtttttagtatgctgtacaatgggtaatataggatgatgggtcctttggttaccatgggtactttacataaagttaagaattctctgtcattttctgggttgccttctctttcactgtggctatgtaatataatcaggatagataaagtggtcattcatataaagactgcatttcttagcgttttctcacagcatcttcattttctttgtttggtatgtatttaagaaaatagaaaacactaacaaatcaggatttttttattttcctagaccctaaattggtcactagatggcctgctagtattgcattttaacttggcttgttatgacataaggaagtagacttcttgctgctggttttaatctaaagtgatattttaaatactgttttaaaatctaccaggaactctagatttactagtgctataaattatttaaaggtttgtctttttaagaaatggtggtttagtgctctaaatgggttttatgctacacataaaagccagactttgcagctcagttttaaagtgttgccggaatgtcgtttggtgttcatgctttggatgcatgtagtttagataacagaaatttaatagttacataaaaatatgaatgtgcccttgtgttcaaatctgttgagcagatttggctcaagaaaaaagtacagaaagtatttaaaggaaaacttaaaatgtggaatcattgtattaacatgttcagagttctttaggaagattaaaatgagaggcgagagctaccactttcatgtagcgcatgttgtttgccctgcctgccagtgtccaggtaaaaacaaaaacagttgtctgtttttggatacaacatatgttagatgttagactgtcaaagtcaaacaacgttctgggtaccccgtgttacattttaaaattaaattaatacttataaatgtataatatctctagacttacaggttacggaattcacctctcattaatagtagagtgtgggtcatttactgatcccctgctcaggaggactcctagggcctccctgagccccctttacccttcagtgctgggtgactggagcctttcagattggaggtgagatgtccaggtgtgtgcagactttttcctggcctggcttgtgatctctttgtgttttaaaggacatttcatgaagcaaagggttttatatgtacaaattgaagaagagcacgttgtttctaatagctgtgtctgtggaaatcctaatgaatcccaaataaagtggatagctcatgtggcagggaccaactttctgttgtccagatatcttgtgtcactttgaggtggttttgctcctttcagatgtttagtagtggttttggaaactgagatttgtcactggaatgtgctagaagctggcagcatctgcatgtttaagattctttttatattcctgtaagagactgagtccttttgtctttacacatagaatctgtgtataactcatttccacagactgagcagatgctcccagttcctcttgattcatgctatttttgcattaattcccaaaacattcactctctgtatcttttttagaagagaaaaacagtagcaacctttcgaatgtttattttggcattggttaggtatcagaagaattttgtattgaagttgtgaggctaaaatccatttaaaaatattgttgggtgtgaattttgaagagggaagagttttatgaaatgcttctaatgaaaaagttattttgactcaaaaacaaaatatgaaaaaatttcccttcttgaaaagaaagtggttatagcctttgttaatacatgtaaagtagcacattgataaaattatgctcaattatgaataactttattagtgcacaaaatatttcagtaatttgatggggcttacagtatagatattgccctttacatgttcaaactagttaccttggagacagatttgatcacaaattatttgtacagttttttttttttaacttggggatatggttggaaggaaatggtagacatcatctatagaaacattcgttagtgcagagttcttatttggaccatctcttcagaggaagcagagatgcacctgagtgtgccctcagtgttgtggggtctccagggtggagggaagagaacagtcccagccctgtgcctggagcattgcagtggactgtgcacactgctcctggtcttcagtctttgtgagctgaactagggatgctggattaggaaaccagctaaacatgccttgttgtagccagtaaaaatcagaagatgtgtctgctgcatgctttcttctgcttctctaggattgtgacaattttcagcagtaaacctgggggagagtagtcaagccccatcacagcatacaaaaagatatcccatccttacaataatatacatttcagagatggcaaagaaagctttatatagagtttttcttaccattgaagttgagaatgagattcttctcttctctggagtcctttgtcatttgttcccagactgcatatcctgctaagggatcctcagcattggaaatggaggctcatgatttattcacagtggcagggtttggaacagttggttgcaaattgcttacttgtctttaatagaactatttaggctcaactgaaatgctgaatatcttttatttttctctagaaccttaccaacgcattggaagatcacatgctgactaaaaacttgggaattatgtttaataaaatcatgaaaataagaaaaatttgtgtgacaaaatacttaataccttagttttcaatacttctcaactatatgaccttggaagatatagtctaatttcttggacttcaattcgctcatctatgaaatgggaaataattaaagtgcctgcctcaggattgtgcagaggattctatgagttgatacatgcagagtgcttaaacagttcctggcatgtagcaagcatactctaattattgagtattctttttatgttaagtccattgaaagacagtattgcagggatttgggtcaagttgttgacctctcttaggcctcgatttcctctgtaaagaagggatagcagtagtttcttctgccttcattagtaggactgtgtgaagattaatggactaaaattcacatgaagctcttagaacaatgagtggtgttatagtcagttctcactaatattatcctccactcttcaggtactttaagtcactagtttgtcaaaacagccctgtaacatatatgtgtgtatcttttttgtacttttttttaaacaactggggagacacgttgtaagatgctcaagattgcactgttagaattggaactcagatcttaaatataaaaagcctttgccctctttttttacttcatattcttagtgataagaacattggaaataactgacctatagactcctgttgctttttatatctcgttggttttgaagatgttatgcccctaaagctttgtgattatgtaaatatttaattttaagtgtctcgtgaaagtgtatcatactcttcctcacagaagtcctaatgagtgcctgactttttgtgtaacttgttatgtttagtgttttctccccctagcatagaagatttcaattctttactttgtagctgcaaagaatctgtatgcctcaaggcatctttggaggctttacatatcgaagaagctaattgaacatacaaaatgtatgtgtagttcacttaatgcacatcgtattgtccttccaggaaaaattgactctgaacttttattttctacttgatgaagtaataggctttgcacagactgctaaactatcatttgtcgtgtaatgtacctatggatggagaccagatcaaagggaagacagaaaaatgacagtgataaccatatctgggatacagggtgatttggttttctcataaagagaatctcccagattctttttactgctattttataatttaaaatacatatattaaaataattctggagttggaagataagctatatctcatgctagatttaaggaagagtccttttttttttttctatatgtggtttcccctcctggtattatgtataaactatgtatatttagttgtcactgctttgaactccttggcaaaatttaagatatgccctctttagtgtgggttcattagaaataatctgccccattagtgcatctacagagagaacatagaagcagctggtggagctttcttccttcaccattattttttaatgccctcctgtattatttaccctcagtaaacacaatagatagcttttggctatgggtgcctgctggaagcttaattgcagaagatttggaaggtatacaaagtgtctaatgctgtgccgggtttgtgcctcacacacttttctgctttcctcctatgaacagtgagaccctagagggacaagaggcttccagaaagtgccgttcatgtctacaccccaagagcagcgcagctggctgaatttgctgttgtagctagcggtgtttatttcttgtctgtcttttgatttttaatattacgttttcttttccttgatgtttattcttcttgtttatttatttatttttttaattattagaaaggtcagagactttgaatttaccagtaggaggagcctgattttggcacatatttagccattgctgaactgtctcttgttccatctttgaggaaacagggtgtgtgagaaagtaggagaaatgtaagagaatagttcttagattttcagaacccatagttgttgattgattgagtggtagcacctaggtctttcatgaagtcatctggctttgattgacatatctgccttttttttctactgaacatgtcatgtaagaccaaatataaattgaagtttctttctagaggtcatctattcctcaggaaaaatagtggagagtgtccttaaaaatccagttctttcatcttgaattacattttttgttgttttgtattgttttaaaaaaacagacttttttttagagaagtttcagattcacagcaaaattggcatcatgtagttggaatcatatagtctgtacccttttcagattggctattttcacttagcagttctcacttaaggttcttccatgttttcatggagctcatttcttcttagagttgactaatatagcattgtctagatgttctacagtttgtttattcacctactaaagacacattgtggctgtcaacttttggcaattctgaatagagctgctttaaacaccctgtgcaggtttttgagtggaggtacgttttcaactcattggggtgaatatgaaggagtgaaattgctgataagagtatgtttagttttgtaacaaactggcaaaatgttttccaaagtagctgtaccattttgcatccccaccagctatgaatgagggttcctattgctccacatctttggcaacattagatgttgtcagtgtttcggattttggctatcctgataggtatgttgtgctatcttgttttgatttgcaatttcctaatgacatatgatgttgaacatcttttcatatgcttatttataatctatgtgtcttctttgatgagatgtctattcaggtcttttgcccatttttaaaattgggttcattttcttattggtgagttttaattgtttattttgtatatttttggataacatttatctaaagatataacttttgagtgtatttttctcccagtctggcttatcttctcaatcttttgagaattactttattttgaataacaaagtattggacacatgtatgaaaagccctccatcagtgccagttttgcatggttgtagaggttacctgacagatttggcttaaaacaaattaaagtgattaaacacatttagtaattattcttagggatatgtcaagtgttgtgaacaagccttgtaaagagctcctaatgagcagtatgtaaatggttatgttgttatcacaaatatgtacttgtagtataaatggggaaaaacaccatcccagtgttttataaatgagtatatggagcttggataaaaattccaggctgcatttcgtgtgggatcaaaaagttctgattttcaaaccacagtggtggaagtaaagctgacattctagaataccgtgttgcttgggtaaaaggtggctttcctgacagtggtgataaaggtatatataaaagctggaataaaatggtttcgtgatatggtaaagataataaggatgatggttcaggtggtttttgtttgcttgtttccaaattctttttgttgttacctcttatttgaggccacctctcatttgtagttgcctgactttgacatatgtagtatattttaggaatttattctttcccactagataatgggacattgggcttaattacttcttggatgtgggatactatctgcttgagagtattggttgaggggaacatagcactcacagccttcttttatgctactttttggttttattttgagagattttcttcattaagataccctttggtgaactctaaattcttgaatcaaacatttaaattgtactcctgttgttatataggatattgtacctgtggatgcatcttatgaagtaaaagaactatatgtgccagaaaataaacttcatttggcaaaaacagatgcggaaacattaccagcactgaaaattaataaagtaagttcttcgttgcttttcacactaagtgatacagccttatatacagtagtttgttaaatttgtgacttatagcagtatttgaggccaggggtggtattagctggggggcaaagatgttgtggtatatgtcacaatttctaaggatggggaatgtgtttaatttgtgcaaccatgttcccaagttaccatggctttgatttgctttgagtaataatacttatttattttgaactatcaaagaacaaatattacatgagatccttaggcttatcagaaataatgggttctaaaaggtcaaggaatactaatccatagtaattaagtaaacattctccccttcagacatgttttctaatcccttgccaaaacttgactctctctgtcttatattgttaagaataattttattgtgtatcttagctctgatgatatcattagctgtctttcccaatacaactgcgtagttaagcatgatgagaatggaaattataatttatcattttcgagtcttagagaattttaagttgtatcatttatgtatactttaaaaaaagggagattaaaaataagtatttggactagaagttagattccccatcctttcttttaatatagtaaaaatccaaaatacccaaggaagtgccacatctgaaagtaaggagaaaggaaaacaaaacaaaacttctaggcttgatgaaagactctttaagttgttaccaaatccctgatgggagtaaattatattggtacactttctgtgtgtgattgggtctctgaccagaaaccaagacatgccagggagtgacaagaagggagaactacagagcagagcagctcaggaagtgaactgttacataagaacaacagaatttgttgcttacagactgcatggagtgaatacacgcagacaaaggcagagagaagaagaatgagaatgaatgactatgaatttacatgtcagattctagaatccagaaagacagtagctttttctaaatggaatgtattttcaattcattggttttcaaatttcttcaattggcagagcatctggaaggcacactgctattctttgcacctcctcacatgcctatttctaagtatggtagcattggggttaggccttcagtataggaattttgagaggacacagacattcaatccctaacagataccatctagaattgaattccagtagagacaagtagtagccaccatcaaaggttttggaaaaaaaaaaatttcttcatgaatccaattttttttcctgtgaattgattttgcagtggaacacattggcaaacatactctgggaataaatagtaggctgcattttactgtactccactcagccaggtgctttatctttctcattggagagccactgctgtatgcttagttaaaaaatgagcatatccagcttacattaacgataagtacattgttcatcggtcctttgacgttctaatgggatatgctagaaatctcaaagttcaagaaataatagtctttgtaaaatgaagagtactctgtcatgggtaagagacttttcttggaaaatattttatttaatgtttcttcctttctttttttttttttttaaatggagtctcgctgtgttgcccaggctggagtgcagtggcttccctttttttttttttttcctaacaagaccacagaacagaaggtacttaattctatacaccttttttttttagaatacagtactttatggtcactttttttgtgagtcacttgatggaccaaggctcttcttatttattgtgtatcaagtgacctcagccagtattttccttttgaagtttaaatggtcttagctggccagtggggtgattcctgtgtctttccagcaagattttgttaatcttggaaagattccttgcttcctggctcagcaagatgttccaggctcaccttataccttctagccctatgattggattcagccttttctccagccagccctagttcctttttggagaccataagctgtgtgcttgggtgcactgtaaaggtaccaaactgtcagataaaatgcagctttacagataaaggtgaagtcttctctatgaaatgattatgccatcattttacatttccctgatgatttatgagaataaccattttttcaatacatttattggtcatttgagtttccttgtctcccaatgacttctttttttttttttgagacatggtctcactctactgcccaggctgccaggctggagtgcagtggcatgatctcagttcactgcaacctctgcctcctgggctcaagcgattcctggcccaagcaatcctcatgcctcagcctcctgtagctgggactacaggaatgcgccaccacatctggctaattttttgtatttttagtagagactgggtttcaccatgttggccaggctggtcttgagctcctgaggtcaggtgatctgcctgctttgttttggcctccaaagtgctggaatttcaggcgtgagccacctcctctggccgtaaagtttctcttggttaaggagagtggttatcaaagtattagatcatcactgttatcattttctgggaacattttagaaatacagattcatgggccccacagcaaactgactgaatttgaaactctgcagatgaagcagtctcattttagcaagctttccaggggtttgaggtaaagtttgagaaccactagtttaggagaggctgtctttattagaaatacttggaggcctaatgttatttaaatttaataggagaaggaaatattttcctagtgcccttattctttgttagtttggtataatctatactcatccttacactgtttgtttccattgctttcaaaattaaattcctaaaggtcatcactgcttttgctcatatatacatgcaatagaaaattttgctttactttcaaatttactaggtggatatgcagtgggtgcaggttttggcagaaggttgggcaaccccattgaatggctttatgagagagagggagtacttgcagtgccttcattttgattgtcttctggatggtaagacattttacattcaaaattatattgtatgtggaagagaaattacatagttgcagagatttgtcactgtttacaaaaagtagtagggtaacgtcttaatagaggtagcattataagactaagttatatcagtaccgaacactttatttaagtgaatcatgagatctcattttcgtttttccgtgtcctgactcttatttattgcaaagagagagggaaaatctgggaatcagggctgaggatggattgtaaaacacatacagttattctgtgctgtttttgcctgatcactgtggaaagctgcttcccacccagggcatgtacgtgctgcgttttgcagtactgaagcccatgcttgagctttctaatgaggaattgtggagtcttagttaaggaattctgaaatatgtggctaaaaatgtggtccttcctattcttttaaaacattaacaaaaaattgtcaaagaaattgatgttggccaggcgcagtggctcacgcctgtaatctcagcactttgggaggctgagggaagtggatcacctgaggtcaggagttcaagaccaacttggccaacatggtgaaaccccatctctactaagaatacaaaacttagctaggtgtggtggtgtgtgcctctaatcccagctactcgggaggctgaggcaggagaatcgcttgaacctaggaagtggagggtgtggtgagccaagatcatggcaccactatactctagcctgggcgaaaggatgagactctgtctcaaaaaaacaaataaataaataaaaaatgatgtccaacatataatcattataatgcagcagcctttaattttgtgttgtatattgttggtaagattaatttactaccttatgaaaatatttttaaatgtcacagaaccctactataattgctaccaagttttttgttttgtgacttattttaactgggtggtgaaatagatattagaaaacataattcctaatcattcttctcaagaaactttatcacaagaacataaggattaaataatgcattttgattttcttccttggagctaattgcaaagtcttgtggactacctcctttacgatgatttagtcttgggcttggtgcaaatctacctattcattttccatgttacactttacctagtggtagtaatttaaaaagcagccaagcagttatcattactctcgttgacatcttttgttcaaagaagatatgccatgatgtccaaaaaatatgatttctttagtatataaatagtccaaatatgaatgtgagagcacactttatttttctaacccatagatgatgagtagaaaaaagatttttatagcttgcaaggttgcatgctgagactgtgcctttagtatcactgacaacacattttggtttaaatacagtcattactgtctttatttcttggttagtgatagctggtatcagtttgaatttgactgtatttaaaaaaactttttggatagttctgtcttcctatctcaaggatactcaagtatacttaatcaacttgccacataaattgtagttattatgtcatcctgttatcaacaaggatttaagtttttcctgaaaaggcccagaaacgtagttctttgtctctttcatatattggaagtgcacagtatgtatttggtgatgttaggcttaaccagctgattctttcttgttaaacagtttgttttacttatgtaattctataccaaaatgttgtacccaaaaacagtttgattcttttaatttttccttttttttttttttttttaacttgggagatcgttgctcattctccctgaccttatagcttgttctgtctttcgtttttctgtgccaggtaccagttgaatactgtcactggatctacagccttttattatttgaaaagtgtcccctgaagtgaaaggtgggtgttaagtaaagcgtgttgagtaattcaagctgtgtgcttcatgttcttttgtgctctgcaggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaaggtgctgaaaaaacctcgctgcattttatcttgatttgccaatgatgtttgtgctgaaatgtgggcattttctgtgtattgacttttcattggaattgttaatattttgcatagtagagattggaccttagattattgtgatgagtgtttatgctcttgtcattttggtccagataaatatttattcaacaaacatattttaaatctctattgtatacatggcactgagctaggtgctgatgctaggaatgcagggccagggacaccaccggcacagtgtttcagctcttggagtatacaatctcgtcgtgtgcttaggcatgtacttataatgagcgtgtgaggtagaggctaagggagccctcaccagggtggtttgatgtgaaagcagtgaaatataatttctcttcaaagtacctcatttattatatatatatgttgtatgtggaatgttattgaagtcaaatttctgtcagttgttaggtgtgttaaggtagactgagaaagaagctgggcacattgttggcacataagccaaagcctcatggggaaaaggagggctggagctgccttgtgaatatgaacaggtcctggagggtaatagctcctcctttcggatgcagggaaaggaagtagtaaaattgtaagaaatttgaggtggtgtggagattggaaggcatgaatttgtatcgaactcgatgatcattaattcttcaaaaggttaggattggagaacacagtgtggggtgacccagagctacaaattgttctgttaataaatgtatgataataacgaaaagaatgtttttgttacttgaaaaggtgtaattattcgcattgcttttgtttgcctttcatatgtaaagatagttatttcacaagttttctgggaaatcacaaaatcgattctaattttatagcatctctaatgtcaatttagttgataagtcagatttacctcatttaagatgagagtagcttacaacgactgtatttagcttatatgagagaaatgtttttacttattttgatctcggtttccattaaaaaaatttgtttttcctattagatggtgatggaacaaggagattggctgattggaggagatcttcaagtcttggatcgagtttattggaatgatggtcttgatcagtatcgtcttactcctactgagctaaagcagaaatttaaagatatgaatgctggtaagacatggatttaattacctaatataggccggcttggagagaaagttctagacgattttttccagtgcttacgaaaatgtaaaacgatgagtacaggtaaatatagcagtggaatatgtaaagaaaggtagtcaatcaaaactagcctgggtagtttcattatattggtataatttgatttgacattattttgaatactctggaagctagatgctaatgcagaatttaccttttatttattataaaactcgcatgttaaagctgaatggaactatagaatattatttgaataattcactcatataaatatgctttatatgtcagagtgttttacatgagagagatatatattcatatatattcatgtatatattcatatatattcatatgtattcatatatattcatatatgtattcatatatatattcatatatatatgaatgtcatgtatctcagaatgttttacttgacattcatatattggaagtgcacagtgtgtatttggtgatgtgtcacagcaaataatgatacatgaccattgtatcataccattgtaccaatgatacacgaccatgatttaaacaatagagaaagttgtttaaagcaaaaattaaaagaaacaacactgcgcatagaaatacttctcaaaacaattcatcaaactgtctttgggtacaaatttttggtatagaattacagaagtaaaagaaacttaacaaggaagaatcagctggttaagcctaacatcaccaaatatatactgtgtacttccaatatatcaatgtcatttatcgcagcaaataatggaacaacggaacttttatcatgttcacttcatttaaaaaatgtttctggatctttatatgccagtatgccatgtgctgaggatccataaataaatactctaggagcttatggtatagaagagagagacattaaacaataacagaaaaagttatttaagagcggaatagagaagctacagatgctgttctttataatactgctttctatattataaagcactccaggacaggatttttatatcatatttcctgctattaggtctttgacacagaggtgggtaaatgatgtgcttaccttggtgcacccatactctttctatacctgcaaattcaaggttctgtatcagggaacagcattcactgtagatttggggaggcttttttaagccttaaaattggaagcatcctgcagttgtgctcctaattaattcccacccactgcagagatggtttggccctaagcactggtgctgctctcttttatattttctgtgtagaaatcagatggatgtggttgagaaagggcaggtgaatgtgtttgcctttttggggtatatagctggccaccaaaccatgtttgtgaaccagaggccctcgttccaagcaactacagaacaactgggaaagagcaggcatttcatttgtgtttgtcttagtgtcggtgaactccagaatgctcctggtaggcattcagagttctgtgttcagactctgcctcaccacctagcagttgtgtttgtggggaaattacttttctctctaaggctcatggacaattgttgaggatattgatggtacctaaagcataacattttactttaaaaagtgaaataagatgtgtaaggcactttaaactgtactgctatgtagtaagagattaagttgttgatacggtttggctgtgtcctcccaaatctcatcttgaattgtagttcctataatccccacctgtcatggaaaggacccagtgggaggtaattgaatcatgggggtggcttcccccatgctattctcgtgacagtaagttctcacaaggtgtgatggttttataaggggcttccccttttgcttggttctcattctctctcctgccaccatgtgaagaaggatgtgttcacttccccttccaccatgattgtaagtttcctgaggcctccccagctgtgtggaactgtgagtcaattaaacctcttttctttataaattacctggtctcgggcatttcttcatagcaacatggtaatacaggtgccttaatttttgttgtgtgaactgaagctagactttattcatgtgaaggttagagcaagaattatctatttatacctaagttctgctgtagactgctgtagactgtgttatgaacttaataaaatgggttaagaactggaggcctcagatgggccacccactcttcagtgctccatagttcctacctagtctgcttaactcattcacatttctttcgtggcttctttagggtttttgagtgtgggatcccttttctccttttatactttactcctgattttgaagcaaatatttggcttaaattactgatacagaaacttctttgagtgctatacttggtactgcctgtataacagctcatttctcttcttttttgctaacatgttttaggcccagtatacaggaatgaataatgattgatacaagttaataatgatgccccactcttttttgtcagtgtgtgatttaagggtcaatgcattaagtcatttctggccattgagatctaaggaagagggttttcaggaaagattttctttctgacagtgtggcttatgccagacaaattctgtttttttttcacccttctcttcctgttttggatgtttggagttcctgcaaccattttgtattcatgaaaattccaaatatgctaacttttgtccttatactgtgagtttctcatccaaccatggagtcatttatctccagatttcttattcaaagagataacatatattcaaattatttaagatacttttagttgggttttctgtgatttgcaaccagaaacatctggtagtttattatatgtacacttcccttttctgctggtgaacagaaacatgtttaatggaggacttgctgtgaccatgttatttaaatttttgccaaaatttgaattcatatctggaactgatgttagtaaattaattgttggcactgttgaaagggtcttatcaaggacttattcataattagggactttcatattacatctgtttttcactcttctttgtgagccaaacattttaagtcatttagagaatgtgttgcataatgaatgattgcaactttgtttaaagtagctgagagccagttattagccttacatcaaacaacaaaaattggagtgttattttattttttccatttttatactgaggcaaataagcaacagaccgaggagtttactttgtagttcttgttcactcttttaggaagccaataacaagtcagttctgatgtgttcaggggagagaaagcagggaatttatttatttattttcttaatctaggatttcttttcttacctcttcctccttctcctcccctcatcttagaagtactttgattaccccatgtgagctattgtcctgtgcacagcactatcagtttggctgttcttagaccattctgtagctgggaaggattgagaaatctttaatacacacatcggtgattgcaaggtgatacatttccagatggcaagttctttgaattaccgatgattgaccagtatcctggaggggaagaatgcatttcacttaagccaagtaagagcctgttagtgtttattaaacatagaatattggtgtcctgctgattgcaaagggaagagttgacataatttctttcagaatagtgtgtggtagtacagtgttaataaatctgagaaagctttatagcgttgctgaattacaaactacattttaagtgtgtaagtggagacatcagaagaatgttttaagtaaagttgaggatggtacatgagaaagctgaggcagaagcagatctatgtttggctctgaagtggatagtggatctcgatgataagtgacagcaagccagagagctgagattgggtgagggaacctgtgtcagtcagctcccagcaggaagcagaaggcacactcagatgaggctttgagcataattcagtgaagcgagtatttaaagaaaggtggtcagagttaagggaacctacaaggatttgctgaggttccagggactagtggcattgggtagtgttagccagtcccaaaggggtgagagcaggaagcagtgtttctgaagccaggtgggagctgcagctgtgggaaggccactgggcagaagctggttgcagggtcactggcacagccagaatcacgcgctgaggcagatgatagtggggagaagagctccccgaaaacttttctccgtccatcctctggttgcctgctaatgccaccaccctcaaggcaggaggacaacagccccttctaggggaagccctgagggacacctgtgctccctgccccaggacatcagagaatagatggggaggggaatggcaaataagcggcacagaacccagttggcacaaagctttgtagtcaacatcttactttaatttggaagtgtttttagtcatgagaatagaaagtagttcattgctgccatactttagaatatgaatttaccagttttgtgaaaaattctaatatctttatatttgttcaaggggcccatctcttattcctttatttccaccccccaccttcttaagcagtttgagtaaaagaaagactgttagtttatgataatcccaagggaggaggggagatcaaactgctttgttattccaggtcccttcacaaaaacccacaaaaacaaacattaagcacacacacaactctagtaaccctagaaccattgtcttgtttagctgctatattgatttaggaaaatcagaaatgtctgttcttggagctttaccgtagagaggcagatagaaaccttgggtgggagggaagaaaggaattactaattactgctctatgtagcgcagtcttacagtgaagttaagaggaaagaagcaagaagatgttgtaattctatgttcagtggttggggtggatactggggctctggctgtgggctgggatgtgaagcacagttctgggaagtctgaggaagattgactaggatttagaagcactgccctgcttatcacctcattcatttatttgctgagtttgcagttgtctttggatactcagcttggaaagagtagagtctgggtcgctctgcactgtgccacgacacgacagtccttgctggcaacgcctctagatgaagcggcctgtggcttgtcctacatgtgttcacggaatgctgatatcttcatttccttccttgtcacacatatatgctcagaaaaactttcttaactttcttcttcctcttctacctgctggaaggaaagggatcagacttcacttgtttccttagtgtattggctcctggactaggtgataggaaatccagaggaaagggagagaacttgctctgctgggaagttccttcacatagacatgcagtacaggagaaggaataggctttgggggccagacccaaatttggcttgagatgtgacagtaataggaaaggtagaagaattgagggaaagaggtaggtaatgagcaatgtatattgaaatagtttttgtaatgcatctgtccggtgaactggaaggaaggacttagagatgtggctaagagaagccatctgtatgtgtgcggtaattgaacccaggtgtaggggtaagcttccagtgagtctgtcaagaaggaatttcatagggcccagcagtaagccttgtggctccaagaggaccacaagatgtcagaaacaggtggttagactggaatggccaagcggaatagaaatgtcatatgtttgattatagctgtgtaaaaatgtatgcaacaaagagaaaaactggaagattgcacaaaacaaaacaaaagaccatgctttcaggacagtgcgtttatggatgattttctcatcaaattttattgggtttcgtggtttttactttaaaaaaaagcatagagaggcagatgacatataaaaggttggtgccacagttagaaggccttaagtggtgtagatttttatgtcagtcagtagagaggtaaggaccacttaaatcaggaaagtgccatttgaatttggctctcatttcatcctcactgttgatggaacaggaaggaattggttcaatcaatgaatccagtccagcagtgtcatgtataggtgaagacgcccattctttccttccctcactctgtcctccacactgtggtagtgctgtcaccagtcttgtggtaatagtgtggaggagtaagtgaaggaatattgtcatgtcctgctggagttgaaggaactatattccttttaacatgtatttattctcttagggaacgtctttgctcccctgctctgactagactgtaagcccctggagggtaggccagttttactactccctcaggctcagcatgtctccagctgcatttgcatcctgtccctggcgggtttcttccctgtcactggctgtcgtgtaaagttgggtaggggaggaagacctatttgaagacagatcttgtgaagagatgatgaaggctgagtgtgctggtaattagtgtgctgcaaatgagatgtagggaacagaagggactcattacatgtggaggacagggcaagaagggaaactgagcctctgaggtaggtaatggtgaattgctggtgaggtgcctgtggagcacttagaggcagttggggagacagtagtctgagcttgggtagagttctggtcagaagacacaggtttgtaaatcactagtacctagggctctgctcagtgacctcaggcacctgagagcagggttgggaggggcttgacggggagggcggtgcctgttcttgctgttgtcatagtgtggctttattcaccagtgtgtagactgtggtctgtcagatgagccttcatcagatgtccccattattctttgagcacttcccttcttaatggtgcaaaaaggtgttccagctcatgttgtacttttcttgccccagctctaaaagctgccatttgccaaggagctctggtttatttaactggggaatggtatttagaatgtatgggcttttgttttgcttcttgccactgggtagtcattgtttgtaggaccaaacaacggtgctacaaaaaaaaaaaaagtggacaaaactaagagatgtgtgtgtgtgtatgtgtgtatgtgtgtgtatgtgtgtgtgtgtgtgtatatatatatatatatatctgtagttctagtggtcaaaagggatattttggcatcttttatgtccatatgtaaaaccaaatttgaagtacattgagaaggatagaaaaatgttaggtctatatttccctcctcccatcccaaagcaaaataattttaaatgcttgtatatcaagacttttctgttttttgtacctaatgtcatatcagctatttcctttgtgaaaaccagccctgttctgttcatgtataaaggtaacgtgaggaacttccaagagtaatgatcatgctgtaaatcttggattttacatgatgtggcaaaacaaaaacaaaaaatcccagttaagtaggatgccacagtcttcctgtggtaccttttgttacagtgatagaagagggtcagaattgagaacagattggagatgatgtactatttggcttacagattgttagaagagagaggctgttcctctccctgagtcgagctgggatcagcatggcatgatgctttgtcaggtattgtgagggcggcaaaatacagagctcctctaactggattggaaaggtctcctgctagcaagcaccacgtaggaatgaacccagggttgtaagcaggagataaggagttaaccagtttcgtctgtctagcagttttcattgttttaagggatattgttgttgctaaactataatccaaaattcagacctttgatcataaaacaaaatatggttctagtcgagcaaagtaattgtaagtgagcatatttggacagtaagtaaatttttgaaactacaaatatatttctctaactttctgtctcccttagtaaagcattatattaggtcgtttggagggattgatctggtgggtaactgaggcacagaccaaaaatgtttatctatggtaagcagtggatccaggatattaggaccagaaagtctgatgattgctctcatttcccatgaatgcaagaaagtaattcttataaatccatgattgttatagtacatatcctcagataagtatgatttacttaatattgtatagtagaagtataggtcatgttatcctaaatggtcaaagcagtactttttttttttttttttaccagttttctgatttctgagtttgcatatgttttgcttaatcctaagtatcaagttttaagaaaaattgcgtatcctttggaaagtaatctgttagaaacatgctattcttaactctggaaattctcttttcagatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtagactgcttgtaagattttcactgcagcagtgttaaagccactcttactaacacagctagtgtcaccatccgattgctttttctgtgctctgtaggcctgttccaaacatttgttatacatgacattctttcctgctcgttagggatattccctggatgctaggggcagccttgagaaaggaaaggtggggagaggtttcacttgctcttctgggtcttggtcccagttgtgaaggaggggatgttccctgcagacagggctgggtgtggttgggaaggtatgccacaagctcctcttgtaactgctggccacattgcagacacaacaacaacactgatcttgtcccgttaccagagttctaggtctttgttaaagaggggagctgggcaaagcctgtttgtttaaattcttctctgtgtccttgtgttttcagagataggcacgttcctttcctctaggtatagggagggcacctctggaatgagagtcttttgacctacttcaggggaagatctgctaggttttatgactgccttaggggaaggtgagagtggcttgctttcttctgctgttttctcaaatgccaaggtgccatattttggagtagtgtgtcctgaaccgtgtcaatatgctagctgcagcaagtccttccctggcctcagattcaactctcctcactacccgaaagagcatggtctagtggaaataatacaagacggttgtcgaggagtccaggcacagtttgggttctgggttgccaccagctggtttgccatctcacattagacttcttgagacctctctatactatgtttgagtgcacagtaggtggtgtaggtaggactaagtgttcttcaagattctgtcccattctgatcgtttcctaatttgtcttattttcttttaacttcacattgaaatataatatatatatgagaaagtatatatgaaaaagtacatattatttgagttacagaagcattaaaagaaaaagtgcatctttcatagatgcaagtaaatgaatttttcccattggaacagaggcatacaatcagcttccagattaaaaaaaattttttatcatcacccagaagtttttcttcttgcccctttctattcactacttgtcctccccctaggagtcatcggtaccctcacattaacatcataggcccagttagcttgtgtttaagattggataccctgagagcagactctgagagtgaggtgcggttcaggaagtctcttagggagaactcttgggatcaacacctctggaagggaagagaaaggaagggagcaggattctatagagagggaggtcgagctacagttcagtctcagtggaggctttaattgagtccatggagagctctggaaaggcccttcagagatgtccaaagttgcatgggaaataggcattatacctccgtgtttccaggggttggctgcccatgggagggggcatacctttgggtgctgctgctcctttcaacagaagcagtttctgagcggggcgacagctgctggagagcccgctcccttcttgcaggaggcctgagtattgcatcacagcattaaatccagctggtttttagtatttctgtaattcagatcataccgcatatactctttcgtgtctggcttctttcactttacattgtgcttgtgaaactcacctttattgttatgtaattagtggcagattgttcattcttggtgctgtgtggtgtttcgctgtgtgattttacccaatattgttgatggatgtttgggcactttacagatttttgctcttaagaatagcgctggcgtgaaggttttagtgcatgtctttttgtggacattcctgttggctataccagggaggagaattgctaggtccttggatatgtatttgttgagcattagtagattcgaccagtcagttttttgatgtggttgtaccattttacactcccatcagcagtgtattgcctcaccagtacttgagtgtccttttcattttagccattttggtcctttagtgctgattacttagccaagcactctgtaatacttttcctatttcttaaccagcctcaaaaaatctcctcattgaaccagtttcactgaaatggagtcttagtaaatgagttgtagttataaagcattgagaaatagaatataatagtccatattttattgatttcttactgtatttttcagacaatattctgaatgctttacatatgttaactaaatccttataaagattgctagttaatgtataacttatgttataagttatttgttgtaagttttatgttaggttttataacttatgttataaggattaatccttataatactaagagggtaggtactattgttattcacagttcacaggtgaggaacctgaagtagggaggttaaactgtgttcaagatcacatagtattagtaaatggtagagataaaatctgaacctaagtaatctggctccagagctatgtactataatttcacataatttttaatattatataacgttaaaatatttttaaaaatatgtagccacatcttttttaaaatactagaaataaattcttataatatcctataagagttccaaaatagtgagttaggatggccctggcaacattcgttagaggtggaatctccaaataaacttatttttttatcagagcctagagttgtgggttgtgatattctttgtataatatgtattcttaatctttgtattcttacaatacctgactcatgatattggtaatatctgtctatgtttctattgttgagaggagaaaataggatcaatgtaaatcatttaacacattgcctggctcatgacaagatgtggtaattaatataattggtgtcctttaaaaaactactttgctgcaaattctctgcatttctaggattctagccccacatccaaggaactgtctatatctctaggctgcttcataagtctatgaagtcctagagtttgattatggcagggagcctggtatgacctactgcctaacaggcttcatgtcagagcgtgtgtcctagccctgatttgggatatcctttggtgtttaatataatataaagctaatataaagaaattgaaagtacctattttatgagtgcctatgcatgtgtcactcaatgaatagctgctttgcatgcatgcgttaggttaccccacaacttggtgaggaaggttttattcttgttttaccagtgagattactgaagctcagagaggataagggacttaactgtagtctgtcaaagaagaccagagctgtacagtgattaaagtaataaaaacagaactttattcaggaaatattgcaacaggagaataaagccctcagtatagaactgggctcaactctgaatatagcatggacaggtggggattgatagcaaaggacagggtggaggtaagtggatggaaaattactgagaggaaacattggaagtaggggattctgggataaactggattcttgctgaaggcaggccaggatcatcagatacctgggaagtgggtggaagataaggaatttgatcagataatgagggtgagcagatactgagagtagaggattctcaataaacaaacttagcaagatttttgctacagttgggcaatgcaggcctggtaaggatggacactgaaggtcaaggcttagagggctcaggggagcctgactagttagtgttctgtctaggagagacacagaactgggactgaaacttgggcctgttttttttccttctagggctccttgctgccaagaagcctcaaagtagctttgtgctttggcatttggagggaaggccaagaagttagttgttctgggtgcctgcagagctcccaggttttctagggagactaagaggcacgttaaagctgtgtctgcctctacatctctgtctggagtgtgaattgtgagcgtaagagatgtggttcttttcaggaaggcccagctctgatgcctgagcaaaaggcggttttttaacttctgaacttgtaaagaataagctttggaaattctagtaaacatcttaatatttcagaccatgaagtgttttaatgtttttggcctgacagtatttaggctgttggattgagctgcttaggaaaagtatctttctcgaggacctaacttgtgtgtttgacttgtttgacttatttgcagccataagtgaagaatttttttgtaataaaaaaaaaccctctcatttttgtagcttttccagtgacatcaggaaaaagtctgtcagtaatgcttatttgccaactaataataataaaataaaaacaacgactcttcctttaatcattttctgtaggtcatttagaaggcattggtaccagatttgtttccttagcacaaatgcttttcagaaccatgggcagctgttaagcctatttggttatcaacaggatgttcctgattttatagtctataaagattttatggcttgaatcctaaattccatttcaggaatggaggaggcgaggatgtgaagggagtgttaactttctaatgctaaaatggtgttatagatacacattttgtctttgtgaggtattaattgactatgtaggaaattctatttgtctcatctcactaaatactgaatctatttttgtgaaggataaataatgctaagacctgtgacgtgaaagtgtcaaaggtaagatgtttttgagaatgtggatatatgttactaacagctataccctcggtttatgaagttttaatgaggattatcagttgaatttgggggaaaatgcagttggaggtagagattatcctttgctatgaaaattacccatgcactgttaattgactctttaagagaaactgattctgtgtaagcgagtggatacccttcaccagggacagtagaacatactatgacatggatgccagtgtgcttgtttaattagtctgtgctttacaccagtatctggagcagtgagtagggtgtctgttaggatataaacttgttcttccctctacacacttccaagagctctagcaactgatgttacttcttgagatctgagtctaattatacaagccatagacacctaagttttacttgtacctttgactctctttgggggtctttgataattttgtcttctcatttatcttgttccaaagtttattgagtagtatgacacagttcacagtctcttttccaaaatccttaggattatgtattacttatttctcctgatgggtctgggatggtacccccatattaaagcacattaatattcctgtagcaaagtaaatgatttttctcacaaataggatcggcaaaaaggctggtagaaacttcctcagttttgatcaggttttgctaccaagtgagttacaaaactgagttttagatttcagaattttagataagcaattgtggacctgtaccacaaatgtatttagagtgtgttgatttactttgaaagtaattttggggatccctgtagtctgttttatatacttttagcttatatatgtcttgaaaactgaacttatttcattaggaagcatcagattttgcaggtgtttataggttgcttttcatagggaaaaaatgtcattttttttctcttaatagagtttcagttcagaatttgttcttgcttgtttcttactaaagcagtatcaaattcagatttgtctgttagtctgatttttcaggttttcctgatttcccagctaggtaatctatacagtttcctccctaaatgtccttgacacagcgtcagtagctcagtatgaataggaatgtgtgggttttggggtcacacagacccaggtccaaagacttgatccttcactagttcattttgcagctaggatatgttatttgaattctccaagtccctgttttcttatttgtaaaacaggaataataactatcttattgatttgctgtaaacattaaataatatttataaaacattttgtacagtgactggtatattaggaagagcttggtaagtgttacctattttaatttcttcttctcaccctgttgaaggacctcatgaaatactttccagtgctttatcaccatggttgccttcctctgttttcttagaataataatcagtgggagggcagagagcctcttgagggtccctgggtttgggaggcaggaagaggaggtggaggctgagcatttccaggcttgttgtctccactctgagcccccactctgggagggctgatactgttctcacctgactaggggtctggggtcagccagggcaaggtcacttccaagaataaaattagtttggttgctggttgttctgaaaaaaatgcagctcttacatttgaggtatatctttttggagattgagagattatccttaaaggaaattttggggaaattctgtgtatcttgtattgggcctcatatacgaaatgaagaattcagactccatgatgtagactgcctttcagctcttaaaattgtatgagagtttttgtaaggtatgtttaattctttcctacaagatgaagaatgaaatgtccaagtatatttcataatttttgcattgcaaactagaaatgtgactctcatgagactactgttcagtaccagtacagagtaatagaacttaattgaaacacttagaatatcagttttattaatacaaagaagaccaaaagccacagtatcaggaatctgtatgatgggaggatgagcctcacctttcacttgcctgtgtagattgttccagtcagcttgaagagtttaaaataattcctatctctggaaaatcaagaggcaggccactatgatttgggaatttcaagaaaacatattaatgctagataatgtacaactaagattagggatattttaatatggaactcatgagattaattaaggtatagattttttacacagcaaaattaggtaatgcacttgacttcctaaagaatttttatagcattaacacaaccaatgtttttgacagtctagaaaataatattcaaacatttactaaaaaaatagtttctgtgcctgatgttcttttataaacactttgagaatataaagttggccttatagaatattgactttaataaaatttattacacttaaataaatgcagattttggtgtgaagatataaagaaataagccacttaagtgggacttaaattttaattgttcaattcattattctcagtatttttaattcagaaaaattgaaaatatcatatatctaatctgccagatttctggaacagtgaaatttctcaaccgtcaggtgtggggagagaatggtttagtggtagtggtattatatgtaagcagtatagtccattttataattttataatgtaattaaatttgaaaagtaggtttttaatttgtttttgttttagaaactaatgaaaataaaatttaccgaagtctttgccaggtttggaagtggggagataagtgatagacagtattttcaaatggatttggaacaaatgagattttcaggtttataaaaaggggcatgaattaaaaggttaagaaactcttctcaataacatgccatattgggatgaatctagaacaattctaactctgaaggattttatattataaatgtgtgtggaggtaagtaactgaggttcttatccatcagcgatcattgacttattagtcatgtggtatcttaacctatgatggatggcaaggagaaaccattatagaactaaaattttcatagataaatttttttaaagcattggctataatttggatcagaaactactttcctattctcactattagatagtaaacttaactaattcttacttgtttgactcacactatggagattaagtaaaaatttgagtaaaccttagctccacaaatgtctttgggaaggaaattttgaaacaaataatctgtttattttaattacagttatttatttttagtagcccatgttctgccttccattttgataagacaattctgaaaccctgtctaatggtgaaatgagataattatggaacctaagtattatttatttgaatttggtcctcctgtcctcccctgctttttcattttctcgaacaaggcagtgtggaaattttgtaccacacagtgaatcaggtgtacactagggattccattattctgtttccggagtgttaagccctgccttacactccagagtgttaccccctttgatttcttagaattcatacttcccatcactctcattcctcgtcttccttgagttgcacgcttctgctgtcgtttcactagtaagcgaattcaacgagtgattttccaaaatcagattctctagggcatgatgattgtgttagagatcaaggcctagaacgtttgtttcgtttctccccaacatttctattatgtattttgtatcgtaaaactgcttcttaaccttcctatattataaataccttcttatgttaatttaaatattgatctttttttaaatgatggcacagttccctgctgtttaggaatttaattcaataacaacacccaattgaaggatctttgagttagtttctgtcttttgacaacccgtaatgaatcctgaaatgaaccttttttgcatatttgcctcacaatatttctggaattgaaattgcttgggttgtttgacatgttatcaaaatcttgactttcggatatcttatacccagttttctttcacataagcagagcaaagtagtataatactgtttaaaaaggtaatcactgtgcactcacatgcctgctttgtcactgactttgaaatactggaagcttgaaagtttgtgactgacaagataaacagagaagcacacttactaagccaggggtctctgtgtacctatgtcaccaagtccatgaaacaccacagcttccagaaaatgcaactgttgtgctatttcgggtgataagaatattttaaagtcttataaagtaatgtttattacataattttttagtttcatggtcccagcatgtagattattctttctgtaaggctattaccagcatataaatttatgttagtggttttatttatttatttatttattttttaagtggttttatttttaaaatgttaactcactggtcacatcctattttttctcctttttgtttcctataattgcctcactttatcataaaaacagtttgtaggagattggaagtatgtagaggaaagcagtccttatttgctccacctatttcctttaattattggcctgcgtttaaatgcagaggtcattgaattgacatgttggatgagcatcttcttggctttgttgatgacaaaaagaatcatatttgtggaaatatttttctctttaattcttttagtttattttaagctgtaccctagtgaaaaaagatcagcaaatgtataccatattaatgcttgggaataaaatacagtataaaagttaagatttttttccctcgagttttttctctcactttttgtttttagcagtcatctttagggaacttgtctttttcaaacagtaggtttctttggtcagggaactggaaattgatgaagtctatctaaaaaagtgtattcatgttttagtcaaggctaatagaatataaaaaataaggaaaaataaaacattttagaaaaaactttaaaaatatgtctagaataggccaagcgcggtggctcacgcctgtaatcctggcactttgggaggccaaggcgggcggatcacaaggtcaggagatcgagaccatcctggctaacacggtaaaaccccgtctctactaaaaatacaaaaaaattagctgggcatggtggtgggcgcctgtagtcccagctactcgggagactgaggcaggagaatggtgtgaacccaggaggcggagcttgcactgagccgagatcgtcactgcactccagcctgggcgacacagcgagactccatctcaaaaaaaaaaaaaaaaaaaatgtctagaatattgtagaaattttagatcttgtgaatattttttgcaaaatttagacatcttttaattttttttccaacttgtgtaatgtatacaaaatcttatggttcatatactttggaatacatttaagcaatgtgagttaggaaccctatgaaccaaattaggtaaaatatgagctacattttaagaaatgtatttctttgggtttattttaaatgatgtgtagataacatatcttgttaattttgttggtaaatttgaaccttaataaaatgatccaccatttacttggaaaaagtaaaacatggtgggaatgtaaattaatattacttcctaaaaatgtcttgcatgaacctcagatgcacagaattggattaatcattatctgtggtacgtgatgccttgtcattagcccctgaattaattgctcttcttaatcttgattatgtatgtatttgttatttttaaaaactatttaatggccaggcacggtggcttacacctgtaatcccagcactttgggaggctgaggtgggagggtcatttcagcacgggagttcaagactagcctggggaacatggcaagaccttgtctctacaaaaaataaaaaatagccaggcatggtggcgcatctctgtggtcccagctgcttgggaggctgagatgggaggattgcctgagcccgggaggctgaacctgcagtaaaccatttttgcaccactgcactccagcctgagtgacagagtaagaccctgtctcaaaaccaataaacagactatttaatgaacaacatagaattgctgctaatttgataagtatgacttataatctagcaggtactgctaccaatcccattctttttttttttttttttttgagacggagtctcgttctttcgcccaggccggactgcagtggtgctatctcagctcactgcaagctccgcctcccgggttcacgccattctcctgcctcagcctcccgagtagctgtgactacagacacccgccaccacacccggctaattttttgtatttttagtagagatggggtttcaccgtgttagccaggatggtctcaatctcctgacctcgtgatctgcccgcctcagcctcccaaagtgctgggattacaggcatgagccactgtgcccagccaccaatcccattctttttacgctgccatttccatcatccaccaccccccaccccagataatctctgtcctgaattttgtattttttcccttatctttacacacatacacacacagttttattattatgttaaactgtgtggtcatgaagcaggttagagcaaggtacacagaaacctggcaaagctatgcaagtggaaaaaaatcaaggtaatcattaactctaggaaaaacagttgtgcaaaaaggggattaaaatagagataatagtggctaatatttcttgtatatttactgtgtgccaggtattattctaagacctcacatgtttcatttattaattttcttaaaacttctatgagataaatactattataatcctcactttacagatgaatattgatttcatcaaaaatgttgatatcactgtacctgttggggaataagaacctcattaaatactcgaatatggtaggaagtctaagtgatgtggaaataaggtctatgttatatactatgtaaaattaaacagtcataacaaagtgtaagcatgctgtttgaaaacatgcaggcaaacatcagtagaaacaacttaaaaagttgaaacccctcagggtgaacaattcaagtgtgaggtatggaattgcactcttactattgcactttctaaactatgttggtaaatagataagtacctggtatgcaggagattaccaggagagagaaaatgaaaacaaaacaataaaagatgatttggttatttatgtgtagtggttatcatttataccttattttaatatggaacagtgatggttttataaattattaaataatggagacttacactgaaaggaagctaaaaccaaatttctaggcctgagtttatcctaaactttattggccagtcatttaacctttcgggggcttcactttcttcaaattttatggagaatgttgaactagagatgatcttttactgtcactttaaattctaaagtttcattattctaggtattagactaatttttgttttttaataataggtcttactaggcctgaaactagaggcttcaaggctagttttggatgcagcatggccgtttactcacaaccaatctttttttttttaactagtattaggcatatgttataagattagttatatattagttatacgattttctcagtactagtttatgtaagtacctacatgtcatttttatccaacagggttttttttttaacctgttaaagtataatatacagaaaagttcataaattataagtgtgtatatatctcaatgaacttttacagtgagcacaccctaattaccagcacccagatactggatcaagaaacagagcattaccatgattccagaagctccttgcagttgcctccctccagggatcagccattatcctgacttctaacctcatatattagattttgagctgtgtaaatggcatctggtagttgtgtaaaatcaaacatctagacacatgtatgtttacatatatcttataagtaatacataaatatatatacatatatatccataaatatttgtggatatatgcttttaatcttttggtttgggggaggtttttgttttttgttagttttgtttctggcttcccaggatgatacatctaaatttgttgagatttcctaccgataatgattttataaaaagcatatgcatttattatccacttactatttctaagtacatagtcataaaagcaaagttacctaaaatgaaacttttattctaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacagtaagtcttacattctctgtacaaatctttgaagtacttcgtggtctagctgctcccagggatttagcttattgtctaatctttactgatgacaggttttgtggtactcatgtcagagaaaggtaaacccagaaaagtaatttcccaacattctggaaattagaagtagaaataaaacttgaatctagtttcatggtttcaggaattttgttttgaagtctgtaaggacaatattgttatttctctgcctactgtgtctgctatagcttactgagcataactagtttgaggacttagtgatgtttactctggtaagcccagggagtctatgtatggagagagaatttagctaatatttgtgcaatcactatgtgacaggcaatgtcctaattatttacaagtattaaattatttataggttgtgtatcccttgtatgaaatgcttggggccagaagtgtttttgattttggattccttcagattttggaatatttgaatatttgaatgaggtaccttggggatgggactcaattctaaacatgaaattcatttatgtttcaaatataccttatatgtatagcctggaggtaactgtatacaatattttacataattttgtgcatgaaacaatttgtgtacattgagccatcagaaagcaaaggtgtcagagatggaattttccacttttgtcatgttggtgctcaaaaattttcagattttggagtattttggattgtggattggggtgctcaacttgtattttccacaacaatctctaaagtaggtgctgttacctccattttgtaggtgagtatctagaggcatacaaaggctaagtagcttgtataaggtcacaggactagtaaatggcagctcagcagatgaacccaggcagtctggttttagagtctgtggtcttaatcattaacagcacaacttctgtcttcaaagatcttaggaagagcaaaaaaacccaagcttttagtacaaattattggtagtattgaacattgtatttatccgttttcacagtgctataaaaaacgacatgagactggataatttgtaaacaaaagaggtttaattgactcacggttctgcatggctggggagtgaaggagaagcaaagcacgatttacatggccacaggaaagagaacaaagtggggaagtgccacacttttaaaccgtcagatctatgagaactcactatcttgtaaacagcatgggggaaactgcacccatgatctaatcaccttccaccaggttcctcccctgacatgtggggattataattcaagatggaatttgtgtgggaacacagagccaaactatatcaaacatacgtgaggggacttcaaaaagtttgtggaaaatggaattaaaacataaaaataaaaaatgtaaactttatttcttaacataagctccatcaagatcaggacacttttgtgagtgatgataccagtcatttaatccattcctgaaggatgagggtatctggagatctggagactagggataaaaaagaaccaagggtcctgggaatttaaccatgtcaatgtagtcttttttgactgaagaaaaatgggtgccccttaaagattttttaagattaggaaatgaagccagaaagagccaaattaggaccttagaggtggatgcctaataatgtcccattgaaattcctgtaaaattgcccttgtttgatgagaggaatgagcaggagcattgccatggtggagagggactctctggtgaagctttcctgggcgtttttccactaaagatttggctaactttctcaaaacattctcataataagtagatgttattgttctttggccctccagaaagtcaacaagcaaaatgccttgagcatcccaaaaaactgtttccacgacctttgctcttgactggttcacttttgctttgactggaccacttctgcctcttagtagtcattgcttggttgtgctttattttcaggattgtgctcgtaaagccacgtttgatctcctccctcagttcttaccaggatcttgatcccacttgtttaaaatgtccattgaaagctttgctcttgtctgcagctgatctgggtgtagtggttttggcaccagtcaagtggaaagtttgctcaactttaattttacagtcagaatcgtgtaagccaaaccaactgagatgtctatggtgttggcttttgtctctactatcaaaattgttggtcctgggcatgggcaagattaatttcttccttgaaaatttatgtggtctgccactatgggcatcatctccaacatcattttgtcccttcttaaaatgtaaactgctgatttctttgggacattatccccataaactattgctgaagcatcagtgatttcaccattctttttacccaagcttaaccataaagttgatgtttgttcttgcttcagttttagcagaactcatattgccctgataggggctctttttcaaactgatgtcttacccttcttagtgcctcaaactagatcctgttcagacatgttataatcagttagtgtgagtttattttggtgaaaaatggaaatccatgcatagttgtttttgataatgaacattttccatgaaccttttggaggccccttgtatctgtctctctttgactgacagaattgtattaactttcatctataggtagtacactctgtaagtttaaagtggtagtgtgaagctgtaaactctgaagttgtgggttatagccctgtccttgctatataacttgagagtcctgtcttctctgccctgtttccttgtctctggaataaaggcagtggacagggtgattccctcttagcccaaaatgtgtagctctttgcattatctatagcacctagttatttttacaccttagtaggtacttgtacatatgaaatgttttgtgcttgacctttatttagtatacctgctcttttagtacaaatcacaatccacattcagcaagcaaacagataatacaacaagcaaaacagataatttttttaatttacatttttatcagtgtcagctctactgacatgtgctaattggaaattgactatggcctagtaaccattagtctgaaagctgccatcctttcccatgatacttcatagttggttccccatttaggaataatgtagccctgaccctgtgtcctcatttttatggctcattttgtaatagtggggacagaagagaaaaagaaacctttaaaaaattaaaacaacattctcttgtttctaaaatggatgtagtttgttgtcatttgatttatttgaaataaatgataagttgtctggagaaagaaatactattattaccagtggagattgggagatgttaggtttctcattaatgacagaaataattctggagacaatgcatacttttagatgacagcagacttttctgagcgatgaactgtagctaaaatgcaggaaagtcttatgagagtgaatgaacagaaaaggcaagtgtaaaaggactcctgactattccctatataattcaagacggaagatattctagtttatattttctgaagatctgaaatgtggcccagattctagtatacttctgaaccacaccaaaagaaaaatttgcaacaaactagaacatttttacccttgtacaaaattaggtttgtaaacatttagaaaaagttctaaatcatgtgggattttgtttgcctttaaaagaaatatgtatctgtatgtatgtgtatatatactatatatgtacacctagtacgatttcactgtctaaaaagtgcaactgtaaaagcggtgtgctgagagttataaaaggattttttctaccaatggaccttttctaccaaaaggatgccttaaaatttttttaagaaaaaaagaataaaaagaaattgtagtaaaccttgaactgctttaccacaaaaggtgattaaaactttaaaatataaattgattattaagggaagtaaaaaagttttgagtacagttctgcccttttatggtaggccattgtcaaaaattctaatttacttagtctggggagaggccctataatttgtagttcttttaaaagctccccactttaaaaccactaaaaaagggtagcagtgccttcctacagatctataaaacatacaatgtcaggtgaaatgctgggcccagaaaccttttgcttctcacctagcatgagatttatttagtttgtgtataagggattatgaacacaatcttgttctgagcgttaggattaacttccttaagttgctaatatagtggcaagggagagcaaggagagggaaataaaattattctgctaatggctaaatgcttaaaacttaggtgaatttccattttgatgagttatgaaaaccaaactaaaaagagttgagcttttcttttacacttcttgtgccaaaatgtttcattactgtggtctctttgcatgatcagttggtttaatcacacgcaggaccctaaaccccatctgtatgtagttgactgatgtgctggtaagcctttggtaactttgatgtttggttaaataactgtgtagtattgctttaagtctctcttttaatcattcaaaagctaaataattacatcagttctcttaagattttccaaagatgaattctatattagttgcatgagtggctcattttcttggaattttttgggggttaccaaatcttaataagtaataactggggaagctttaaaactgccttagttttctaactttttgtgtttgtgttcaaaaataattaagttgatggtaatacgttggaaagtgattaaaattttgtggaaaggtgatagcatttgatgtagtgagaaaacagttattaattatgcacagatgaggttgtcttttgtttgattaatggatgttactcagcgccaggttttatgtaattaatgaatttgttttgttttttatttgattaaataccaatgtaagacaatgcttaggagaaaagaaacaaactttatgaagatttcaggcaaaacgttgttgataagaattatgataaaaatcatctgtttatatttagaaagttaaggaggttcaaattagttataataggcactaaaggaaatttagttttaggactacaagattaaagtccattctttcagaaattgcaaataaacttttagaggtaattcagttatcttatttgtattttttcccctctgttataatgtaagtctttatattagggtagatagatacaggattattcagattagtgaaatagtaaactcaaaaagcagacagtacacacgagtgagagtgccttgtggaaatgggtaaatgaatgggcaggtggacataaatgcctgttatctggttatttccacattttcagtagagtatttctttcatgtttttgatgccagagtatactttttttttttttttttgagacagagtctcactcttttgcccaggctggagtgcagtggtgctatctcggctcactgcaagctctgcctccctgtttcacgccattctcctgcctcagcctctcgagtagctgggactcccagcgcctgccaccgcgcccggctatttttttttatttttagtagagatggggtttcactgtgttagccaggatggtctcgatctgaccttgtgatccacctgcctcggcctcccaaagtgctgggattacaggcatgagccaccgcgcccggcccagagtatactttaaataatgtactgttagtgtcatttttaaaaaacactctaactgtaggcatccttcaaggctttttcagatatactttccatgggagaggtcatccgttcctgtggtttctgtgggggtgatttttaaacctgtacatcagtgtttcccagttgtattagtttttcgttgttgcgtaacaaagcaccacttaaagtaacacccatttattacctcatgcatggttctttaggtcagaagactgggtgtgcttgacagggttctctggccaggttgggttcttatctgaaggctctgaaaggaatccactgtcagactgaaccctgttattagccgagttcagttccttctagttacagaactgaagtccttgtcttcttactggctattggctgagcattgctgtctgctcctagaggccacttttggtctttttttgtgggctgcttcatctcagcagtagaacctccctcatgttgcatccctgtcatgcctcagatctctctgacttcccttctgctacaagacaggaaaatttgagtgattagcttagggccacgcagataattttgctgttttaaggtcaactgattagtaactttaattgtatctgcaaaatctcttttgccatgcaataacataggatggtaataacactggggacaaaggtcattggggctatgttagaattctgcctgccacactagtgaacatttctacttagatttcttgcttctttgatttctttctaaatttatttcttcttcagccatttcttaaaatggccaaaaccagctttacctttaccctcataatatccccaaatcctacatttctttagttacttcttattcgcactatatagaaccttaaagtcctttatccttttccctcactcttcatagccgagtcttatcaagttgaccactgaaacgtttcttgtgtgaattctttcctttccctttcttgccacagtctttgcaatacacaagtatttctgttagagtattgggaaactgtcttttctgttaattcataaaatgccttgtttttattaattttgatgtttcgtctgaatacatgtagagtctgactataactgcgtgaatttaccaatgagtctcatcctgtatttgttaattttgcacatactttatagtggggagttgcttcatgatcattaatagataagacctaatttaaactctatcatattgtcttctagtatgcatttgaattataattaggtatagtataactatgtatatttttgaaaatcaaattatatattttatatatactggatcttgtattgaggtcaatatattctattgaaattagtacaaaactttgactttactttgcattattcatttattaatttcttatggagtctttactatttgcaaatagtttgcttgcaagccattgctaggttgtaggtactatagttggaaacaggcagatattgtcattgcccttatggaacttaaattctaggaaagaagacagatagtaaaccactgaccatacaattgaagatggtaagtacttggcagaagactgtgggaaacgcagttagcacttgcttgaccaagcctgaggtaccggggataggttcctggagtaagtgatgtttgcactaagctccaaaagatgagtcagcactcctttgatgaagaagggaataatagtattctggacaaaaggatctgtgcatgtcaaggtcttgggtgagaaggatcatagagggttaaacagagtgaggtagaacagagtcaaaggaggatgatgagatattcaggagccagataaggcagttcttgaaaggtaggagctggagttgataagaatttttaaaagatggtggtgtgactgtatggattggttataaaaaatttgggtttctggtaaagaggtaggttagatttaacagattgcctttctgaagaaattaaaaatgctggattaaatgaaacattttcataaaagtattgtggatctgacaagatgatgataagaactgtgaggccaaaaccagtaagcgaatgctgaaaattcacataagctgagcgttgaagctgcttttgccctggtaaaactaacaaacttgagagtattgattttcaatgcctcatagtgtagatggggatagaaaatacaactctgcccatgatcaaggtggagagcccaacaggagacactcccattcagttgagactccctgctgccttaattaagtgtaagggagaacctgaaatgaacccagttccttctcctgttctaggagactgtgagcaggacattctactttaagctcgaaagctgaaagctctgctcaaatgggccagacttacattacctgggtgatattaaaacaaacaaacaaaaaaccctcaagtcatgaaattagttttttgtggttcttaagtaggcaggcctctaagcattcagcagaagcaaacataaactcttcctagagcagcacatcagtgtcctaggtctcgacttactcctataaatatttatatatacttaatgaacagttttagtcaaaaatgacaaaggatacaaggcaacaaagcaccataagcaagaaaaaaaatggaaactacagtcagcagaagcagacctgcagagacttcacatgttagaattaccagatatagattacaaagtcagtatacttgtagtgtttgtaaaaccaaggacaagtgtgaaagtatccacatggaacataaaagttataaaagtgacccaaaagtttagaaaagagaaagacagggaggtcagtgtgtaggcatgtatcagtatcatatgggtgggttgcaatgggcagactggaggaagtggcttgacttcaaagcatcttcaggaggcacagtcagtaggacttgtagtataattgttatattaaatgaaggctgttttgctttttcttatcaaatacataaatctactcacctcccccatttcaaaacaaaaccaatttagttcagtatcctcttttgtaattccacaggtaatgggcagagagttttaatggaaggaactgtaggtataaaagtgtgatggaattagtgaagggttcgtgtttcacacaccatcattattgtgtacaatttaaattttctgtaacagcaaatattttgattccaaaagtgttctgatggcaagagtctgcttctacatttcgtaaagcagttaataaaagattttgtgtattttgctccctttagaatattattcaacaatagaagatgatacattctacctagtttttatggcaaactttctttaatcagtaatgcaacagatgacatggaaatatgcattatttgttttatcttttcataagcccctcttttgaaaccattgtagggaggtgagaagcttacattttctggaaataaaataaaagtgatttttttctcttagtggttgatactaggaatgatagataagacaccattaaagagatgttattatggtatttttggtataaaacccagcaatacctatatgctgctcttagtcaactatagtatctgggagaaagaagggagggggaaggggagatatgcatggagcagtaaacagcaattgaagacagagcagtactcttgggctttgcccccagtgtggaattctagtgagctggaatcgactacgttgaagacattttttttaatgccaggaagccaaagtagctttgaacccaaagcaggacaaaggtcattttctctttctctaaagccctgatggggtttgaccactcttgtaaagtatcagtaccagagaaaaagtaaaaagagcaaatgagacagttcctgaatgagtattttccctaatgcatatgtagagcagtccaggtctccccatacaagtgcccttgatgtcctccagtggaagaaaaataggtcccagccatttgtgctcactctgaaaaacctgtcttccggctgggcgcggtggctcacgcctataatcccagcactttgggaggctcaggcgggtggattacgaggtcaggagatcaagaccatcctggctaacacggtgaaaccccgtctctactaaaaaaaaatacaaaaaaaaaattagccaggcgtggtggcaggcacctgtagtcccagctactcgggaggctgaggcaggagaatggcgtgaacctgggaggtggagcttgcagtgagctgatatcgtgccactgcactccagcctgggtgacagagcaagactccttctcaaaaaaaaaaaaaaaaaaaaaaaaaaaaaagataaaaaacctgtcttcctagaaagtttcttctttgtggctaactagggtgccctgattttgatgcattcttgggtgaataaggggtaaatggagtaagtgccccctaagaggtcaaccaattgaaaatatgtttgagaaaaattacgagagcatttaaaaagagaaaattaacacctatgtcaccaatactttttgtgtggtttgcttttattctctttatacattaatctaacacagttgtacgcagttgagtttataatataatagagttttgtgtcctgctttttaatttacttttcatgagcatcgttccatgctactagaagttctttgttatcattttaatggctctttgtcagtatctggtaccatactatgccataaatctcactggttgcagttgaataaagaagtttatgaaggctcccccctactctggaagaggcttcctcacagcacactcatgtccttaggtatcactgggggcaggtagcatcgatctccttgtcccatttcttcccactcctcttaaaaacacagagtatagtttttctgtatctgtaccatcagatgccactgagatctggccatgatgttccgttaggctgtagacctgagctgtgtctagtcattgaccttctttcttactgtaaagaggtctaggaggaaataactgtaaagctatatgtcttatatagtgatgttttgttctgttacctgcttttcttttttcctgtgactttgagatctcttttttcttttctgcccctttagggtgagagtgaaatttacattttataaaactatcaactcaatctgtctttctttcttaatatacccattagcagggtttctcaatctcaggagtattggccttttgggccagataattctttgttctggagaggctgtcctatgcattataggatgtttgccctggggagggggaagaggatggcaaaaatcatctctgttgagaaattgagttgattttccagtacactttaggacagccctggaagtccattatttggctgaatatttaataggtgccacactctagcctttatttaaaagactggagtgctgggaggaaaacatgacaaatgaatggcttttattaattagattttagataattcaatttttcatgtctttcaattggtctttggtttgaaaataaaaattgttaagtttgtcatgtatgatgtcaaacagtgcttaaattcctaaaaagatagccataaatgtttatctgattttgaagagaatttttaatcccagtcttaagaatgcttaatgttttgatgtatactatgtttgatgtaacccgctttcaagttagactcaaaacagattcacttataagttaccactattatttttcgtcctatcaaagaagaaattcccttttgcttctctgaattgcttgttgcctagttagcacttttaaaaagctggtctaatcgaatatgaaccttcaaaagatatacttgaagggccatctgctgaccccagctcttgtccatgtgagcaacttgtaatggtggctctgatggccatgtatgtggagtgagaaacagcagatggttgtaaagatttaaaatcttcaacaagtggccgagagtcatctctactttggagttagtcaagatgctggccacatgtggttagtatgttatgaagggtttcacatattctgctcatttcgggtttttttcccctccttgctgttctaacctcttctcttttgttttaagagctagcattctgtctgctgtagattataagaatctgtaaccaagtggttttgaaaaggaaaaaaagcaaacatacttgtatttctttttccagtgccatagaagattggttaactaatgtagtgaaatggcccaaattagaatttatttgtagtgaaaacctaaggtcccttatttattagcctttcctgctactggcagattcctgattactcacaggtgaagttcagagataattttagcccattccagaaattcttcagtttttttttaaatttagttatttctgtaaaataatgtccatttgaagatgtacttgtgaaaaatatgatttgattttggtgactcttgtgtccactccttgaacctacattctgataaaaagttaaaatccttatgtgacagagatggaaatgtaagtatgaggtggaggaaaatgtgttttccgtagccagggtggagtggaaccaccactatgtggaagtggaaactcccattccgtgtgatgaagaaatgcttgtggcatgcagggcagatggagtgtgaaatagcttcaggacaagaggtacccagggaccttggtttaaaattgcaatttcagaaggaatgcaagcaaacttctggatttcagacagtttggcattctggggaaagaaaggactttaattggtctggcttttttccaaaaagttagacagagtcatctagcaagctgctgtcttctttttcattgccttcaacaacaagcactttataaagcaagtgacaagtttttcttttttgaaaccagagtttaagatttacatgaccagaaagttctagtatcataatttttcaaaatgaagcttatttagggagccaataagtggacctcctaaggaactgaaacacattcagtcagtattttgtcaaattattattgaccaaaccagtttttaattttacatctggttagagcaagcatttttggatatagttggaaagctatctggaccccctccataactagtcaactcccttagcttcctgtctaggctctgcttgctaagtcttgtcctgagatgtaacctctctggcctggagataaagtcaactaactgcatggatggattattttatatattcattcacatgcagattctccacaccctcagaaggcaacctgacatctttattgagaaaattaagaccattttgcattaaccaccacatctttttctaacaccaaatcatttctgtctctctccactcccccaccaccttctgtttcctcttttcatcactcctgaccctcctccttgtcaaagcccctctccctgtgtcttcatcctgggcttccttctccatcttatgtttctcttgtttcttctcctggcactcatcctcctcccctttctcattcttgccacttattttctcctgcctatataacttggtaagccttctctcgtttccttaaaaaaaaaaaaaaatcacatctcaactccattgtgtatctctgccatttcactgctctatctctttcttttatcatctattaaaactcttctattaaggaagatttaaattctgatttgtcaactcagtgttttgttccctactgtggtcatcttcctaagccctctgtggcctttccatttttaagtttcccttcttccatgactacatataatcatcttggttctctttctacctttttgacaaatgttttgccttttggtgagttttctttctttggagagcttctccattttctcaaactcagtttttattttagttttgataaacttacaaattgtttctaactccagctctcctgattgtttttgaaatctcttctctcatagccttgcttatttttctaggctcatttcacatgcagtaactttgtttttttccccttaagtcatagtcctttatgtaatataaagatgatagtttactttattttgaactatagtaaccagctcatctgcatggacccgtatatcatggtcgacttgacatttcttgcacattgaatatgatagaggtgggagatactccctacatttataaactctctgaatcaaaccatcttattttgaagcaatatctgttaatctttcctttttatccatcatctttaataatttggtgtagacatgtaaaatgtgttttacctaagaagatgagagttgaaatactgagttgaatgtgtatgtctatcttcctggtaatgcagggagtaggaagaatagacaggatgactaggggaggatgtcacatatctgaattaaagtagtagtacctttctgcttaatagttagaaatgagattataaaacactgacattgatttttcttgtgactgattaaatgagtcacactagtttatattcatatcatatatgtatagcattccagagtaaaactcttagacatgtttcaaaggggagtggaacatttgttaaaatcctggttcctcactgggaagttggaaaggccagaattggagctaacagtgaatctaagaggtagaactagaccgggaaccaagtgtcaagttgattgtaagaactgacagcagtggtcaggcagaggggtaggtcaggtacaggagatgcttggaggccggtggtgaaaaaaaaaaaaaaaaagccgaagactcatataaaccctgtgagcagttgagtcattgagcacacagataacaaacatcaaacagaggaaaccagaagcttgatataccacctagatcactaaggaaatcataacacttctttcatgttctagagcccaccctagtgagtggatagcccacaagctcatagctagactcagtgaactgtgataaggaagatggtggaaagctgactagtgtggaggtgagtgaggtcagagagaagacagatctgaagaggattattgatgagatcattatgaagggcatgctgaaacttctaatatgaatagtccagatttagataaaagggaatgtagaagtagcccaaacttcagtaactaacatttcttatattatgtatttatgtgttcacttatttatatcaacactcctatcccatcttaatgcatgttagttttttgtcttatgaccctctgccacccacttctaagacccattcttaatttgttacatttgaataaatatctttcaaaaaacaaagtagtagcacaaattgaccacagtattcagtaaagctaaattcccctttttgccacagtataaagtcacttattaaggtctatgaatggtgctatattgaaccaatacattttcctttacatgtacctatttatcctttcatatttcaccaaatatttactgagctcctagttagataataaaccaccttatcactggtcagttaatatttattgaatatatttggtgtccctagcaccattcagatgtattttttactgctaatgtctgtcatttacaggtgtgttaatagccattataattgttatgaggccagaatgatcactttggatagagatttttaaaatgagtttttactcattataaaattataataattgacattctcatttgattttgataatattgataattgatgaaatgatcattgtagaaaactgcagaaaacatgaataaaataaaaagcacttgtaagaccacttcctagaaataaccactgttaacatttgggcatatttcttcttttttttttaaccccaacaatgactacatagggcatatttctttatgtgcacacacactctctctctctctctctctattttctaaaaatagcagtgatatttgtctgagttcaggctgctataaaaaataccacagcctggaaggcttagatgacaaacatttatttctcacagttctagaggttgggaagtccaagatcaaggtgccagcagatgcggtgtctggtgaggaccctttttcctggttgtggatggctgccttcttgctgtgtccttatgtagaggaaagagcaagaatctcctgtctctttcttttcttataaggggattaatcccatcatagggggcccacccttttggcctcatttaattctaattacttccctaaggttttacctataagttcatagcaatgtttgtatatagttttgtgtcctggttattttatttatcattaatcacatcatgagcatcttatcccatccgtactttaatgactatgtaatattcgactcaggactatactgtaacttatttaggatctttcggcctttaggttatttatagtattttgctgttgtaaaatgactttcatatagctgtcttaggcataatatttgtctgcctctaattatttccttctaggtttgtagaagtgtgattattagttaaaacatacttggcatacctccagaagccagggccacttggtagtttatgattgcaccaggttttcaggttaagtctataaataatgaagagaggaaggaacatagaactgccaactagaagtaaacaggctcgtgatctggtgacctgagcgactctgaatgcttgctgagtcctagttggccatctaggttggttcccatgtttgagagacgaggatggatgaatttaaggtaagcaatatatgccatagctatacgtgctctgtgcttactggtttgagggcttttgtgtgtttttgtatgtgtgaagatgagaaaaactatcaacactacctctgttgtgtcttgtcaattaagtagtattgattattgctacttgctgttccagaagaaaaaaaattcaattttactcttaatattccagtattaatttagcctttcagattgaaacttctttaaaagttttcaatttatgctagttaaattagatttagtgttttcttgaaaaaaaaaaatctagttttagattagtggttgccaggagctggggagtagagggcagaggggcaatgcaggtatgactataaaagggcaacccgtgagatgggtgtggttttggaagtgttctgtgacagctacatgaacctacacatgtgataaagtagtatagtattaagtgcataagagaaattagtacaagtaaattaggaaagtctgagtaagattggtagattgtttccacactgataatcctggctgtgatatgctataattttgcaagatgttacctttgggaggaaactggataaagggtacaatggtgactggctatattatttcttacaatttcatgtgactctacaatggtctcaataaaaatttcaaaactaatttttttctggttctaaaaattggtaatattcaatagtggttttttgttcagtgacaaatttgaaatgagatttatattcacaagtactatgttcagtatttttttttcattaagtttgtctaatatgaacagaaggaacaaatgctttttaaaaatctaagtttctaaaattatgaaataattttctttttttcctctcctttagccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttatttatgtgatctattttatattgctttgtttccgtataccctttcctccttgtgaaaaagtttctgatggaagagggaaaacgcaggcatcttttattactggaatccaatacttagtttctaatactgtattacagtgaaatttttgatagcaggagactgtgttccattattttatgtgggaaaataataaggcattcttagtccatccaaaaaaaagtttctttgaatatttctctaatattcttaaaacacctgtataacaatttccaaggatttggaacatagatgggtacatactgctttagttaggaaaaactagcttatgctgtagaaacacatctctaaatttgtgccatttgatccatacaggttgacattctgttcaccttagtcattcagggtgaagttctcccaccttatgttcctatgtcaaaaagaggttttagagggaaagagcatacaaattacacaccaactcttcagtgttttgaatcagaagtaacacacatcacctgctggttcattgggcaaaacaggtcacacggccccactcaaatgtaaggagggttaggaaatgcagacttctgtgggtataggaaggcaagtagactgggaatattggtgaccatgagttgtgagtaagtaccaaagttgtcattctgttctctgtatttggaagtggggaatagggatgcatttcttgtattggtccgttttcacgctgctgataaagacatacttgagactgggaaggaaaacaggtttaattggacttaaagttccacatggctggggaagccccagaatcatggtgggaggtgaaaggcacttcttacatggttggcagcaagagaaaatgaggaacatgcaaaagtggaaacccctgataaaaccgtcagatctcatgagacttattcactaccatgagaacagtatgggggaaactgcccccatgatttaaattgtctcccaccaggtccctcccacgacacgtgggaattatgggtacaattcaagatgagatttgggtggggacacagagccaaaccatatcattctgccccggcccctccaaatctcatgtcctcacatttcaaaaccaatcatgccttttcaacagtcccctaagacttaactcatttcaacattaacccaaaagtccacagtccaaagtctcatctgagacaaggcaagttcctttcacctatgagcctgtaaaatcaaaaacaagctagttattcccagatacaatgggggtacaggtattgggtaaatacagccatcccaaatgggagaaattggccaaaacaaaggggttacagggcccatgcaagtccgaaatccagtggggcagtcaaattttaaagctccaaaattatcttctttgactccaggtcacgctgatgcaagaagta

SEQ ID NO: 13211 - DNA, 77867 bp, Human
ccatgagtatacaggaggttcataattcccctagtcctaagggattaaagaaggcttcctgaaggaactgatgtttattctgctaagctgccatattaatttttaaaccaatatcagcttaaagggttacacaacatataaaccttaatcaattaaagaaaaggagaataaccaatagataatttacaaatacgaattcccagcctctcaactctatttgttgaaatataatcagtctttcaaggctcttctctgatgttatctctttcattctttcttgatcctctcatttagatcgctttctgctttctactttttttggtgctacatttcacctctaactttgttcttgttttagccccttaaaagattataagctgaaagataaggaccacatttaacttatatttatctcctacttgtctatagaaggcattaagaagtatgtgtagcattacatttaattaaagtcttgtcacttgattttgcctggaatggattctgagaagttccagagttaggcataaccccaagatactgatttcttgatacctaatctcacaagtttaacagtatacaatcttaatgtggtattaaactttattactagtggcaatagcactaaactcaagtttaaatgtattactcatgtccagtaacttttctggtcctgttactttattgtaaaatgtaagaattttactaaagtattcctaaggccaatccggcttttcagtcacccaatcagagacacccttggaatcagagatatccaatcagaattgctctgtgttttattaattctcctggagcttccactttttctttgattctcaaactaattcctgaaccttgcaacacaaaaatgaccatacatcaattcattaaacacttaacagatgctaataaataaaagttcacttgtaattatatcaaatatagtaaccttataccacagatcttaccctctcccccaacatgcttttcctttcaataaaaactccctttatataaattttgagtttacagatccagatacaaaaaattatgtacaaaattttactggtatatttagtttaaaaagccaagcctaggcgcatctacccgacttacagttaagaaacaaaactgatgacttgatgatgatattcctgatattccatcaggaatgtcagggtatgtttcctaacttaaagggcatatcctattttgagagagatccgaactatgtcaactccttacaaacaactcagtgataggcggggctataaaccttactggtgaaggaggttcagatagattaaaacaacttgccctagatcaaggacccttcaatggaactgaaagggcagacgttctaattcaaaagttctacattatttttcgctgcactatacatcttactgctctcagcacaaagcagtgcagatgtgctgaactcaaggacctaggggcgacacctgtagagggtctggcgactgggagggagggagaggggatccagctccggcactctgccaccagccgggagctcacaggcccgtgagctccgcctgcggccttccaaacagccaagagcggagaagcggcttcggtcctacctggggaccacgaagcggcctgacctgcagggctcggcctgtgtccacaggctacccacccccacgggctcaggagttcttagatggcgccggtccatcaaaaagcgaggtccgggacagggaataacaacccacctgacagaagggaaaatcgccgccttgcatctcacttccgggttcgtctcctagcctgctcaggattggctcctgcgtgagggcggggcctcgccgctactttacccgccccctcactgcgtgcggtagccaatgagagccgaactggacttgaagcatctacgttatccataaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtggggtaatttaggaatcgcattcgtctcctgtttctgcaggttcccaggcggaagcccagagttaactggaacctcgggaagagcgggccgagtgggcaggggaggggtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcctaaaggtgttcctccgcagaccacgtgtttgtttatttacactcgctttaaacgcgggcccgttcccttttccaaactagccaggtcctttaaaaaaaatcgtggggtttgaataggaaatacaggattgcctctgttctccagagtaacctatgcgtgcaacttaaaaatatctgcacatctagagttgtttgtgtgttgaaccagaaccgtatgtgaccctttctgcctatttatttagcatacattaatttcccataagagcacgggaaaggaaaataggagtttaatcatcttggtgaaactaggaaacaggatgtacactggagatatattattttctatgctcagttcattaaaaaaaagtatagtgggtgcttagatgaaaatgagacttctaaatttgccagtctaattaagacgtctgtaccttgtgcagcgtaaatcatgttggttaaatacgtgcaggcttttaaaaaatgtgttttatgatgtaattttgtttttagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaagggtatttggaatgttttaaatatttatctgtttgttaactggaagctaatatgcagctatagattggagtcttgcagtaatttgatatattgatatagtattgtttatgttcttaggcttcatcttaaattattgaagtgataaatattcttgaattttcctgacaaattcttattagtcaatgcagttctgtttaagatttttagagtaaattcctctagtattaaataagctggaaatgaatttgaatggaatgggaataaataaaaggactgtaaaagttatgtgcactttgggaggccgaggctagcgggatcatctgaggtcaggatttggagaccagcctgaccaacatggtgaaaccccgtctctactaaaaatacaaaattagccaggcgtggtggcgcatgcctgtaatcccagctactcaggaggctgaggcaggagtatcatttgaacccgagaggcggaggttgcagtgagccgagatcgtaaaaaaaaaaagttatgtgggaaagactttagacttggagtcttttaccctagtttcaagtccttggaccctactagctgtgtgaccttgggcaagtcagcagttctctgagccttgcctcaattttgccattggtataattggaataattatacctttttcagattaattttgaggcttaaatgagagaattcatgagaaaatacttcataaattgctacagaaacatgtagtattatgatttgaaaagtattctgacctaccttcttggatatatcagtgagaactgtgtgcatatcatttttgaagtttttgaagagaaatcgtttgtggaaatatcttttgtttgtaaagatttgaattttggagatatatacagagattttttaaaaattcattgtggtttattgaaaatagcctgagttttcatcatgggttttagtcctgtttctgtcactagttatgtgataaagcagttaatttctctgggtttagccttctcatttgtcagagataataatgcctgactctttatctgtgagggttgagatgagatcataaaaataaaagtatttcatacaattaaatttagtgtaagagtattaataactattacattgctacttcacattaaagtacctttgaatattaccaaattcaaattgaaacaattctgtgttggccaactttattaatgaaatctaactctgtagagagtagagtcatgcaagtgtcttcaaggccctgaatgtaaattattgcatattagtataaaattgactcataaacttagaggaaggctttttaaattaacttcgattttcctggaagagtacgaagtcagataaataacaagtttatttatctgaggaaaacaagcaaacttttgggcctgggttacatgagtttgtaaaactggttataacaaggttataaatttttgaagcagttatagaaccttgtaaagatttatgtacatttgttctgtattgaactagtggttaggaaaactgtaatgttaatgataacgttgaatacttcagattttcagatgaactctaaggctaaaaaaaatgattttactctataactgttattatttattttataagtttgtctcaatttgtttgaatatcctttaatgaattattaatatattgaaatgtttcttctttcttaatatagtgatgatgaaaacacatttaaaatattagttgcaacagatattcatcttggatttatggagaaagatgcagtcagaggaaatgatacgtttgtaacactcgatgaaattttaagacttgcccaggaaaatgaagtgagtgtggtttgtatttgtgcactatctaccatattcccttggttaacaagttatttttccttctaaagttagagatttgttttataagctcaggtgcttaccttgcctgcttgaatatcaatatactgaaagctcaaagccgattttgtatgctttgtgtcttaaattcaagtaggagctacttttgtaaatagtctgttaaaatttacaaatgtttttggggtgtttactgaatgcaggatcctgtggcagtgtctattcgaaatgtaaggtgactgtcaaagcttctgctttcagataacgtagaagaaaactggtgtgaaagacaaatatccacaatccacagatgcaaggttgtatgtgataggagccctaagaaaattctaaataacatttcctttgagtttagaggcagaaaaaatcacgtttagattatagcaagatgagtttaatgaagaaggttgtgtttaacttgggctttggaggaagggtagacttttggccagtggggagcatagagaatgtacatccatgtgaagcaggagtgaggaaacccgtgagacagtataaggtatgttaggggccctgtagtcaatttggctcaccagcaggtcatagttagcaagcatgctgagagactagaaggaaggatttgagctgcattaatgaggacttcaaatatcagattgagaaatttgtatccagttcaagagaaagtcttttggcagcggagtataataccatgaattggagaccagttagaggctttttttgaagtattgaccttagggatggaaaagaggaaatgaatgcaagggatactgcaaaaagaggatttgtgtactttggttagttgtagcggggtggggatgagggcaaagggatgacagtgactctgaagtgtgtggagtttgggtgaatagttgtaccaaaaatagaaataggtagataaggaagaggtactgcttcatgtgggaaggtgacaaattctttgtttgatttcgacaaacttagagttggagactgcaatgggacattcagggaaaaatttcagcaggcagttaacacgccagcccaggagagagttggagaataaatgtaaaaattgacttgcaaattaacaccgccagccttgacttttctggagagttctcttaagtttatctgctaggtccttagttcttcctcccaaatatatatggttcctctctactactcttttcacactaataaacttagtccaaaacgatcacatttcacatggcctgcaggaggtccccttccatctttctgcttctattcttttctgctacatctactcagcatagcagccaaagtgaacttttaaaataataaatcagatcatggcactctgttgcctaaaattttccaagtgtccttccattgaatctagtataaaattcaaactacaaggttcgacttgatcttgacccctgccatgaaacttcatctcctactactctctgcctgatttacagtgctacatccacaccggcatgttctactctgaggcccttgcacatctagttctttctgcttggagcacattgatcttggtggggccgacttctgagagttcaagtcttacctttttggagacgtcttccctgatacttccaagcactgttttatcacattactctgctttttttcatagcatatttttaatagcactatctgaaataatttattgaattatttacttgtttattgtctgttgtcttcactagaaggaaaactccatgagagtggaaatcttttgtttgttcatgctgtatcttagtgcttagaaagaatcagaaagcagtgggtatacatattttaaatttcttaattaagtgaggcaatggctggattctttcttttattttaggttcaggggtacatgtgcaggtttgttacataggtaaactcatatgacagggattgttgtacagattattttggcacccaggtattaatcctagtacccattcattatttttcctgatcctctccctcctcctatcatctgctctctggtaggtcccagtgtctgttgttcccctctttgtgtccatgtcttctcatcatttagctcccacttacaagtatttgatttttctgttcctccattagtttgctaaggatgatggcctccagctccatccgtgtccctgcaaaggacattatctggttctttttaatagctgcatagtattccatggtttatatgtaccacattttctttatccagtctaccattgatgggcatttaggttgattccatgtctttgctattgtgaatagtactgcagtgaacatatgtgtgctgtgtctttgtggtagaatgatttatattcctttgggtatataccaagtaatggaattgctgggtcaaatggtagttccatttttagctctttgaagaatcgtcacactgctttccacaatggttgaaccagtttacacccccatcaacagtgtataagtgttcccttttctccgtaatttcaccagcatctgttcttttttgacttttcaataatagaatgtaaggtgcatttttccttccttgaaggcaaaaaaacttgtggccaaaggaggtctgtttcctgccagagaatcctgtatgtgctctttcttttttaactcttgagccctaaaacagaatcttctcctgagtgtaagctacttaattctactttgccctttccttcacttctgcttctactgtttctcttccctgcgtcccttaattgtaactgttccaccccccataaccccaggtagggacttctagatgtgtattatatttactcattctcttgatttgtatttagtatttcttattattgaatctaaagtcttcctgacttttaagtcccttattatgtgggcccatgcccactaaccagtcttagttctgttccctagtttcttggagtctttttttaaaaaaactttttattttgaaacaacatcagtctcacagaaaagttggcaagaatagcgcatagaattccttacccgtcacccaggttttctaacattttgtcacatttgctttatcttctctttacaaatacacacgatttttttcctgaaccatttgagagtaaaccgcatgtataatcatagaaaaccagaaaattagtattgattcagtgctattatataatgttaagatgttgccaattgtccctgtaatgtctgttacagcactttggaggctggttggtggtgtccaggatccagtccaggtttacatattgcatttagttgccatgtctctttgtctcctttaatctggtacattttcctgcatctgccttgcctttgtttttcatgaccctaatattttgaagagtacacaggccagttattttatagaatcttcctcaaattggctataagtggtatttcctcatgattaggttcagattctgcactttcggcaagaataccacagaagtgagtcgtgttcttttcaatatttcctggagtcactgccagccagtttaaaaaatttttttaaatgtttgaatgatggcaaaatatattaaatacataacataaaatttcccttgttaaccatttttaagtgtatagtacagtagtgttaaatatgttcatattgctgtgcaaccaatctccagaattactctcatcttgcaaaaatgacacccattaagcaacaacttcttttcgccccagtatgtttttcatttggtttgttgtttttgttttgtttcttccatgcctttgattgagatcattttcttccttttactcaaatagtgttcattctggaaggcctagcttaaacctcacatttttattaaagttatcctaactaccatacgcacagtgatctataccttgtattcttttgtgtgattaagaacttaagtttctttaggtgcatcgtatacgtcttgaaagcctgtgttagactttttctgtatgatttccctccttcactgaagttattcctagaattctcttcctcacaatcatttatctttcctagtgcaactaacatgccaccatgttagttcattccttctagactttctgtcctcaggcgaattgtcctcccttgagttcaaattcatcgtagtgtcatctctgctgctggttgcttacgtgtccattctagtgcaccccagagtttgacttatgtttaaatgtataacagtttgcctcttccattagagtttgaacatatttaggatagggatcatattttattcatcattgtatcctcaggactcagtagagggtcttgcatagagtcagtatttaatgagggcagggatataatctattttgtagattgctattttttgagcttctagaacctgtaggaattctgtaaataaatgctgaatgaattaaatgaatgatttggattgaatttggtatctcttcccatacgttctgttaaagtgctaagtttatgtttgattcaaataatagaaaaaatatgatcaccttgtgtggcctgaatcagagacttggtgtaattggaagatggcttttttgaagatagcttagtcagctaaattagaaccagattaattaccagattgaaagtccctttgaataaataaaatgtaaatttttaagttgccatatataatagtgtcttttgtgagtttttttttatctctttcatctgtagtttacaaaaattttacctgtaaaacatactaattttaacacctttttctgttgatcaggtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtaagtatatttatttacttgagtgagtgattacttgtgtatggtatttgctgtataagacacgtaaacacacaactgttttgccttccatataagctattttcttagtaaatatcattctttgaatttttttgtacatcattgtattaatttatattttcctaattaatagtggaactgacccagctactcgggaagctgaggtgggaggattacttgagccccagaagcagaggttgcagtgagccaaaattgtgccattgcactccagcctaggtgatagagcaagactccatctcaaaaaaaaaaaaaaaatacatggtgggactgaatatcttctcaggtttatattgtacattttggtatcctctcctgttcatatcctctgcctattttaaaaattgagatttttttgtttgtttttctacctgaattgcagaagttacttatatattctaattagtaaacctttgtgatacatatattttttcccaatcaatggcttgtcttttgactttgtttatggactcttgttgacagaaatatttaatttttatgtagttaaatctattggtttttctttttttccatttgtgcctttgggactatttatgatatttgtcaatccctatattataaaaatatcatcatgtgttttttctttttttttttgatggagtcttgctctgttgcccaggctggagtacagtggcatgagcttggctcactgcaacctctgcctcctgggttcaagcaattctccctgccttagcctcctgagtagctgggattacaggcgagtagttgggattacaggtgagtagctgggattacaggcgcccatcaccacgcccggcaaattttttgtatttttagtagagacagggttttgccatgttggccaggctggtcttgaactccagacctcaggtaatccacctgccttggcctcccaaagtgctgggattatagacgcaagctaccgcttctggcccatcatgtcttaaacattgtacaggatctcacattgcatttagtagaaacgtttccttaatttcttcagcccatgtcaggttttctgtctttccttgtctttcatgaccctgatacttataaagaggtcaggtattttgtagaacgtccctcaatttggtattttctcctgctttctatgattagattgggattacaggttttgggggagaatattcaagaagtgaagtaccctttcagtcgcatcatatcaggaggtgcgtgacatcaacctgatttatcactggtgattttaaccttgatcacttggttaagctggtctctgccaggtttctccagtgtaaagtcattattttttcctttccatatgctgttggttagaattgagtctctgagtccagcttactctcaaagggcagggagttaagtttccacttctgatggacataagttaaaaccaccaaagtaattaataaatattttagggtagatattttgaggctgtgcgacttttctgttcctccttaaatttgttcattaattttagattcatcagtggatcttacctacaacagttataactgtgatattctaattgtgattttccatttcctatattctttctacatgtattaattgggattcttttgtaaggaagatttgtcccttgtcccacatttgtttattcaattgtctatatcagtagaaacccatttttttttcctttgggttataatttattactatcataatttacttgtggcttaaattgttccagctttagccattgggctccttttgagattggctcctgtatccttttgatatatcccaccttttcttctgattttttactttgtctttcttgtcttcagactcagccatttcttcaaggaaccctggttccttttggagaatggtatttggaaaccaagatctggatgttacatgtgcacattactattgtattgttgcttctaggctctcactggacagagctaagaaaaatatgtgtacatactaacccatgagaatagacatactcatgtttatttatttatttatttatttatttaatttttgcttttgagacagggtctggctctctttcctatgctgtagtgcagtggcatgatcatagctcactgcagcctcaacctcctgggttcaagccatcttcctgcctcagcctcccaagtagctgggactatatgcatgtgccactgtattagtccgttttcatgctgctgataaagacatacccgccaagactgggcagttcacaaaagaaagaggtttaatggactttcagttccacctggctggggcggcttcacaatcgtggctgaaggcaagaggagcaagtcacgtcttacatggatgatggcaggcaaagagagaggttgtgctgggaaactcccatttttaaaaccatcagatctctttagacttattcactatcaccagaacagcacaggaaaggcctgcccccatgattcaattatctcccacgaggcccctcccataacacgtgggaattatgggagctacaagatgaaatttgggtggggacacagagtcaaagcatatcagccaccacacccagctaatttttaagaaattatttttggtagagatggggtctcactgtgttgcccagctggtcctgggcccaagcaatcctcctgccttagcttctcaaagtgctgtgattacacttgtgagccaccatgcccagcccatatttatttcttatttagtttttaaagtgtgactttatattgggaggtaaatttttttttgagattttgtccacatgaaaatgtttatgttcactttccccttgattgatagtttggctgcatatataattgagttttaaaagatttgtataatactttgtccttgtttttcaaaattgtgatcaatgtctttaccctccttctattcaaatctaaaacttgggacattttttattttttattttttatttttgagaaggagtcttactgtcacccaagctggagtgcagaggcacgatcttggctcactgcaacctccacctcccaggttcaagcagttcttctgcctcagcctcctgagtagctgggactacaagtgtgcaccaccatgcccagctaatttttttatgcgtttttagtagagacggggtttcaccaggttggtgaggctggtcttgaactcctgacctcaagtgatcctcccgacttggcctccgaaagtgttgagattataggcgtgagccaccacacccagccgggacattttttaacttcagtattttctttctttcatcttatttttaaattgcattctgttttgaaaactgtttccccaccctatatacatgtttacctatttctttgctcactgttgttccttgtatttcatttcttttgtgtagattcagtttccttctttctgaagcacagttttcagtagttttttcatggagtgtcagtgagtggtaaactcttattttttgttgctgttgaggagtctactgttaggtgagttgctagaaagtttagcatagtgattaagagcatgggttccggtataaaacagctggagttcaaatcctggttctgtcatttagtagttgtaaaattatgttagtcacttaactactctaccttagttctgtccttcataacatgggaaagaaatgtgccaatcttacagagttgagaagattgagatgataagaaaaatggctagagtagtgaccagcataaagacaatacttgggtaacttaagattttctcattgttcttaacatgttgcagtcttatttagctgtggatttaattctgtttgttccgcgtgggctttatcatatattctaatgtaatattgtttttcagcaacttggggaaattcccattctattcattatgttttcaaatattgtttcctttctctttctgaatatcatttatatagcatactattaaaaaaaatattgcccataactttacctctttgtgtttcattttggataatttaatcttccagttcacagttcatgtagaaaataggcaaagatagggaaatcccaaaaaagaagactactaaggagttagtagccaattagatttgaagtataacaatgctacaataattgaaaatgtggtatggctcatgaattagtagataggtaagtgaaagagaatagaaactctagaaatagcctcaaatacatgtaggaattgagtatttgatgaaggtcaccatctcacaatgtaggggaaataatggattcagtaaaactgctaggagaaactgttacacatattttaaaaatctaggtgtggggaaggcttctaagtatgacacaagacccagaagtcataaaagattcatacatttgtctttgcaaaaataaatttctgcatgccaaaaactgcctgaagcaaagccagaagtcacagttcaatcaggaagaatatttgcaaccaattgcaaattaaggttgaattccccaataagcagttctttcaagacaataaaattcatgagttagtaataaataaagaatatggacatacttcacagaaaaggaaataacatgacatttaacttttatttttttttttcgagacagagtcttgctttgtcgcccaggttggagagcagtggcgcgatctcggcttactgcaacctctgcctcccagattcaagcacttgtcctgcctcagtctcccaagtagctgggactacaggcatgtgccaccatgcacggctaatttttgtgtttttagtagagacagggtttcaccatgttggccaggctcatctcgaactcctgacctcaggtgatctgcccacctcggcctcccaaagtgctgggattacagatgtgagccaccgcatccggcctaaacctatttttaaaagtttgatttcactcataagaaaaagacagagctatactgaaatatttttctcctataaggttggcataggtctgtgactctcaatcctgagtgcacagtacagttacctaagaacctttgaaaatatggatggccccctctccaggccaactaacttagagtctctccaagtatgtcatgggcattggcatttcttgaaagatccccaagataattccaacatgctgctagcattaagaactgctagcatagatttaagagctggatgacctactgtgttagtgaggtaggggaaaactgtccctcttgtgcactgccattgcattatgtgtaaatctctatggtgggaaattggcagcacctatcaaaattacaaatacatgtactctttgacctaacaattcccttccaggtattcctttacaggtcgactcaccagggcaacaagattactcgctgtagaagattactttgtacaagattactgactgtagcattgtttgtaaaacaagactgccaagaatctaaatgtccattggtagggaactgctcaaacacattgtggtgatccatgcaatggagtactgtgtggctgacagagcagaagaaaggtcttcatgtactgatgtggaatgatttctaaaatatgttgagtgataaaagcaggatgcagaaatgtatatttttctatcatttatgtaaggagaaagaaaaatctgtttatttgtgtggataggtataggatccttttgaaagatgcactagaaattgctaacattatttgcctctgagaagaggagctggatggctgggggcaggggctgacaggagactttaatttgaacaggcaataagtgatagagctgggagttttaatctacctctttgggattctaaagtatatggattttcttccctccccccactacgaataaaaaccatatgctaagtttttaaaattttgaaggcttattaacttttcattaattagatatactactcatacataccacaagcactgtttattatagttggggtttctttaaaatgtagtgctttgagatattttcaaactaattgaaatgaattgtcgcctatgattttattttttaaagctctaaactagtggtcatatgccaatgtagattatgcagtttgcctatgattgcattaatattttggaggagaatcttagggaaaacagcttttgtcccgtatggaaattttaagtaactttttttttttaaggtttccatgggtgaactatcaagatggcaacctcaacatttcaattccagtgtttagtattcatggcaatcatgacgatcccacaggggtaattattgttttcttagagtttgttggaattttggaaatgatcagtttagtttgtctgtggaaagcatgccttccctttttctcattgtgtagtcaaattgagtcaaaagtcaagttgacttttcacattcatacaagcttttatactgctttttagattttttaaaaatctgaaataagaattggtgtatgagctatgcttttatttcattaatactgatgttaacaataagaagccaggagtaggagtgaacacctaacatctgtatagtggtttacagtttgtcagtgtttttataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttgatgagatattaaccttgcctttggcatgtgattccagttgctgtaggtgatttgtagtacaaaaatgtagcaaatacttttactattgtaattttgttttgagaagacactatcctcatctatgtttttgtaagtagaatatggagtatgcttttaacaggtgatacgatattcatgcagatacctacttttacatacacactaacattctttgaaattattttgcataggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggtaagacagttttattttactgtttatgtccatgtgtgattctttaaacaattgagaaatttggagataagtttgtatctgtttggaaaaaatggggcaaaccttattctttattggtgactataaaaaatgatggatggttttggtaaaaatttttggtgaaaaaatgtcttttcgttactatttattattttgggttttttttagactcaggtgtagaatcctgaatgttagaattatagaataattagcaaaactgcactttgatatcttggaagtctttgaaaggtctaatgcttcactgtacaataccgctagcttataattttgtgcagctttcataatacctctggcaagtagaaaagcatcatggttatttatattttagagataaggaaaatgaaatctggatgttatatctgattctgcaagtgaaagagcaggaagtgaaatatacttttcttaaaaaagctattaacagttgttttaatcactgcagtgttattagggatcatatctccagaaaattgcctttcctcctccattcagactaaggacagattccattatgcctcagtcaccaccagaagcacatctctccagtcatccattttctcccaaactcttatcttatcctgttctattataccttccttaactggactctgtctccaccctgcacccctccctgtcccccagctcttcattataaactctagaactctttttataattatcagattcctcattattatcagtctcttctctgaatgttacctccactttctaaccttcagtgaagcccagctgtcccctgaggttcctgtgtcccatgcagttctcttacccctgggcttttggaaagaagcggggatcactgttctccttgctccacccactgcttccttttctgcctgcaaacacactgttccctttaagcttctgccatctggctaaaccgcattgctttttctctcagactttttacctacttacctaccttcaattttgccagtgtttttagtgtttcaacactcaagtagattaatcttctaatgccttgggctttgtgtgccttgacttttttgtctccagttacatgttctacattccacctcagccatgtattccattggccactcctgtagcattctccttgggagctaggccacttctaacttctagacttctacattgttggcttttcttctgagaccctctctaatccgtatataaagtagcagtgttgtccacccttttaattccatagtgttaattcgccatcttagcatcctggctttttctccttttataatatttaatatttgtaactattttgttgacttgtttttgttagtttctttcactagatcaaggtgaacctgtggagtatgagaattgtttgaaagtcattgagttatttaaaaagcacaatatattaaaacaatgtaagaatattgtttttaaatacacttttatcatcccttttaatatttatttctgcacatgttataatgtatatattagatcaaaagtatatataatttataacaaagggatggtgaaaaatagtattactagaagttttaataagaattttaccatagaaaactcacatttttattctacattttgctggttttgaacatgtatatgtctgaaatggaaaatgtttttcaaatgcaactaactactgttatcaagaacctggaacaggccaggcgtgctggcacacgcctgtaatttcagcactttgggaggccaaggcaggtagatcacttgaggtccggagttcaagaccagcctgtccaacgtggcaaaaccccatctctactaaaagtgcaaaaattagccagacgtggtggtgcatgctgtaatcccagcaactcaggaggctgaggcacaagaatcccttgaacccaggaggtgaaggttgcagtgagctgagatcacaccactgcactccagcctgggcaatggagcaagactgtgtttagaaaagaaaagaaaagaaaaaaaaccctgaaacagctaggcatggtggcttatgcttgtaatcccagcactttgggaggctgaggcgagaggattgcttgagcccaggagtttgagaccagcctggacaacatagcaagaccctgtctcagttaaaaaaaaaagataaaaaaagaacctgcaacatacccacttataaattattccagaattcaaatatatctcccaacagtaaagtgaaatactttgagaaggacataatttagaagcaaaatagattcattttttaagccgaagtaagaaaacaatttaaaaataatgtaatgtccatttcaggatccattccagatgaaaggctctatcgaatgtttgtcaataaaaaagtaacaatgttgagaccaaaggaagatgagaactcttggtttaacttatttgtgattcatcagaacaggtaaaacttttctctgaaaaagtttgagccaagtgctgaggcttcccaaatctgtttctgagcttacctattttagtgaaatgcccttaatctttcaaggttgtcaatgcaagatcagacaaaacatagatttgctttgtgtgatttcattttgaaattgtttttagtatatattaatacctacaagaatatttgtaacataaggataaggcatacacatgaatactcctcaattcaacaaaaaggtagaatctttttgttggattatccattcctttatcccattccttttccctgatcccacctgcttccccctatcccaaagggaagcattattaattttgaattaattatttcattgcttttctttgctgtttaatcacatgtatactcatattatgctatatttacagccaacttatgttcagcattacattactgagatccattttgatgcttggatgtgtaatttatttttactgatgtgtacagttatgctttgcctcctgtcagtgaacaggagttttttgcttttataaaccttgctgttatgaacattcttagacatgtttcctgctacatatatgcaagtgttcttccaggatatacaaatatagctagattacctttcttttgttagtagttttaagaaatttaatctgttggcagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgttattttttattgtttttttcctgaatatttcgatctttagttggttgaatccacgaatctgccaatacagagggccagctatatttattgaacacatttattgaatgcagactactctgtgcattcagtgaatgcagacttaggttaaatactcggtaaaagaaagggtttaagaggctgacttgtgttaccttatgtgtgagttcttgaataaactgtgagtttcaaaggaggggcaggccagagtttagatatgtgtgtggtcttcatataactttgcaccactgggatttgttccttctcttccatagagcttcccaggtctaccatttttttgtactatgccaaagtagggatgatgagttgaaaggaaaactcataagtaattctaagaatttaagccaaatgaaaggtagaatagcagcattggtaaggggaatgggtagtcaccatatgatgttgatttttctcattgcccccctcatcatttgattaagggaatgtgtaacagctttctctgctgtaaagttcccattttctacttttcaattaataaatatttttgggaaaatactttgagactatgcaaatatcctgtttcaccttaaacttttactcgctaattttagcatccatgggtgatcttatttccagtaattaatactgtggtattttaattgtaagttttgatttccttcattctttctatatttattaatggaattcttctgtaaggaaaatttgtcccttcttctctatttacttacttatttatgtcattatggacttgaagatccagtactatcagttttttggttgctactgttcctctgattgttgcagctttgaccattgcattctcttttatgttggcctctgtgtcctttcaatgtcttcccacctgttttgaggtcatgaccttagttagctttttggcacctcaagatggtctaggctcttggctcttgtaatggcaaaaatcacaattacttttgcaccaacctgatattttcctacctagccctggaatcaaccatttctccaaggtgctctgattctttttattggagagtggtattcagaaatccacaaatgcgtactaggtgtgcttactgctaccagggcttgctcagcactctgaatgaacagagttatgggaatagatatatgtgtatatagtaacccatgcatacatacatgtctatatatgtgcttaaaaaaccaatgataagttcagactgattctaatccagccctacaaggtccatttttgtcttctccctttccttacttgtgacttctttgtctaacagaagcctggatcatattataaatatatatgtttacttattttttcaatcttggtttaattatatttccaatcctggtataatttgaaattataaagtaatttcaaaattgctaactcatacccctgtgcaaaacaactttcccaactaggttacaatgtttgtgtaagttattttagtctttagcctttctgtatctagttgaaacctaatttttcaaacttacttagctcattttctccccacccccttcactgtggttatgtggttctttggtaatgctgttagattcatttgtcaccctgtgcattctcaagatacttctgctttcatatttaaaacaaagaaggttttcacagattgggtgagaatcttgagccttctgcattttgccttatttcccatttgtttctctacatcaactgtttttttctcttgtttcaaagaagaaagaatctgaatttggagatgacttggtcatgcaaaatctttcaacaaggatattgtgatcacttctaggtcacaaattacagtcagcctaccagcatcatcctcccttcttcttccgggaaagaaccagcactcaatgaaggcacaatggcatcatgttgtatttgggaattattctgcttttctttagtagttgtgataatctcataccttagatgtatgttttttacataaaaacattcctggatacacaagcctgtatattctgtcttccctgcatttattctgcttagcccttctgttctccttgctgttccttgaattcactgaacacattcccactttagcaccatctgctcttctactgcttaggactttctctctccgcgtactgatgcttcatctcagttctctgctcatttgatgctagtcagagaggtcttcctgactaccctgtgtatgtagagaggagtatggcacttctatgtcacttttccctttatttttctttacagcacctatcactaactgacaagttatacatgtgcatacttacacacatgcatatacatcttgtattagagattgagtatcccttatctgaaatgcttgggaccagaagtgtttaagattttggattttttggattttggaatatttgcacatatgttggggatggaacccaagtctaaacatgaaatttgtttacattttatatataccttatacacatggccttaagttaattttatacatgttttaaaataattttgtgcatgaaacaaagtttgtgttaagtatttatgtgtggaatttaccacttgtggtgccatgttggcacttaaaatattttggattttggattttcagattagggactcaacctgcattgcttgtttcccacactagaacaaggactttgttcactgctgtgtcttccatatctagaagaagcctgggacatctgacataaagtagacagtgtttgggtaacagtatttgttgggtgaatggaagaatattggtttggattaaatgaatgcttggttaaactatgtgaacacttttacttgaatctccaatgatgtaagttaatattagggaaaactattccttcttgtcttctatcaccttgcatttcatgtatctttaaataataactgatataggtataataccatagtttgcatatcacttgtttatttaatatttgatattgaaaactcttagcacttatgtgagattgatgtttttactcccattatatttattagtaaaaagataatgttaagaaattactggacatatttatacttacttgcattttctgtgtgttttctctagtatatagttagactgatttatagatttctactattgatagaattcatgcttttctgattgaccaaaggggaaatccttcctatgtaaaacctttcatgatcttcctccaaatatagaattgactgctttctcttttcgggtttccacttgtctgtgtccaataagtttgtaaagctctcaaggtcaggagttagcattgatgatctttacattcccaatcctgtgcacactttctggtacatagaaggatgcaataaaatctttagtgaatggagaaagaaagatctgtatagacttcaataatatgaaatttttctaatcaccgaatttatatttttcaaaatcttgatacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaagtgagtgttatatattttgagccaatttttaagaaatctttgctataataactaatcatctcataggtttaaggcctatgttaaggttaccgctaactggcagtattgtcatttatatgatagctttatttttgaaaattgatcattctgtgtagtcttattgtttttccagattttaagccattttcaaaaagagagcatccaattggtgttattttgctgctcattaggcaaattcaagatgcacatttttattatatttcaaggtagatgttttaggttgatgattactaatttcacaaagttcattataaaaaattatcctaaaaccatttaattgaaaattttctgattataagtgcagtataatagatctcatttttaaaacatttttgggggaatgatatgattgtaagaagtagttaacagtgattaaactcaatttttattatgggttttatcttttgaatcacttgagttctgattgttacaatgataatagggttaaagaatatggtagtagaatctatgttggttggttttttttcttcatgagtccactgcaaaatcattttgtctatatgtgtacatgtatgtacatatacataggtatatagatgtaatactatagtctacatatgctaccatcatagtcctgttaacatttttttatgcttattatgtctatcttacaagactgatcagacagggataataatggatgagttgattttactctggggaaggaaaatgtctaccatcttttcctgtgatgataacattaaggttaaattagcagaaacatttatttttaagagtatgattttataaagaagcatttttagaaactaagaaatatgaaagctttcgtatgcacatcaccctgaggaaatttacactgtgactcggtgttcatttctctccacttcagacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaaggtaattctttttgataaagtcaatgagatctactttagttgaagaattattcaccttcaattaagtaatttaatagagtagagggaagcctttatgttgattacattctcatgaagcctgtaaggacactgttcttcagtgaatgtgtttaattgtgtccaagatttttttttttaagtcattgagagagaggaatactggatgttaaaaaaaattaaatctctctcctagtttctttcttccttttcaaaaacataatacataatcttttctcctttttaatcctgatttgatgatttgttcattttatttatgaaagcaggcagtaactttgattgaggaatgggagactatcgtgtgtgagaaaagccttagcttctaataatctgtattaggcgtccctttcaccctgaaagctaccccaaatgaaatgtgaaaaatgtgtttgctatccaccctattgctgcaatgtaagtcccaaacctccctctctatgcacattgccacccctaaatctctagaaaatttcagccactactaaggttgggtggattaatgcatttaataatatgtggtttgacagcttaattagcatcacttgctgacgctcagttcttaactctgtgtcagctgtcctactatgttttcttttcatgaaaaatcaggtaacatagtaacaatgataataattatgaccagtgatacttactgatttactgtatgtgatgtgcactgttgacagcatttaatctagccaacaatactatatgtgagtagtttctaccatctatagtttagaggaactgaaccttagataaggtgactcattcagtgtcacagctttttgagcagtgtgtagctcacgtaaccaaaagtgtacgcttgtttcaagatgattgactctagaaactcaaacatagattaagattctggcatccctaaatccaatctctcaagccaaagagatagaaaatgcattaattgcttttgcattgattgatccaggcctgagtcatgtgcccttccctggagtcagacctgggtttttcaactttggcttagttgacattttgtactaataattctttgttgtgggaggcagttctgtgcactctgggatgtttagcagtattctccctggtttgtacccactagatgccagtagtaccccttctaactggtcgtgatgatcaaaaatgtttacagaccttgccaaatgtccttagagaagcaaagtcacctctggttgaggtctactgtatgaacttcacctaaatcctgtgggctttggtgacatgaatccagagaggaaagtagacgctggtgacacaaagtaatagaggttcattttaaacaccaggtgtgcacataactttctgttatctctgtattttatgtacatttctgttattgtacttagttaagttatattattttttataagcatgtgagtgtcttctgaactctttgaggacaggacccatatcttacttttctgtctcagcacttgacctagtacctggcaaaatgatgctctataaatgcttgttggattgaaataattgacctaggagatcatattcttatagattttctctgtgctgtctgatatgtattcactagcacatgtggctgtttacatttaattatttacatttaaatttaaaattcagtttctcacttgtactagccacatttcaagtactctatatccacatatggttttggcaaccatattgaatatgcacatagaaaaaattattgcagaaaactcttttggacttcattgttacagacagtttaaaggacaagattataaagtcttagatgtgaaagaaatctgaggacaaaaacacttgttctgtattgttcttgagatcaggaccaagttataggaaggcagtttttgttccaatacaagaactttctaagaactagaattgttcagctatgaagttggccatctggagatatctaatcactgtgcacacagccatttatgaaaataatctagtgctgtctccttgtaacttggttttacccttaagaacaatatagaacaagtgcttttgtcttcagaactctttcaagtctaagatgttataatcttatcctctcagagtatgagacaactccacatatttgaaaacatcagtcttattttcttttaccttgaactcttccaagataaataatctaaagtccttgcttattgatccctaaatcttctggtgagtctcccatggatcatatgactgcaaaaactagacttacttggttttaagttggtaagctgaggaaagccttattgaaacatgagtagtaatattttaagttttattctaaaagaattattttagagattgaaaaattatgaagaactttcatgaaaggaaaacattaaggaatagtattaaaggagcattacaagaaggtatatttgaaaaggtgtcataaatgacctaggaaataaagatgattatgtagttcaggaaaattcctgtggtaataagctgctattcagccaagttaaactcagtttactacgttgttttttaatctttttaaaaattttgagattgaagaaatgcttgaaaatgctgaacgggaacgtctgggtaattctcaccagccagagaagcctcttgtacgactgcgagtaagtcctatttatatagattgaatattattaattttcaaagcatagtaatgtacagtttacatggtttctttgaaaagtagtgaggagagtgctcatagtaataagaagagcaatcaccatcggaggcaaaaacaaagatataaggatttgagttaatcacagtttaagtgataggtttggtaacttatttttctcattttctaaataatttgttgttatatttaatagattggctgagctctctggcttcatctttaactacctcctctactcacttcattccaggcatcttggccttctcgcagtttcttgggcatgtgggatgtgctcttatctccctttagtctgctcccgtgtcacctcactgcagccctatcatcaagattgcagcccctaccttctctccagtgccctgatttcacttaccttcttctgcttcctcttttcttcttatttttttccccgtaacacatccttctaatctatgtacggtttatttgttttggttattattaggattgtttcctgtgcctataaatctgcttatcctttctatcgtgttataaacaaagaaacaacaacagacttcttctttaccactatgcttttcccttttccaaactcctaccccatgttgcttactctctttaaaagcccctaaaagtatataacctatatctctcttaactttctcttcttcagttcactataaccaaggctctgacttcaccataaccagtggaaaagatgacctttaattgttcaatccaatagatcgtgtctcatcttgctgaattactcttgggcattctctgagttatttgtatccgtcccgtctcatagttagccctcttttcagtgtaggcatacagctttaatgaccaccaatagagtgatgacttcaaaatctttacgtagacctccttcttgttctgtatctccaggagtcccctgaggcctggtactgaggagtgtagtctttaaaccagcagtgttgttgttgcctgggaaattgttaaaaatgcagagcctcagaccctgcatcagaacccactgtattttaacaaaaatctccaagaaatgtatatgttcatgaaaatttgagaagtactgggatgtagactgtggaggtaaagagtacagtgtagagccagacttcctgagcttcattctggcccaaccactagttgtatgaccttgagcaaccgcatcccttatcccttggtttgtattaggttggtgcaaaagtatttgcgggttttgtcgtagaaagtaatggcaaaaactgcagttacttgtgcaccaaccaaatgcttcgtagatttatgagatctaaatggattaaatagtgtctgttgcacagtaggtaatctgttcccgtttctttatcccactgtcgctggcatagtgaagcccttattaatacttcctggcctattgctgcagcctcctaccaggactctgcctccagtttccttctctctccacactaatgccaaaatgatctttgtaaaacacagttttgcatgtcttttctgctaaaaataacttaattattccccagcactaacaggaaaaagtctaaacttttttaggttagcattcaggggtctacatgatgtggtctaaaccaaaaaagctgccgtcccctgggtgcagtggagtttatttcactggaacctttgtccatgttgatcctgttgtgtgggacatacttctctcctcctttctctataccttcttcagcacccacctaaagcctctgtcttcaaagaagcctttcttgacctgcccacagagaacatgcttcttcctttgtgtcctcatccaactttgtacatacctcttatagcaccactcacagtctgcttccagtgatctgtttacatgtttttcttcccagtcagtttgtgaatttcttgacagccaagattgtatttatttatggttgtatccctggccctgaacagcatacttagaacattgaggacatccaataaaatttgttatgaccaaacatttataaatgagaagtttgaaggagagacctaatagctttagcatttagtattttgtcttttataacatggtagctgtagagatgatctgggtaaggctgggcatggtggctcacgcctgtaatcccagcactttgggaggccgaagtggctgaatcatctgacgtcaggagttcgagaccagcctgggcaacatggcaaaaccctgtctctactaaaaataaaaaaattagccaggtatggtggtgcatgcctgtaatcccaactacttgggaggctgaagcgtgagaatcgcttgaacccgggaggcagaggttgcagtgagctgagattgtgcctctgcattccagcctgggtgacagtgagacgccatctcaaaaaaaaaaaaaaaaaaaaagagagagagagagatggtctgggtaatacaaaaataattactttaagggaatcacatagttctcttcattatggcaaaagatcccaattttctcatctgtgtctgcctcacagcattaaaactaaccagactttaatagaaaattggcatttcttttcctaagcacagtaaattacgaattcattcataaaacagcacatattgtcatataagtaatattacaaaactacattgtactgactaaaagacattcattaattcattgactaaatcttactgagtacctgctattatggatgctgcaggatatagggatgataaaacagatgaggttttgaattcgtcgagcttacaggaggtggaggtgcaaagagagacatgatacacaaatatcaaataaatgaacaaaaaaccttagcagatagtgatgatgagtgaaagtgggagcactttagttagggagcattctggataagctgtgaggtggtgcagtgctggtccccatagcgtactttgggaacagctagttgagaagaacatatctctgagaaagaaaggtggtatttgtctttgtaaaggtctgtttaccactacagacttctgtagaaagagtctaccttgagagaagttctcagtttcagtgagataccatgttttggaggtaatcatttctcaaggctcacagatttgattctttattacctggatgttcctagcattcatctttctcttgaggcacatctctaagatgatagaccaatttactaatgcatttaaggctagtattttattttggtgtgtgtttgtttgtttgtttgttttgaaagttcagaaaattgttttcagatggtttgcttggtaggtacctagactattagtgttatcagggggagatgtaatcattctgcattgtggaaattattgcaataccttgattccatcgaacaaagtattttgcttatgcttataaacttttcaaacattagtttctcagtaggataaatgatatagctccatcatgatctactgtagaaaattaattcataaatttcaaagtatcaagcataaacactgtgaatactgaaggattagtgtgtgttttaaaaattggcaaattgttgtttcctagcgttcatagattattctgtgttttcaggtggactatagtggaggttttgaacctttcagtgttcttcgctttagccagaaatttgtggatcgggtagctaatccaaaagacattatccattttttcaggcatagagaacaaaaggaaaaaacaggtaagctagttatttttatgaggtaaaaaaatgttcttataggatttgtgaaggaatctttattaaaaactgtaacataataatggaagatgttttaatatgattgtaatgtcttaaacaaattgacagtgggaataattctcttgtcttctaaaaattagatagcaatcttttttattattattataccttaagttctagggtacatgtgcacaacgtgcaggtttgttgcatatgtatacatgtgccatgttggtgtgctgcacccattaactcgtcatttacattaggtattgctcttaatgctatccctcccccctcccccaaccccatgacaggccccggtgtgtgatgttccctgccctgtgtccaagtgttctcattgttcaattcccacctatgagtgagaatatgcggggttcggttttctgtccttgcggtagtttgctcagaatgatggtttccaccttcatccatgtccctacaaaggacatgaactcatcattttttatggctgcatagtattccatagtgtatatgtgccacattttcttaatccagtctatcattgatggaaatttgggttggttccaagtctttgctattgtgaatagtgccacaataaacacatgtgtgcatgtgtctttatagcagcatgatttataatcctttgggtatatacccagtaatgggatggctgggtcaaatggtatttctagttctaggtccttgaggaatcaccacactgtcttccacaatggttgaactagtgtacagtcccaccaacagtgtaaaagtgctcctatttctccacatcctctccagcacctgttgtttcctgactttttaatgatcgccattctaactggtatgagatggtatttcattgtggttttgaattgtatttctctgacgggcagtgatgatgagcattttttcatgtgtctgttggctgcataaatgtcttcttttgagaagtgtctgttcatatccttcacccactttttgaaggggttgtttgattttttcttataaatttgtttaagttctttatagattctggatattagccctttgtcagaagggtagattgcaaaaatgttctcccattctgtaggttgcctgtccactctgatggtagtttcttttgctttgcagaagctctttagtttacttagatcccatttgtcaattttggcttttgttgtcattgcttttggtgttttagtcatgaagtccttgctcatgcctctgtcctgaatggtattgcctaggttttcttctagggtttttgtggttttaggtgtaacatttaagtctttaatccatcttgaattaatttttgtgtgaggtgtaaggaagggatccagtttcagctttctacatatggctagccagttttcccagcaccatttactaaatagggaatcctttccccattgcttgtttttgtcaggtttgtcaaagatcagatggttgtagatgtgcattgttatttctgaggcctctgttctgttccgttggtctatatctcttattttggaaccagcaccatgctgttttggttactgtagccttgttgtgcagtttgaagtcaggtagggtgatgcctcgagctttgatctttttgcttaggattgtcttggcaatgtgggctctgttttggttccatatgaactttaaagtagttttttccaattctgtgaagaaagtcattggtagcttgatggggatggcattgaatctataaattaccttgggcagtatggccattttcacgatattgattcttcctatccatgagcatggaacgttctgccatttgtttgtgtcctcttttatttcgttgagcagtggtttgtagttctccttgaagaggaccttcatatccttgtaaattggattcctaggtattttattctctttgaagcaattgtgaatgggagttcactcatgatttggctctctgtttgtctgttattggtgtaggaatgctgtgatttttgcacattgattttgtttttattttcatttttttgagacagagtcatgatctgttacccaggctggagtgcagtggcgtgatctcagctcactgtaagctccgcctcccaggttcacgccattctcctgcctcagcctcccgagtcgctgggactacaggcacctgtcaccacgcccctgctaatttttgtatttttagtagagacggggtttcaccgtattatccaggttggtctcgatctcctgaccttgtgatccgcccgcctcggcctctcaaagtgctgggattacaggcgtgagccaccgcacctggtctgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctcctgcctgattgccctggccggaacttccaacactgtgttgaataggagtgatgagagagggcatccctgtcttgtgccagttttcaaagggaatgcttccagtttttgtccattcagtatgatattggttgtgggtttgtcataaatagctcttattattttgagatatgttccatcaataccgaactaccttgacgtcacaaggcaccagcagtacccatgattgcttttgcatcgtcagtgtagcaatgatggcagatggcaaaatggcaaataacatcttaggattattatgaaagtatttttgacgttattactccctgaatgggtcttgaggacctccagaagtctgtgcttcacccagtgagaacagctacaagacacctatcctggaggtatgaacgagaaatactgactgtggggaaaagaccgtggctattaacaaaaatggcttgttttgcctcaaaatttaccatgttgagcaagctggcagttgctaaagtttggccttaccttctccactgacaacttgcaatgagtatgcacattttaacattatgatagaagctattttttgatatacttctttttttctaggagaagagatcaactttgggaaacttatcacaaagccttcagaaggaacaactttaagggtagaagatcttgtaaaacagtactttcaaaccgcagagaaggtaatttcttacagttcacattttgaataatggctaccttatagtaacagattttaatttaggatatgtttagttgatagtttaaacaaaatgaatcctcaaaatgtttctatgaagtaagtagggtgacaattaattacattcatttgcagttgctgcacagcagggaaaattagtgtttaattaatgttagttattagtactgttattaatatagctgttattgttgatgttgttattctctttctttgtatctctgttgcaattattaaactgaataattttaacttaaatcagggacattcttaagtgaaacttagaagtaactagggtgacatttacattcatttgtagttgctgcacatcaaagaaaattagtgtttaattaatgttaattgtgaataccattattaacataactgttattgttgttgttattttcttactttatttgtatctctgttacaaagatctcaatccagatttagttttctcacatttggatgtaatttcagaattattctacaaacaaagacagccaaatgatggtgaagccactgaaacttacgtcataagtatatgccactctaagatcctccggttgtattagtttcctatgggtgctgaaacaaatttccacaaacttagtggtttaaaacaacacaaatttattatcttacagtcgtgtaggtcagaaatcgtacacaggactggaatcaaggttttggcatggctgtcttcctttttggaggctctaagggagaatccattttcttaccttttccagcttctagaggtgcctactatgttccttggctcttgctctccttttatcttcaaatcctgcaatgttgtatctctctaaccatttccccagagttatttttccttccagctcccatctgcctccctcttgtgcttttcaggacccttatgattacactgggcccacctggatagtctctgatactctccctattttacagacagctgattagcaacctttgttcctctttgccatgtattcacaggtcccagagtttaagacgtggacatctttagggggctcttattttgcctatgacactggttaatttcatctctattaatcatagctgccatttttggactccatatcctagccatcaggcctctacatttcacgtgtcctgtactcctcccccatttctggttttgactttgctttttctggttcctgatattagtaggcttaactacagctgttcactatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatacatcttttgtttgtcaaattggcagcaatttgagaaaaatagtatctagcacactgctggtagtagtattacgtttgaatagctttactgaaaagcagtttggcagagtatattaagaggcttaagatttaccctttaactcagcctgggaaatttccctatgaaaatagtgaggtagagatttgtgtatggagtgattcatcttagtgttgttcatagtggggaataattggaaatgttttgatacaataaatgttggtacatataccatataaaattttacacagcttaaaaatgacattttggaagaagaacatgagaagatatttctaatctaatgttaattgggaaaagaatttcaaagataaaaaactgcgtagtataatctcaattatttttattttatatgtaattgtgtatgtttatgtaaataaagaaaatatcccagatatattatcaacagttatgtcaaggtagttatattacaggggatcactttctctatttcccagattctccctaagcagaagaacaaaacaatgttatttaaaaaaaaaaaaaaaactcattcccttattttagtgcttttggttaacatggttctcttaaagccttatggtgtcaatgtgtaactaatattatttaataccaagtacttccagaggtaggacaggcagttcaccctctaaaaccattcactctatgactctggatgtgttgggtttgctaatttatagcataaatagatttctcaggtacataccagaaataaaacataaccatccccacctggagtgacatcatgactcctgagcagcaaagtctgtgtggggtgtgtgtgtgtgtgtgtgtgtgtgtgagagagagagagagggagagagagaaagagaaagagtgtgtgtgagtcatggtggctctgaccagacacccgtgttcaaaatcaaaacccttattagctgtgtacccatcattgagttatctaaacccacctatccctcagtatcctcatctgaggataaaatggtgatgataataggccctccttcaaggttgttgtaaggattagaagaattaatccatgtaaaatccttagaatactgtctgacacatagtgcctgttcagtgttcccactctgactctcatttctcttctgtgaatggcttagcacctttggtatgctacttatcacctagggcacgattacatactgtctcatcttttaaaatattgttattcttgtatttttcctctactgaatcataacaaacatgctgttatttctttcagcttaagaaacaaacaaaactctcgatcccattttcctttagctactgctctctgttcctcttctagagcagaatcgcttcaaagagttttctgtatttgctgactcattcttctctctccattttctattaaatctatccactcaggctcctgatcccatcattctagtgaagctgcacttgtcaagatcaccagtgactgccattgctaaatccactgtcagttttctatcttacatctcacttgaccttctttgaaacatgttttttattggatttcaggataccagactcttgttatcttcctgcctcactggctgcatattttcagtgtcttttgttgattcctctaattgctccagcctcttacattggagtcttatttgctgttccctctcccatatcatcaattgattatagattccatgagagcagctttttgtctgttttgttaataactgtattctcagtttctacgataatatatggcacattgaaggtgctcagtaaatatgtgctgagtagattattaaataaatgggcttaaagaacatatacatagctgtataataagagccttgtgagcaggaaccattaaaaaagaaacctgtagtctccttcttgataccaggaccatgctcagcaaaccttcatgagttgactcttaataaaaatggatcttcaggggccacccacttcagatcccatttcacagagcctcctggatgtcttgcagcaaggtgcacaagagtgatttgcaatgtaataaatatttcaagccttgtcaaggagatatttttgtttttaactagtttactgaagtgtaatacccatagggtattagaatttttcctgtacagtctgaaagactttttcagtgatgtgaaacattttggcagcaggtaatataattttgcttcgggtcaatatgagtttttttttttaagagtacattgtgcaattttaacgttaataattggaaaaatatgatttacttttgtgagacattgttaaatttgcaagttttataacataaagcatttcttaattgtagccccttgttttatatttacataactggaataggcaacatgtttgtgatttactctgttatgatctaggtacgtcgtttcagagaaaccagacaaaaaaatactaatgaagaagatgatgaagtccgtgaggtaattattctgctgcaaattcttgtgtttatatatcactttcttaaactagaataaccagtaggtttagttagaatagtcagtccataggtctaggggataggagtgagctggggttggcttaggatggctgcttttggttgatttcagttcagcctacaaatattctgctcattgctctttttttccattttgttcttgtctaaaacctgtttagcaagtgcagtgactcacacctgtagtcttggctacttgagaggctaaggttggaggggattgcgtgagcccaggagttcaaggctgcagtgaactatggctgcaccaccacactctagcctgggcaacagagtgagaccctgtctctaaaataaataaataaaaataaataaaacccatttaattgtatgtgtgtggggatatatacaacaaaagcccctattactcaaaataatatctctttgttagcagagcatcttatagataaaatcttatcttactgagctgatattattttgggcaaaaaagaaacttaaagtgttttggttagcaatgttaaccataagtaagcaagcatgggcaaatagacaatttctattatctattctaaaatattaaaattagcttaagcaccatcatcactgtcttctcagtctcattgcaggtttgaatctacaagttagcaaccatttacttaaatttggggcctctacctggtacttgttgaatttatgattgaaatgtattttcttattttctgattgcccttagtgttttatgattgctatctagtatttaaaagttataaactatgtactgttagttttgtcttgattgctttcattcagcaaacattttatattgtccctgttatgggttagatattctgctttatattaggactgtacatataaaaaagctgaggtctgtagccacaagattttctcaatttagtagataagagacatttgtgtaaggaagatatttattgaattatttttcctaggtgcccattttataaatgaggagacagaccagactcaaggtcatggagtggcgctagaatttgaacatatttctgactccaagtgtagacttttctatcatcctgtgtcctatcaaaattttagattattataatattaattcggtgcattgcaaatggatggttttctaaaaatgaaaaacttctaaaagtgtcatgcaacacatcagaatcactgttgaaatacacatagttgcaaccactgtatcttttacaggttgttttttggaagctaaggaaaagaagctatagattagaaatggcttaacacgtttattatatttctatttatcttataaggtgcatttaaaatagaaatagtttgccaaattgcaagaataatgctaggaagaaatgattcctgattcttaaatatctagcttaaaattgattaaccctttcaatttaacagggtacagaaatatttctttacgtttgagtgagttcttcatgtttgaagcgacaaacctcaatttttcattaagcttttaaaagagttaagagtgaacgtcttatacaaggaaggtgggagaggctgtgacaaatttcatatgggagttttacagaagaaataacttacaagttcagatattcagctatattttaagactaaaatgtaattggggcttcctaggtaatttttcagcatatcataagatattatatattttttcattttcagcatactatttagaacttaggtaatggagtctgaaactctgccaagctgtaattcacagctttgcagaatcatttggcttagaatatgaatcccagcgccatgcttaaattacttatactgacaaacaagactattagctcttctatttggagaaaaaacagtatgctttaaagtctttcaggctgggcattgtgacttacctgtaatttcagcactttgggaggccgaggcaggtggatctcttgagctcaggagtttgagaccagcctgggcaacatggcaaaaccccatctctacaaaaaatacaaaaattagccaggcatggtagctcccacctgtagtcccagctactcaggagacttaactgggaggatcgcttgagcccaggaggcagaggttgcaatgagccgagatgacgccactgcactccaacctggatgacagagcaagaccctgtctcaaaaaaaaaaaaaaaaaatcttttgttcacatagaaaaactctcaaatcttttctttaatgataaattcatatttgaataaaagagcaaacagtaaccattaggctttgcgggacatgtgtggtctctatcacatattcttgtgtttttttgtttgtttgtttttttattaatggccctttaaaaatataaaaactattcttagtcttacccacagtcgttagtttacctggcctctgatttcttatgttctacctcaatttgaggtgggttgataccctctttcaaaatataataccaggcactatcaatagtgaagaagtgacccacagaatgagagaaaatatttgcaaatcatacatctgataagggattaataagcagaatatatttttaaaacttctaaagctcaacagtaacaataacaaaaaaacccaatttttacaatgggcaaaggacttgaatagacatttctccaaagaagctttacaaattatagcacatgaaaagacactcaagatcaccagacattagagaaatgcaaatcaaaaccacagtgagataccacttcacacccattaggatggctgttattaaaacaccataaaataacaagtttcggcaagaatgtggagaaattagaaccatatacattggtggtggggatgaaaaatgggtcagctactgaggaaaacgatagcagttcctaaagtagttaaacatagaattatcatgtaatatagcaatttcacttctaggtacataaccaaaagaattgaaagcaggaacttatttgtacatcagtgttcgtagcagcatgattcacaatagccgaaaagtggaaacaacccagttggtcatcaacagatagatggataaacaaaatgtggtatgtgcatgtaatggaatattattcagtcttgaaaaggaatgacattctgatacatgctacaatatggatgaaactctgaaaacattatgagtgaaaaaaaaacagttgcaaaaggacaaatattatatgactctacttatatgaggtacctagagtaatcagattcatagaaacagaaggtagaatagtggttactggggagagggaggaatgtgaagttactgttgaataggtatggagtttcagtttgggatgatgagaaagttctatagatggatggggggatgattgcataaccatgtgaatgtacataatgtcactctactatacctaaaagtggtaaaaagagtaagtttatgttatgtatatttcaccacaaaaaaaaagtgtttaacagtaggatagtatgttttcaaatctcacaaaatgtatatggaaacatttttgccattggctctagacctgcactcatgagttaagctcttagaagtaatacattccaaagataacagtaaactctgtttttcataggaaaggtagagttaaaatacaatttgaatatacaatttgagatgataaaaatgaagatacagtatttagacaaagggaaaatacaaagtttagaaatgatggttagtaattgattccaagaagtaatcataatagggcatatttattttaaattttgctacatactgccacattagtccaaagatgtcttaactagtttatattctcaccattagtatttgggagtgcttgtttcctcacatctttaccatcgtgatgtattactgtatcttttgatctttacaagtctaaggggtaagaaattatttcctactgttgttttcagttcatactacttttttttactaatgagtctgcctaatttttatgtttataaatcatttgtatttatatgaaacacatggtcattttgtttggccacattttctctttcgagtagggtattggtctttctcttttttttttttttttttgaggcaaagtctcactctgtcacccaggctggagtgcagtggtgtgatctcagctcactgcaacctctgcctcctgggttcaggtgattctcgtgcttcagcctcccgagtagctagcgcgcgctaccatgcccagctaatttttgtatttttagtagagacagggtttcaccatggtggtcaggctggtctcaaactccttaccttaggtgatccacccgcctcggcctcccaaagtgctgggatgacaggcatgagcaaccgcgcctggccgggtattggtctttctctaattgatttgtaagagcactcacttgaacacatttgtgtgtgtgtgccctctctttctctctctggatatatacacatagtaatatagcatatttagggttttttgacacataaagtatccacttattcatcagcttatttgtttaaatcaggaatgattggtgattacatggttctgattttatgaagatatacatttgggttttttctttctttgttccattaatatagtgagttatattattatgtacatagcttattgacccatcctggtaatatatccattaccccctggtaatggatatattggtctttccataagcttctggagtctctatttgctttcataattataaataagattctgtaattttctttttgtgcacgcagttctttgtcagtactgtgtcatactggcattgtgaaaacagtttggaagctgtctttctgtatgctctggcactattgaaatagcagtgggcttatctgttttttgaaagtttggtagaatttacctacgaaactttctgattgtggtccttttttgggagtatttttcttttaataattttctcaaaattttctttgataattggtttgttgaacctgtttttttcccaccttggatcagattaagttattcattttccagattatttagaattgagcattctctcataagtcttgggtcttccctcccattcttccttctttctttttttcgagacagggtcttgctctgtagtgtgctaccactcccagctaatttttaatttttttttttatatagacggagtctcgttatgttgcccaggctggtctctaactccagggctcaagtgatcttcctgacttggcctcccaaagtatggggattagagatgtgagcttctacacctgtagtgctagtattagagatgtgagcctctacgcccgtccctcttatttctaatgatgtatatttgtgttttcttcctttctttaaagctttgtgatttttattaatgttattgttttgtcccaaaggaccagtgcttatatttattcattctaatgtgtttttgtttaaaatctattaatatatggtttcatcttcattctaatacttggataggctttattttgtttctcctagctttttggatacagaattaacttatttacatttattcttagcaggctataggctttcttataagcattgctttagctctctcatatgttgtgatgttcagtattcttgttatgattttctagatgttctgcaactttcgttttgttttatagttttgactctggtttgttttcaggaggcaggtttttgctttattattaattttttattttattgcatgatgattagacagtgtgataaatttatttctcctatcaaaaatgtattgagatttttgtttgcaccctgttatgtatcagctaaaaagtttcatggggtcttgaagtatattattaattttcagtgtatagaattcaacatttatcaattagatctatcttattaattatgtgatttagatcatcttttttctcttaagtctgctttctaaaagcatacagctggttccttttatttgtggtagttatgtcgtataaaatcacttccagcacagaattagcaaatggtgaatcattgctcctaggggaaatacaaaattagctttctatgagccactgataacgtttttgtcagctgatcaatacgtaatctttttaatgtgtttctgtttaaagatactgtatttaacatttgattcattagcattgaactcatagccagtagcactttaacttatacttgaattaagtttatctaatatacattttttctccaaaagtcatattgcagcctttttgcatgtaggaatgaacactaaacatgttgagggggtcatttgaaaacaccacattaccaaagcaaaagtacaaaaatgcagaaaatgcaataaatatgtagtcatgtgccacatacaacattttgatcgatgtcagactgcatatccagtggtggtcccatgagattataataccatatttttactatatcttttctattaagatatgcttagatacccaaatacatagctatggtgttataattgcctgcagtattcagtacagtaacatgttgtacaggtttgtagccaaggagcaataggctatctcctatagtctgggtttgtagtagactgtaccatttagctttgtgtaagtacacactatgatgtttgcacaataatgaaatcacctgatgacacatttctcatgaggcatccatcattaagcaatgcatgactatcacagaaaggacactttaaagtacacaagtggaaacaagaaggcagagtggctcattgttcagcctcagctgggaatatgtgtgtcaggcaattcaaaatatttaccactctgcgtctccataaatgatgccaaaagtatcgtgagtgttgatttttagggttacagagaaattttggcaagtcggtgaatttgcaaatataggattaatgaataatgaggattaactgtatttcatgtgggacaggaaagatgaattgaaatcactgttgtttcttatattttttgttgtatttcctgaagtgttttctttttgcattgtaatgctgtattgaaccctgcatgcagtgagttagctgtgatttcacctcagctgagatcatctcatcatgaagttgccacttcagtcccactttatgctgcctgccttgttcacatctcctcatttagccctgggtctccttactttatggtatcacagagcttagaaatgttctggtcagctattcttagacccagaactgccattccaagcaagagagactgttatcatgtcttcttgggatttatacatcagttttggagagctgtataatacctgaaactcttctcacctttctcccttagctaggtcaaatatttatcatattcattaactcttctttatagtttgtgtgtttgggggtttggaactattttttaattttatggaaaatgtattttgtttttgttctcttactaccttttgattggtttaagggaagatcaaggcaaaattgcttttatttatattttattttattttttggtgacagggtctcgctctgttgccaggctggagtgcagtggcacgatgtcttttctaaatggattcttaccaaattaaaaatgcgtggcatgttcttggtcctaaggtgtttattccttcttaggcttaggctttcagttgatatattctccttaattcttccgtttcttttcattttttttttaggcaaggtctcactgtgtcacctaggctgaagtgcagtggtgcaatctcagctcactgcaacaactcccctccccactgcttcccccaggcttgagcgatcctcctacctcagcctctcaagtagctgggactacaggtgcatgccatcacacctggctaattttgttcttttgtgttttttttttgtatttttggtggaggcagggtctcgccatgttgcccaggctggtccctaactcctgatctcaagcagtccatccacctaggcctcccaaagtgctgggattacaggtgtgagccactgcgcccagcccttaattctctttaccatatatttgtgagagattgttactcatgtttttttctgattataaaactaattttttagaaaaagtgtaatatagaaaatatgtaatattcaagaacaaaaaacaaaagcaccctaaaatattagtgcccagagataacggctattttttgtaagtttttttcttattatttcctaggagccgattctaaaaagtagctcaaatgatgacagtctgttactgtcaaatgtggcattgaattagggatgattgccagtattccttctagttctgaaaattttgattctgtaaaattttatttttcttggtaaaccttttcaaagggtctcattttataggtagtatggtagattggtctgacagataataagtattaaatttgattggtggggaggttctcctttacacatatataaatattttttgtttttatttttatttttgagacagggtctctctttgtcacccaggctggagtgcagtggtgtgatcatagctcactgcagcctgtatctcctaggctcaagtgatcctcctgcctcagcctcctgtgtagctcgggactacaggtgcatgccaccatgcctaattttttttttttttttttttttttgtagagacggggtttcgctgtgttgcccaggcttgtctcaaactcttgggtgcaagtgatcctcccgcctcggcctcccaaagtgctgagattacaggcgtgagccactgtgtcagcctcctttatgtttttatagtatgattagttcatgtcaatgcctaaattaatgatttttaggatggtacgttatctcattgtgtgtactttctccttcttctccctcttaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagaggtgagcactgagttcagtcctgtgcacattcacacttggcagttgagtggaaaatacagaattagatcttgtcagagttgaattataagttttatttctaaaacacggttctttaaaaatctatttttataatatataaagacagtctttaaggcagttctgacatgtgccttttacttaaataaattttgaatggccacatgcacttagggttttaattgttcttagcacataccttataaaagcttcactgtgtttgtcacgtagtaccttttggatacatttaatgtcatatgtattttcacatgtgcaaagtaataggcaaatatgagttgttaaagaaaatagctaaaagcctttggcaacaggaggaaaactccagatcatacaattattatttttgttactgtcataagatacaaatacacatatgcttatcaagtagtctttataaagtcagtttaagaaagaaaactgccccccaatttgattcctaaaactagtcattaacatagtcaacattgtatttactgtgagactattgtcattgaatagttcacgccaatagaaattggtcattcagtgactttctcacacattatgtcagttcatctctaaagattttttaaaattgtttttattaaatatgcatccataggaattttaagctggtgaaatgaatattaatttggtttaaaatctccagggagagaaatcctcatcttttaatgatgattattttcactattcttacatttacaaaatttttccttaaaaatttttatttttgttttttaatttttcttgagatggagtcttgtctttgctctgttgcccaggctggagtgcaatggtgcgatttcagctcactgcaacttccgcctcccaggttcaagcaattctcctgcctcagcctcccaggtagctgggattacaggggcccatcatcatgccagttaatttttgtatttttagtagaggtggggtttcaccatgttggccaggctagtcttgaactcttgacctcaagtgatcctcccgcctctgtctcccaaagtgctgggattacaggcgtgagctaccacgtccagcctatttccttacattttaattggataaattaaattggataaactgaagtgtggcctaaaagaatagtctctgaaaattggtcagactctagatgtttgttcttatatatatgtctggctttttacagacaaactatttgacataagtttatttagctttcattttttggtgttgtatgaaataaaccttagctgctgataggcttgtacattgactgttcatttttctaacagcagacactggtctggagacttctacccgtagcaggaactcaaagactgctgtgtcagcatctagaaatatgtctattatagatggtgagtatagactgcaagtgattatttataaattccaacattagaaagaccaaggtaatcaccattggtagcccttatttgtgttgcaatcattgggaagttataagggcaattaggatcacaggataaattattttttaaaagatctttgctatgcattagagttactgaagagggtaagcttttaaaatcatgttttataggccaggcacagtggatcacacctgtaatcccagcactttgggaggccgagacaggcagatcacgaggtcaggagatcgagaccagcctggccaacatggtgaaacccggtctctactaaaaatacaaaaatcagccaggcgtggtggcacatgcctgtagtcccagctacttgggaggctgaggcaggagaatcacttgaacccaggaactggaggttgcagtgagccaagatcatgccattggactctaccctagcaacagagagagactccgtctcaaaaacaaaacaaaacaaaacaaaaattatgttttataatttcttactttcagacaaatgctgtttctgtttggcagagagaccctggaaacaggaaagtgaagtagttggtcactatatggacagtggtcgaaagagagaggaactgtctctactgtttccttgcttcccccatactgccctgtcagtctctgctttccatatagagaagtcatgtgacctatatttaagagaaattatggctaggcccttggaattaatttgtgtatatcctatggtctaaaaattggcctcaaggggatctgtttaactatttttaatattatagatgatgagatcagcctaaaatgttagtcatatttacaaaaagtatgcattaagataggtggtgatacttttttctacctagcatttagaatatattcatatgtatattatttatattatcagttatttgaggttattgtttcacttttataattataaatattttttaaatattataattgtaatatttataatcttatagctaggattaattgttgacacactggggagctgaactaattctcagaagatgaagtttatcaagggtaatataaaccacatttatgtccaaaaggacagctgcacaagtagagttgtgagaggtatgtgagtttaacagcaacccaggtgaaaaagacttaggtcagtaagagttatgcaggcatacccaactgtccaaatctattgatattttaaacagcatttaatgagtcttgcagaggtgtccaagggagagaatacagtcatggattcttagtttctgtttctggttgggccagtaaagcccttttctcatccttcttttcctcatatcactagcgacagaaactaaaaaccatggcttcagctgctaaaagcctaaaacaaaagaaaacagaacaaaaacaataacaaaatgaggtgggttggacaagcttgcacagcaaggaagttctctctgtgtactaaattggccataacatgccaaggatactgtactcctctttggaattatatttcaaggagactgtcaactatatatgatcattcagaagagataccaaataatataaaaaatggttggccaggcgcagtggctcatgcctataatcctaccactttgggaggctgaggcgggcggattgcctgagctcaggagatcgaaaccagtctgggcaacaaggtgaaaccctgtcccctactgaaaatacaaaaaattatccaggcagggcggcgtgcacctgtagtcccagctacttgggaggctgaggcaggagaatacttgaaccgagaaggtggaggttgcagtgagccgagatcatgccactgaactgggtgacggagcgtctccaaaaaaaaaaaaaaaaaacaattggttgaaggaacttaggatttaggatatctaacctgggaaacattcagatctttatgtagattatgttctatcgtgtaaaatgtggaatgaatagatttgatctgtttagtcccaaaggcaatgctttttaatctattttggcttatggattctctaaaaatctgatgaaagctatgtcttctctccttaaataagtactcacatgcaattgcacccaatttcaaagggttcagccactcccatgaggcgcattcgtgttttccagcttaagaactcctggcccaatggggatggatgggaatagctagaaacatactgatttaagtttctcatctgatagaatggacctggaagatttaagaacaactttgttcccctgttttatatgtgagggaactaagccaagcagttttgccctgagttgataaaaccactaatagtagcaataatagctaatatttatgaaactgcatgcctcttaacaggtctgtggggtaggtacttactatattatttctgttttacagaaaaggaaacaggctttaaaaagataggtagcttatcctagatctcataacttgtcagtaccagatctgggaatgatctcacattctctgcactctacaaccagtagttgaccactgtactagtttccagagcaaggtaagattagagacctagctactagttctccatagaataatttttgcattatgcagaataacctatgtaattaatataaagatggactaatttgccttggaagtaagtatcactccattaaaggaattttcaacatttatcaaatgacagctgacattgaagaaaagatacaaaatcaggttgattaaatgactcttaaaccttacaaaaaattccattgctatatttttactcaagtattatttagtacttcagaagagctagctaagatccttagctttttgcttcacaaacatgttgtctttattgccatttagggagtggtatctggaaagatgctgttccattcttggtaggtttaatataaaagcagagaggaagaaagagagaaaaggcagcctggaaaattgtaaaggattcatgctgagttcaaccttgcattcaacaaatgacagctttgtgacttgagacaaatcagtcactctcctagtttgtttagatatgattggaaataataatctctattgtattgggttattctgaagattaaatgatcaaaaagcctggcacagtaggcatttatcaagtgttcttttaaaaatgagaaaacaggaacatagaaaaagagtgaataaaataatgaacacttccatgttaaaccaccaaaattggttagcatgcaatcgacagagtcatagatgtagattacccacctttaccttagcccaaatcgtctttttttgtcctgtcttgttttttttttcttttttgtttttgtgtttttgtgtcctgtggaatccagtgtcctggcttgttttatgttaagctttccttgactccagtgggtagaattcatcacttaaaatgagtcgtctttgagtttccactgtaattaagaaatcagatatcagttaagcttgttggtttttgttttttaaaaaataacctgtttttctctcagcttgctgtttttggtgttctgcagtttcactgtgatgaatctaaagatggtactcttgtttagcctgcttagcaattattgggcttcatgaatctctgaactgctatcttccgtcacttctagaaaatccttagctattatcccttcagatgttacctctatgctattcttattctccttctgagtcttcagttaaataatgataagacctctttactctctcctcacatgactcttgtattttctgttttctctttctgtgctacattctgaataattatttctgatcacttttttttttttttttttttttttttgagacagagtctctctctgtcgcctaggctggaatgcagtggcatcatcttggctcactgcaacctctgcctcccggggttcaaacaattttcctgtcttagcctcccgagtcgctgggattacagatgtgcactaccacacctggctaatttttgtatttttagtagagacacggttttactgtgttggctagtctggtcttaaactcctggcttcatgtgatcctcctgcctcggcctcccaaagtgctgggattacaggcatgagccaccttgcccagcctatttgcttcctttaaaatatgctctgtcacttttaatagtttttagaagttttctgaagatatttttaggcctgttttaatttttcgtgtgtacacagtaaggacttcttttattttgtatctaataacctagtgtctgaatgtctttggcctctttctgttgtctgtttctgtgggttcttatttatggtgacttatttccttccatgctttgttacttactgtccctagaaaattatcaacaggaataatttgagaccttggatgaagccatcttccttcagagaagattcacgtttgtttctctaggtttgtagggcaccacaagtcatagaccactttaagctaaatttgagggtttcttggaccagtcatttgatacgtacttgtaactaaaatgcaggttcagtcacttgctgcttgcaaagtccaattaacaagagcaaggtgtggtataaagaaagtgactttttattccaaagcgaacttaggggaagaaatacaggcttcctaccttaagggtactgcttccccctttgcagcagaaagtggactcttttaaaggggacctatcaggagtggcatgcaggggaggaagcgagcaagtggggggtttgcattctagtttggtgtcttatctaccaggcagttgaattggcatcttcatgggtagaaataggctataaaggtggccgaatactctctaggttggcgagagtttcatagcaggactttggattgtgaattgactgttatctctagaggcaaccccctggtgggtgatagttcaactctggagcttccaagcacatagttagatgaactccccttttagggagtctctgatgaagaggaagtaaaagactatagttgcatttctaaagaactaagtagaaagtgggggaaaggagaaaagaagagagagaaaaagtaatgaactacctcttagaaaaatgagggtactcagttacatgcttatgaaatcctgtttacctctgcttctctcttcaaccactggggctccaccttaggaagggaaatgcatcggggttttcactttgggcagccgtgggctgtggtagccctctctatttttcttcaggattctcaaaaccaatgttaacattttcccaattgaaaagtgaactcagggaaaggactctgcttacctctctgagttctagcttttcttcagttttggcctggtaattccttggtatgtgatcagctcttcaatgccattgagaatttttttttttttttaaatgtttgaggtactaatttggattgttgtcagcagaagtgagtttgaagacaatgagaggtcattttgtctgaataacctagcctgcaatgactgttacccattgacaacatagaataaagcttctatttgtgtagaaagactggagaccagttatgatgccttaaaagttttacagaatggcttgactaatttttttaaggaaacagtattcatctatgaaaagaggctatgtaaataaactaaatacgaaacgtcagatttcctgaattatgttgtaagcaaaaatcttattatggtaccttttgcagcagagcatgatggttaagaatgcaggctctggagtcaggtccattgggtcagtcacagccagctctttactgctggcttagcacccttgcactgtaagtgctgtgagaaaggggtctgcatcattcctcctcatcactgtatccactatatttggcacataacatagtagatgcttgttaaatacttgacaatgactgagtaaaaattacttggagattgtgtagcgtaagggtgaagaccatggttctaaagtgaggaagatcttggtttggatcctgacttctcaattttactagttgtgtgtcctccagcaaatatgttaagtttttcatctttaggaatgagtgttctcatctgtaggatgggacaatgattgcgtccacctcattgcgttattttgaggattaatgagaaaatgcatgtgaagtatcaggcagtgtctatgcatattaagccctcagtaagtgcaaactggtgttattctacaagcatcagatcccttagctataaaatttgacaatgttgtactgacttcagagtaattttattaaatgagcttaagtatttacagtactgatcacagcacctggtaaaaatgcgacagatgatagctgttattaatattagtggtagtgttttgcaataagattatgaagatgaatattatgtgaatcattggtctaaatttgtcttttatctaattgatttgatataatggtttcgctaacttaactgattacctccagtactaggcctttttttgaaaaatgaactgattttttaagtataaatttgtgaaacatttttatcaggttggatttggtgggtttttttttaagtctctgacagaatacctgtgaagtagtaactatacttgtcatcactttgggacagaagcaacaaattaagactgtaacttctagatctctgttttaaatggaggagtgaagagataaataaaggtcaaattctcttataacaaggtccatggagtatggaaatttattattgtgctgcaattttattggaaaagataaaaattacacttgtagccacgggagttgtaaataggagttgacagcccagatttttccattgaagttagtcagcagaggatagtggctaggtgaataaaagtacctctgaagtcacggcctttacatttcatttataccactatgggtaccactgctgctactatgtttgctacccaaacagctacatgtatttgaatgctttctatctgctagacacttcctcttaccctctcagcagttttctgcatgaagtattaacactgttttacaggcgaggaaattgagttttaaagaagccaaggagcttggccatagtcaagctagtaagtcaaaatgagtctaactccaaaaccagagcttttaaccaccacactttattgtcttcctaacagaacatattgcttagttttctgataaaattatttcacaacatcactcatcttttgccttccagtgggataaaaagaaaggtatcttgttttctaggatctcagagttaaaggagtcagtgaataaatactgaacagaaatattctttgaaatcatcatgatcactggattttttattcagttgctctgtctagccttttgagtagagtaggatgtgaaaaaagtaactgagtaaagcagataagaacactgtttctgcctctcgtttctcctcttagatattacaagtttggggacagaacctagaataggaaacatgtgcaaacacaataaatttaggttagatagaaagattcgttagttttctgactaggagaattttggactttgcaggattttttgagtatttgtttgtttttctgtgccctatttagtttgtgagttatcttggggaagatatttttgatattagcaaactggtaaggcataggagaaaataaacctaaattagacgtttgaaatttattgtaggttttgttttgttttgttttgttttgttttttgagacggagtttcgctctgttgcccaggctggagcacagtggcacgatctcggctcactgcaacctctgcctcctgggttcaagcgattctcctgcctcagcctcccaagtagctgggattacaggcacctgccaccatgcctggctaatttttatatattttttagtagagttggggtttcaccatgttggccaggcttgtcttgaactctggacctcaagtgatccgcccgcctcagcctcccaaagcactgggattacaggcgtgagccactgcgcctggccttattgtaggtttcgatgtcaaggaaaaagaaagggaaagataaagagctagctaaacttcaagtatctaaccaagtttaaaaggaaaaaaggtatggatacaaaggaatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtatttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaataaaagaagaaaaattatggaacattaaagctggaaggagctttaccaattatctctagggcttctaggatttgattttttttttcttggttgctctctttttttaaataatggttattatagaaatccataaatgttatgtatacagtaatgttttcaaggataacagtgttgaaccaaaagagctcatacatggaatactaatattgaaggtgagttcaatggttatagaggttttttctatgctggatttccttttgttacttatcttcccaaaatactagctgtgccttaacagctgttgctagacttaagatgaatgaaaaggctggagtccagcgatccatgtggtttgccctaggtttagcctgggccttctgctcttcctttcgattccaagaagagtccaatatgggcttgattctcttattacttcactttcaaaactgtgtgtcttaactcccgagccaatactcttccctttacatcagggtttctccatagtagcactgttgacattttggactagataattctttgttgtgaagggttgtcctatgcattgtaggatatttaacagcatccttagcctcaggggctgttcgttcagtatttggtctttggcttcatcctcatctgtacttaagttagatgaagatatggcaaatgtatgtatcaaatgtcaagataacaaaatgtagagaaatagtattttgggtggtagaatcaacagtcagaaatatctttattgggtcttaacactaacaaatggtatttaagagggacagatttaacagaaagatatctagtatttcccacatggtctgatacctcatttaaagttggagatggaacactgatggtctcacctctcataagaaactaagaggaaagtcataaggtctgcatatgagcctatgcaagtcattcaccagtgtaactgtgttcccttaggtgctcaggctcctgggatggccaggagagaggtgagcaaaaagtaacatttgtgaatgaagagggacattggagggaggtcagactgagtgttagttttaatggttatggctttctgtctccttttttgtggctcatatataacttaagatttaatcgtgtaattcatttcttcattttcatttttattcagagtctattctcacaaaaactgtttgttgctttgtttccttgccaggtgattgaggtagatgaatcagatgtggaagaagacatttttcctaccacttcaaagacagatcaaaggtaggtgcagtgattttctgcaaaagaaacatctgaaaaaaattaaaaattatccagaattccaaagttacacatttttctatgccatgtaagtttaacagacttattttcaactagtaaagtatgtagaggaatgaaaacagaccaagggctagtttatagagttgatgcagcattagtacaaggattttcagtgaaaattgaaatagcctgtaatttttttccttttgactttattagtgcttttctttctttttatttatttatttattttttgagacagtgcctcattctgtcgcctagactggagtgcagtagtgcgatcttggctcactgcaacctccactttctgggctcaagcaattctcccacctcagcctcctgaatagttgggattacagacgtgcaccaccacacgtggctaattttttgtatttttggtagacacagggttttgccatgttgcccaagctggtcttgaactcctgagctcaggcgatccacccacctcgacctcccaaagtgcctggattacagatgtgagccagtgcgcttggcctcagtgcttttcttaatggaagactgtgttctctccaaataacagaaaataattttgtattttgctatcatttgatttcagctttttgtcattgtcttatttttatattcttaactacacatggtactgtactaaacacttaaaaggggatcacgtagactcagtctgccttcagaggacttgcatgctcttcctgtgtgttttgggattttttgcctattgctgttaagcttgacttgattcactattaccatttgcttttatacgttaacattttggttgaatactgcttaactaaagctcgaataatgagaatttctacttaataaagtaatcaactgccttattttgtacttattttctgtttgagcattatattaggtctgatgagggaggggcataacgaatgttttaatatggcctctgccttcaggtaacttcaattatagtggaaaagagaaatgaacatatttgaattcatcaaagaatgaattagtacataattaggtgtagaattttatattacagacccataagtgtgagtgcttatgggctggtgaaaaaaggaacaaggaatgtgggctagaagaagcagcttcatggagggagtaaaattgacctgaggtttcaaagataagatttggcttagtagggtggaaaatggtggtcccagctgagaataagggcatgagcaggaactccagaaagaagggtgattgaggaaaaagccttatatcagtgtttctcaagctttttttccattatctcagccatttcttgattatccaaggagaagaattaagtaacttagatgtaagtcaatttctccctaacgttagaaattaaatacttaaagaatgaaatttttttgggtatggttgagtctgagagggccaaaaaccgtagctttttcatcccactctatcccctggagccaatttttgttctttatgatactgaccccactgagaatataagctgtatgtgacttaaaggttaatgttagagcaagtgtaagtatagttccacgttcacttattagatccttcaaacatcatgctaggttctggggatagaaagataaatgtttcttccttcaaggaatttacactttagtggtatgctaattacagggcactgctaatccaccaagataaatgttttcttcaggtgtaatgaaacctaagggacgtgccagtatcttcctgggaaaggtcattgaaggttttacaaagaagataggtgacatttgagctggtgatcagccgatcagttagcatgcattaaaggaaatgatctggtgtagagagaagaaacagtggcacaggacgggcatctactttgaaggatggtcatggaaagcctctgaggaagctacatttaagcggaaattttaataagggaaatgtggccttgcaaaaagcagagggacaagtgcatgcagcctgtattagtccattttctcactgctgataaacacatacccgagactgggcaattacaaaacaaagaggtttaatggactcaaatttctacatagctggggaggcctcataatcatggcagaaggtgaaaggcatgtctcacatggcagcagacaaaagaagagaaaaagagccaagtgaaagatcttgtgagacctattcactaccacgagattagtatgggggaactgcccccgtgattcaattatctcccaccaggtccctcccagaatacttaggagttacgagagctacaattcaagatgagatttggtagggacacagccaaaccatatcacagtctattgaagaagcaagtttaataatgttatttaggagccaatgactaatgtgtggtggaaaaggaggttgtttgagatgagaatagaaaagagacacagggtaaatcatgctgcaggaacaggtgagcactacaaaggtattggatgttgttataaatgcagtgggaatccacagaaagattttaagagaggagtggcaccttgtgatttacatttacaaaggatcactgtggttgcagaacaagtgtaaacaagcttatctgaaaggagggtgctgcaggtagtctgagctaagagagacgatggaggcttgcacaggctggtggtaggtgaaatggaggaaacagatggtttcaggatatattttgaagatagacatgacaaaacttgaagatggattaaacatttggagtaagggagaataaggaatcaagactgattttctggtttcttgctggagcatttacattgtgccatatattgagaaggggacaaaagaaaggacagatgtgttgtagggaatgataggcatataattaaaagttccactttagatgtgaaaagtttgagatgcctagaaacttacatgaagggaagttataggcaattgaatgtgtgaattcagaactcagataagggtttttgttttgttttgtttcgttttgttttgttttgttttttgagacggagtctcgctctgtctcccaggctggagtgcagtggcgcgatctcggctcactgcaagctccgcctcctgggttcacgccattctcctgcctcagcctcccgaatagctgggactacaggccctgccaccatgcccggctaattttttgtatttttagtagagatggggtttcaccgtgttagccaggatggtctggatctcctgacctcgtgatccgcccgcctcggcctcccaagtgctgggattacaggcatgagccaccgtgctcgtcccagataaggggtttgaaatggtacttacatttacctctggacagcgtgcagatggtacttaaaaccattgggatggataggatcacctcaaaaaagaaggcagagcagaagagtgtttgttttcctagcctgcagttttaaccttactcagcctttgggtagagtagaaaaaaacaataaagacatgagaaaaatccgggagagtatagagttgcagaaggctgtactggcctttataggagtaaaaaataccaagatgggcgcagatgcaaatcagtttatatgtctatggtaagtagtggagggacttattttagctcacgaaggtttacttgaatttctcaggctcatttatgtgtatttaacaggactcctttggttccagctgatagaaacctaactcagattctcttacagaaaaggagatttattggaagattatcgggatacctcaggttttggaaggaagtaagggcccctttctgagtccttgtttggttgttcttgtctttgtaaattgaagcacacacaaatcagatctagctttctaagtttttttttttccagaaatggatcaaaatgctattctgatatttttgatatatgcttaaggatattaaagaaaaaatagtttgcttttgatatcacagtagattgtttacttttcagctgtataaatgtctgccgatttctttagacatgaaatagtaatataactcacagttgtttggtacttcctatgtgccaggcacttctctgagcattttacatgtgaattagcttgcgtggtgctcacaacttccccaggagatagattatagttataactttatcatccccattttacagatgaagtgtgaagcacagtggctaagtaacttacctaaggtcacccaactagtcatacagtccaggcattctgaccccaaactcatctctgttgttgcttcttggtatggtaactaacttctctgaccattgtgcaagcaataagaatcatttaagttttgagaggctgtttaacattttagaggcaatttccaaaattgacattttggaaacacatcagaaatcagctttggcagattggtgtttctaattacagcatctaaatgataatttagactgtttttgcagaatgttttagtaattgcaggttatgcatggtgttttatttataatttaaactatttaagctctgccacttaccagagtggaccttgataattgtgctaatctgctacctctgaaccttagttgctcttcaagtttgcctgataaatccttctgtcctttcctttagtgcaaaggacctgtgaatttttctatttacttctgacataagatctcgtgattctcattcttttttccagataaaacctttggacatatttcttttgctataatgacatcccaaagcatgttaataaaattgtagactaagaatttataaacactacttttattgaagacgggaatcagcagactttttcttaacaggccagatagggagtattttaggctcggcaggtcaagaggcaaaaccggggatattatgtaggtagacacttgtataaccatttaaaatgtaaccatttcaaaatgtgaaaaccattcttagcttataggccataaaaaaaacaaaacctggtggtgggctagatttgcttactggccccgatctaaagtgacttaaatttcttattaattaaaagacataggaatttactgcaagttaagctttgtaagagtaggaatcggctgggcgtggtggctcacgcctgtaatcctagcatttgggaggccgaggtgggcggatcacgaggtcaagagatagaggagatagagaccatcctggccaacctggtgaaaccccgtctctactaaaaatacaaaaattagctgggcatggtggcatgctgagggggctgatgcaggagaatcgcttgaactgggaggtggaggttgcagtgagccgagatggtgctactgcattccagcctggtgacagagcgagactccatctcaaaaaaaaaaaaaagagtaaaaagagtaggaattatgattttcttattaactgagatttgaatagaaaatatttcaatgttcccatggttttcagaagtggaagatggtaatgtatacattttggtacatgataagtactataataatataagtaagtattgttgtagtacttaatatgtgtcaggcactgttctaagtgtttaagcatattaacacatttagtctttataaaaccattatccccgttttacagatgaggaaattgaagcacagagaggttaagtaacttgctcaaagccacataggtagtaaagggcaaaaccagagttcaaacctcggccccagagtccttttccttacagttaagttttattgccgctaatgtagattttaagggaattgtgtgttatttatattcgtggcagctgctggattgaaaaacttagccagaaaggcacacttgatgaattatgtagttcattgtgtttgtttttgtttttgttttgcctcaggtggtccagcacatcatccagcaaaatcatgtcccagagtcaagtatcgaaaggggttgattttgaatcaagtgaggtaaataagtaatattgttaaattttaattaatttttaactttataaaatttaaatagagactgccagctagttgctgaacttttttttctttgataaataacttcatcttttatgttcagggagtacatgtgcaggtttgttacatgggaattgcgtgatgctgaggtttggtacagatcccatcacccaggtagtgagcagtaggcagttttccaacacacatcctactctcagcctccactctctagtagtccacagtgtctgttgttcccatcttcatgtccatgtgaactcagtgtttagctcccacttgtaagtgaggacatgtggtatttggttttctgttcctgttaatttgcttaggatagtggcctccagctgcaaaggacataattttgttctttttatggctgcatagtgttccatgttacatatgtaccaccattttctttatccaatccgtattgatgggcacttaagttgattccatgtctttgctactgtgagtaagtgctgcagtaaacatgagtgtatgtgtctttttggtagaatgatttcttttcctttggttatatagccagtaatgggattgctgggtcaaatcgtagctctgttttaagttctttgagaaatttccaaatggcttataatggctgaatgaatttacattccaacaatgtataagcattcccttttctgacaacctcactagcatctgttgtcttttgactttttagtaatagccattctgactggtatgaaatggtatcattgtggttttgatttacatttctccgatgattagtgatgataagcactttttgtttgttggctgctttgtgtgtcttcttctttgtaatgtgcctgttcatgtcctttgcccattttctgatgcagttatttgatttttccttactgatttatttacattccttttagagtcttgatattagacctttgttggatacgtattttgtgaatattttctcccattctgtaggctttttgtttactctgttgatagtttcttttctcttttttttttgacatggagtttcgctcttgttgcctgggctggagtgcaatggtgtgacctcagctcactgcaatctccgcctcccgggttcaagcgattctcctgcctcagcctcccgagtagctgggattacaggtgcgcatcaccacgcctagctaattttttgaatctttagtacagacagggtttcaccatgttggccaggctggtctcaaactcctgaccttatgatccacctgcctcggcctcccaaagtgctgggattacaggtgtgagccactgtgcccagcctgatagttttactgtgcagaagctctttagtttaatgaggtcctacttgtccatttgtatttttcttgcagttgcttttggggacttagccaaaaattatttgccaaggccagtgttgagaagggtattttcttggttttcttctaggattattatagtatgaggtcttactattaaatctttaattcatcttgagttaatttttgtatatggtgaaaggtagggatccattttcttctgcacattgctagccggttatcctagcaccatttattgaatagggagtcctttctccattgcttgtttttgtcagcattgtcaaagatcagatggctgtagatgtgcagctttatttctgagttctctgttctgttccattggtctgtgtgtctgtccttgtaccagtaccatattgttttggttactgtagccttataatatagttcaaagttgggtagtgttatacttctggctttgttctttttgcttagggttgctttgtctatttgggttcttctttggttccatgtgaattttagaatagttttcttctaatttctgtgaaaaatgacgttggtagtttgatagggatagcgttgaatctgtaggtagcactgggcagtatggtcattttaatgatactgattcttccagttcctaagcatggaatgtttttgcgtttgtgttatctgtgatttctttcagcagtgtttcatagttctccttgtagagatctttcacctccttggttagctatatagctatgtatttaattttctttgtagctattgtaaatgggattgtgttgttcttgatttgactctcagcttgaacgttattggtgtatagaaatgctactgacttttgtacactttttttttttattctgaaactttgctgaagtcgtttatcagttctaggagccttttggcagggtctttagggttttccaggtacagaatcatatcgtcagcaaagagagagtttgacttcttttcctgtttggatgtcttttctttctttctcttgcctgattgctctggctaggacttccagtactatgttgaataggagtggtgagagtgggcattcttatctttttccagttctcagggagaatggttctagcttttgcttgttcagcatgatgttggttgtggattttcatagctggctcttattattttgaggtatattccttcagtgcctagtctgttgagggtttttatcatgaagggatgttggattttatcaaaagctttctctgtgtctgttgaagtgatcatatcgtttttgtttttaattctgcttttgtggtgagtcacatttatggatttgcatatgttgaatcaaccttgtatcccaagaataaagcatacttgatcatggtatattaactttttgatgtgctgctagatttggtttgctagtttcttgaggatttttacatctgtgttcatcagggatattggactgaagttttctttgttttgttgtgtctctgccagattttggtatcaggctgatgctggcttcgtagaatgagttagggaggagcctcccttgatttttttggaataatttctgtaggattggtaccagttctttgtatgtctgatagaatatggctgtgaatccatgtagtctagggcttttttggttggtcagttttttattactgattaatttcagaatttattattggtctgttcaggttttcactttcttcctggttcaatcttgggaggttgtgtgtttagagggatttatccatttcctctagattttctaatgtgtgtgaatagttattcatagtagtctctaaagatcttttgtatttctgtggggtcaattgtaatgtcatctttgtcatttctgattgtacttagttggatcttctctttttcctttgttaatctagctagcagcctatcaattttgtttattattttaaagaaccaattcttgatttcattgatctttggtatggatttttgcatctcagttttgttcagttcttctctaatttatttcttttcttctgctaatttgggggctggtttgttcttttatttctagttcctccaggtacaatgttaaattgttaatttgatttaaattaacaaattgttaatttgattctcttaatgaaggcatttagttctgtaagctttccttttaacagttttagctgcatccctaagattttgtaagttgtgattctatttttattttcattaatgaaattaatttcattaattaatgaatgaatttttattaatttcaaagaatttttttatttctgccttaatttcattattgacccaggagttatccaggaataaattgtttaagttccatgtatttgtgtagttttgagagatcttcttaatattgatatctctttttattgcactgtagtccaagagtatacttggtatgattttgatttttttgaatttatttagacttactttgactgaacacgtgatctatcttagaatatgttctgtgtgtagatgggaagaatttgtatcctgcagttactggatgaagtattttgtagctttcaattaggtctgattggtcaagtgtcaagtttaagtcctgaatttgttagttttctgcctggatgttctttctaacactgtcagtggggtgttgaagcctcccactattactctgttgctgtctgagtctttttttaggttaagcagaacttgatttatgaatctgggcatgtatatatttggcatagttaggtcttcctgttgaatcaaaccgtttatcattatataatacctttctttgtccctttttactgttggttggtttaaaatcggctatatctgataaaagaattgtgactcctgcccttttttgtttttcatttgcatgttagatctttctccatccctttactttgagcctgtgtgtgtcattacatgtgaaatgggtctcttgatgacagcagtcaggtcttgtccttttatccaacttgccactgtattccttttaagtagtgacatttagacaatttatattcagagttagtattgatatatgagatttcgatcctgccatcgtattgttagctggttgttttgtagacttgattatgtagttgctttatagtgtctctaagctatgtccttaagtgtgtttttgtggtagtaggtggtggttttttgtttccatgtttagcactctattaaggacctcttgtaaggctgatctagttgtaatgaattcctcagcatttgcttgcctgagaaggattttatttctcctttgcttatgaagcttagtttggtgggatatgaaattcttggttagaatttcttttttctttaaggatgcagaaaataggtccccagtctcttctggcttgtaaggtttctgccgagatgtccgctggtagcctgatggggttccctttgtaagtgacctgacccttctgtctagctgcctttaagatcttttctttcatgttgaccttggtgaatctcatgactgtgccttggggatggtcatcttatataatgtctgataggaattctctgtatttcttaatttgcatgtcaacctttctagcacgattggagaaatttttctggactgtatcctcgaatatgttttccatattgcttattctctcttctctctcaggaatgccaatgagtcataggttttgcctctttacataatctcatatttctcagaggttttttttttccattcttcttcattctttttcctttatttttctctgaccaagtagatttgaagaactggttttgaagctctgagattctttcctcagtttggtctgttatgttgttaatactttcagttgtattatgaaatccttgtagtgaaattttcaattccagaagttcagtatggttctttcttaaaatggctattttacctttgtaaaattgttttactggattcattggattgggttttaactttctcctgaatcttgatgagcttccctgccatccagattctaaattgtatgtctgtctttcagtaacttcaatctggttaagaactattgttggtgagctagcaggctcatttggaggtaaggggacattctggctttttgaattgccagaattcttgcactgattctttctcatgttagagggctattgttcctttaactgcagtgtaagtcgagtatagtcaactggccttgtttctgggtgctttcagagggccacagctctatatagatctttactgtgcctagattcttgccctgggtgtcacagagatgtatattggcagaattattttggtgttgtaattttggctgtgatccagtagctggcatttaacattagtgtccagtggataggctcttactcagctgcatagttcttttgtatttctgtgtgttcacagccgtgctctgtggtggggttggggagagagatgaccactcataagggccactcctggaccatgggtgaggtccctcctatcactggcactgtacctgcattactgttgtttggtgtcttgggttgcagggctcccttagacagaggccatggctgccagacaggccacacccttcccagaccagcactgtggaggaaggcatgtcccattcctgcactggcccacgaacccacgtgtctcactcctttcagtgttctgaaagtgggatttctcccctacttgagtgccagccccagctcttagctcgacagccccagctgtgtgctgtagccctgtagcactgggaccagcctgtggctccatcgtctggaccctcagggtcaggcaccagctgtgctggggaatctgaaatgctcccaggctgccaggaaggtactcaggtggaaccaccagcaaaaaacaaggctaggcagcagaggctgccctgtgcacacattcctgcagggcagcttggcaggggccctggaaggggctgtaggggaggagggcctgcagaacagatgttcctctgtcccacagggaagctggccccaggctggcctgccccagcattcaggtggggctagtcctactccaggggaaataagaagtcttaggggatgggcgcctatggccaccttctgctgcagctgccttagatatgaaaacccctgggctccatgtattctggagctctgtctctgcctactgtttgggccaatccccctgccagttgaaacgtctccagggggcatggaatcttgtagctaggatctctgaggtccatagtgagagtgtgctgccccatcatccattcactcacccctttctaggagcctttcaaggccaagaaccagccctggcattgggcaacccccacaaggttaccagcttcctccctcttcagcttccagtttgtatcacctctctatcagctcttggtgctttttctccaaagatctgctcaaaatatgttggcttactcgatattttggtctttattagtggcagtggtgcttcttggccctgtctagttggccatcttgtccttcttccactaaaaattatttttaaaaatagtttcaggctgggcgcggtagctcatgcctgtaatcccagcactttggaaggctgaggcaggcggatcacctgaggtcgggagttcatgaccagcctgaccaacatggagaaaccccgtctctactgaaaatacaaaattagccggacatggtggcacatgcctgtaatcccacctactcaggaggctgaggcaggagaatcgcttgaacctgggaagtggaggttgcagtgagccaagattgcaccattgcactccagcctgggcaacacgagcgaaactccatctcaaaaaaaaaaaatagtttcattgataaccttcctttgaactatagttaatgttaagagttaacaagtaacatatgttgagtgcccatcagtgtaatacctcagatataaaagtcctgtagatttttaaaatatgatattcactcagttcttatttgcccagttaacagtgggatcggaattttttttagcttctaccatttacttatatttggagaaatgatgatgatgatgatgatatcccaagagcttttaatattactttaatgaatatttattaagtactcactatatgctctacatgtgtcatgtagagggtggcgcatggtggtgatttcatgacatacaggtattcaggcattgtccgaaatgttctctgggaggatgtctggaaaaaactccagttccagatcgcgtctgcaaccatgaaatctccccaccatgaatgaggaggaggaggaagaggaagagttataagtcaggacttacctcttgcctttattaatttgctgtttcaattaagtttaaataaaactacatgactgaaggatactgcccttcccctttccttcaaggctgccatttgaagggcctttgctagtttttgttgatttgcttgaaagtgtttctcttaggcccatgacccctttcatttatttttttatttaaaaaattgttaattgtagcaaaagcataacataaaactaaccattattaagtgtacagttcagtagtgttaaatagatccatattaaacagatcttcagcactttttcattttgcaaaactgaaaatctatatccctgaaataacaagtctctgtttccccttcttcatcccctggtaactaccattccactttctctttctatgaattcaactactctaggtacttcatagaagtagaatcatatagtatttgcctttttgtgactggcttatttcacatagcgtaagtacctgaaggtttatctacgttgtagcctgtgacttacacctttcatttttagctttggctgctgctgccatgttccctgtatttaagctgtggtttaaaacagcttgagaggactcaactcaggctgccaagaaaaatggcagcaagagctcattctacctattaaatactaacatgttgcttccaggagggaagtgagcaattattgtttattccaaaacatctggatatatatgcggttatatgttacagttaaaaatttgtatactagttcatgttaactgcaaagacaaactattagcaaattatctattagacttcatttggatttgtctctggtttatttaagttttgtctttgatagcagcagaaaatgaatcaataaatgaaaatgaatttatatttcttaaggcatccattactcatcagagatagttaatttagctaacatttggaagtgctgataccaccaacaaagcctagcatcaaataatttcttttaatttcttttaatgtcttaaacacaaataaaaaacttataaacaaatttgctttattttctgaatatttatagaatacgtaagaattggttttatcttcataaaattatataattgggcttatctgaggtttgttttcattctctttaattaaattattagttaatatctgatattcctatttattcttaccatgcatacaatctatagcccaatagcatgggaactcttttttttttttgagatggagtctctcgctctgtcgccgaggctggagtgcagtggcacgatctcagctcactgtaagctctgcctcccagtttcacgccattctcctgcctcagcctcccgagtagctgggactacaggcgcccgccaccacacccggccaattttttgtatttctagtagagacggggtttcaccgtgctagccaggatggtctcgatctcctgacctcgtgatccacccgcctcggccttccaaagtgctgggattacaggcgtgagccaccgcgcccggccagcatgggaactcttgaaataactgcatgtatttctttttttatccaaaaaactatttgaaagcttgctttgctaggttgttttttgcataagtgtgagagtagctagctatttctagtattaaatggtaatgggaaataaaattacagctgtttctgagttggatctccatgtggcttcattattttttcgctgtgaatttccagaagagtagatacaactgtaataaaatgtaaatgagaaaatatattcaaaaaccaaatataaaatgacttgaattatttttctggcttacctatacttcatttatctttattaaggttagtaagggaaatgtgtgtggtttatattgtagatacatgcacacacagcaggataaattttcattttaatgctcattaagaatttaattgtacttaatatattttgcagttataaaggaaatagaaaaataaagtctatcccatgtgaaatgactctcactggtattgttttgcccataagaacttctgtcttgtttcagtgaagcagggaacaatcactaatacaacatttgtatctcatttcaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaag

SEQ ID NO: 13212 - DNA, 77867 bp, Human; identical to SEQ ID NO: 13211

SEQ ID NO: 13213 - DNA, 17901 bp, Human
caaaatactgtgcattgagctgaagccgctgcatgggcctgtcccagctacaaatccctgttctaccccgaccctaagcgtgcctgctctggccgcagcctatggatttagtgcgtcccttaggcttcttcagacctatgaggaattccaggtcctgaccctcacagtacagtcgacaatcatctttctttaacaacacagccagaacaccttcagggatgcagacaacctcatctgggacctaagcatccgggagagtggggatgaggaaatggaggaagaacacccttggggctcattctggaccagtttgccaggcttttctccccatgcctatcttccagtgccactcaggagaatcatatcttcacatcagtttttatgtttttctttttcttttcttttctttttttaaaaataaagatggcatgcctgtaatcccagcactttgggaggctgaggcgggcggataacctgaggtcgggagttcgagaccagcctggccaacatggtgaaaccctgtctctactaaaaatttaaaaattagccgaacgctggtgtctcacgcctgtaatcccagctacttgggagactgaggcacgagaatcgcttgaacctgggaggcggaggttgcagtgagccgagattgtgccactgcactccatcctggcgacagagtgaagattctgtctcaaaaaaaaaaaaaaaaaaaaggagagagagagagacgggatctcgctatgttacccaggctggtcttgaacttctaggctcaagcaatcctcctgcctcggtctcctacagtgttgagattacaggtgtgagccattgttccaaaaattgatatacttggcctcacatcaatttttggaacaatgcaggtaataatgagggggaaaaaattttaaaagtcccaattaccctttaaacaaatattacctcctccaaaaaatatttttctagattcctgaatgtattttttggtggaggaggaactcaaagtagaattcatttacatattcattcattcattccacagcactaatcactccatgcagtaactgtgtgtccccgtccctctcagacttagtacctggaagacagccaacctgtcttaattctattggtatccccagggcgcatttctttgccttgaaaattgagtacccaataaatgtgcgtcgagcagaactacacgagatggagaacaggggtttaggggtatgggggagagtcagcaattactggtgtcctccctccctcccccagctctgctcctacagatccaggacgcctagcgagggtaggaacctcttctgtgcttccgcaacgctctgaactgcacggcactgagcgcatctaattaaagtgatggtttcattagatagcaacacagcgagaccccgtttctacaaaaaataaaaataaaaaataaaagattagctgggcgtggttgctcgcgcctctagtcccagctacttgggtggaggctgaggaagaaggatcgcttgagcctaagagttcgaggttgctgtgagctatgatcgcgccactggactccagcctgggcgacagagcaagatcctctgtctaaaataaaaataaaaataaaatgatggtttaatcgccggcctttgccccttctgccccccaccccccacaagtctgtaggactgggttgacttcccagagcttactacagattagatgctaaataaatgtctattggacggatgcgcgaatgaatggatggatggaggatgtggttgtgcttaccacgctccctggtcagtgggttaatgtcgtcaggcggggccaggctcgctaacagccgggcggggtcccttcccccgggccccgccccggccgaccccacctttccgcgcggctccgccccgccgcccccttgccagtggcccctccccgcgcaggtcccgactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggtaccgggctccctccggagccaggggaggggaggggtcccggggcggagcccggagggcgggggtctgattcggaggtggcgtggagggtgctgaagggtcggggggctggatggggaaggcaggcggagacgccggacgggattcttgggggtctaggagaccatcctccgccatcctcttccgcgctcacctaggggaatgtaggcggcagctcggaggcgggggtctgcggcccggaggcgggggtctgcggcccgccaccgccccgggcttctcctgtcgcggctgcagtcgttcggttatccgctgctgctgataccccagcctgggtttcggcttcgctttccctgccctactcggcgagctctggaaagcaggacctgctctcggatacccgctgctcggggacctcctcctagcgcgtcccccgccgggcctcccctcggtcgcttccctgcgggccgggctgtgagcggctgtggggacagacccaggctggggaagggggaagcgctcccttgcccgcttccggatctcgctttatcctgccgccgctttcagactccctggccaccctgtccactcccatggcctccacattgaagcttctaagcccagccctgcgacctacggccgaacctctccctggacgtcccagggtgctccctggtcagcaagtccaaaacagaactctcgcttcccaccttctctcctaagtgatcctctttatcccccttccgtgtctcactttcccaagtccttgtattactgggtctgggtgtgcaaggaatagccatttctttatttcttgaaatttaattaataccaaagcccccattgtctgcagggtttgatgggcaaacttcatatcagatattattaatatgaacagctcccctccccaggaaattggataacttcttggctccaggccatcttccttgtccaatcccagccactacttcagatatcccctggagtacaggcttctttgcccacgcaggaaacattgctgctgggtcccagaaagcatctccctgaggccttttcatccctcagcagcccctgagctaatctccccatcttcagtctctcctccctgctttcaatctcgtccccaatctcatattcactccctttctatatcatagcctgaagactcttcttaaaatgcagtggctcacgcctgtaatcccagcactttgggaggctgaggcgggcggatcacaaggtcaggagttcgagaccagcctgaccaacatgttgaaaccccgtctctactaaaaatacaaaaattagctgggcatggtggtacgcacctgtaatcccagctactcgggaggctggggcaggagaatcacttgaccctgggagccagaggttgcagtgagctgagattgtgccattgcactccagcctgggtgacagagcaagactctatctcaaaaaaaaaaaagaaaaaaaatgcatgtttgactatgcccctccctcaggcagaagatgttttaatgattcttccctctcccccaggaggggcctttggtgctatggtctattctcatcttccacactagagcttcatctctcaccacctgtcctaagcccaccactaactttttcctccagctttcccaagctgcctgcaagttgtcaaacacaccactcgttcagcaaatatttattgaacgtgtgtgctaggccctaaggtgacacagttgaaacagacagggttcccgctattgctggactgagggcctttgaacatgttacatgttgttccctcttcccagatggtgttttttcacttcctctggcaaactcttacttgtctttcaagacctggcttcaccattctctcctctatgatgttttccttgacttctgtggtcagttagctgctccctcctccaggatcccatagagtcctctaaatatcggctctgtggttaggcttccttaggctttgtatccagccccgtagctttaaattccagccaaatttatacctccagtgcagactcttcatctgcctacttgcaatataaactcagatgtctaataggcatctcaagattgccacccgcacaaatctgttcctcccgtcttccctatctcaggaaatagttgcactattcatccagttgcccaaacagaaaacccaagcatcgttcttgttgtctcctttgtcctcatcctggaccccatttccagtctgattgcatgacctgtcagctccgcttcgaaaatatgtctccaatctttcactctcttctctgctgccaccaccttaaatcaagctatcattgatttcttgtctggattattgcaacagacgcctaaccgtccatcctacacatagcagccagagtgatgttataaaatcttaattcagattatgtcattctctggcttaaaaccctccagtggtttcctattgcacttagtattaaatccggctcttcaagccctgcatgatccatgtccttcccacctctctcctccctcccttctttccagcacctagcctccttgctcactgcaaatgtgttgattctgtgcacttgttactcctttcccaagtgctatttcccagtattttgctcatccttcaagtcccagctccagggggcaccttctccaagaggccatcctggaccactctgtctgaaatggcctgtcccactgcatctccctttaatacatcattgtgtgtattttctttagagtattcatcataatccataatcattttgtatatttaagtattgtctctgtccattagaatataaactccagggcgggtttggtggctcatgcctataatctcagcactttgggaggttgaggtgggagaatctcttgagctcaggagttcaaggccaacctggacaacatgttaagaccctgtctctacaaattttttttaaaaaaattagctgggcatggcagcatgcacttgcagtactagctactcagaaggcagaggaagaaagattgcttgagcccaggaaaggtcaaggctgcacagagccgagatcatgctgttgcactccagcctgggtgacacactgagacccctactcttaaaaaaaaaaagtaaactctaaaagaacagggatagagatcttgtttgtagtgttcactgctgtatccctgtgatcaggcacaggcttggcacaccataggtactcagtaaatatttgtggttttgttttgttttgttttgtctgtttgtttattgtgacagggtcttgctctgtcacccagggtagagtgcagtagcatgaacacagctcactgcagccttgacctcctgggctcaaacaatccttccacttcagcttcttcagtagctgggactataggtatgcggcaccacacccagctaattgaaaagattttttttttttttttttttttttagagatggggtctccctatgttacccagggtgatctagaactcctgagctcaagtgatcctcccacctcagcctcccaaagtgctgagattacagatgtgagccaccatgcctggcctctcagcaaatatttgtaaattattgtgtttattcatctttgatggatggattataatctgcattgtaatctggtatttgtgtgtctgtttccctaccttcctcatgagttcatacattgctctgcatgtctgaagtctggtccaggcctggcacataggaggccaactgtaaatgtctgtggaatggatgatgtgaagtaaaaggggcaatcaaagaaagtgggggtggggtggtgggaaagcccaggagacagcagaattgagaaaattgagggggtaaagtaaatccaggccagagaggtgacgtgattcattctggctcgtacagggcccagagccagaactagggccacaggcatctccatggcatggaggggaatgcaggctggagctcttggtcaggatcatacttaatgtcccaggtgtttttccaatatcctactccttcatctgccctcatgtctccctgcaggaaggacattccccaagaagggccaaacgtgtgtggtgcactacacaggtaagtctcaccccctcagcccccacccagtccttcccctcccaaggcagggctgtcctctgagcttctctccagaggtgcctgcctctggatcagggctaaagcccaaggcagcagggtctccctgtgaccagccatcctctactcctcccagccagtctagtgggaatgataaaggaggcttggaaggccaactctttccctcttctaccagcaagggccatccatggtgccagcttctaggtgagtcaaacaccttcagtccccttccttctgttgcaggtatggtggagcccctgtccctgctgggtctgtctgatatttggaaatccctcctagagctccccgcagactttctctccatcctgcagtatcattagagaagaagaggaggggagaggacagacaagtcacccagaggctccgatgccatttgaggggtggggtgatggcagtgcttttctctgggtactgagggagcccagagcgggactgatcccagttggatgctctttatctgcaggcgaggtagagtgagttcttcaggactgctggcaggaagatcatgagcaggtgtttgttccaagggaggtgagcaccctgccttgtgacctgcttcctaaagtggcaaactcgatgacagccacttagcagacagcaagcccaggttaattcctaggacatactcggatggggccatttttagcagttctgtgggccagtgtgaagcacaaggttaattctaggcagatggtgtggatgttttcagcagttgtgttgctggtcgctgatgtcagtgggctggaccatgttttatctcctggtgatgtggcctaattaccatgggtcgtctggggcctctgacctgtgtaattgatttaacaattttgcatgttgtagacagaccagtatttatcaagttactgaaaccacaacatccttttgcaaagtcctttcacaatacatacatagggcagcagctcctgtcttgggagagactatgtcttatcaaacatagcgggagactatgggacttttggtaaactttaaagttaaatataaatatagtagagaacataatgtaagatgtctaggtcaatgaattttttcaaagtgatcacatttatgtgactaccacctagagaagcatagaacatacaagcatagaaccagcatccccaaaagtccccctgatgccttctcccagtcatttcacctccctagaggtagctatcattgtttttctttttttttttttttttgtcattgttgttgttgttttgagacagggtctcactctgtgactcaggctgagtgcagtggtgatcacagctcattgcagcctcgacctctcgggctcaagtgaccctcctgcttcagtgtcctgactagctgggaccacagacatgagccaccatgcctggctaattttaattttttgtagagatgagggtctcactatgttgcccgggctggtctcgaacgcctgtatgcaagtgatccttccaccttggcctcctagtgctgggattacaggtgtgagccactgtgcctggctggcaactattactctgacttttgtctccatggattggttttgcctatttttgaacttcatcttaatggaaccacagcgtaggtactcttttgtgtttggcttatttcactcactattatgtctgcgagatatatccagaatggtttattcctctacagtattttaacgtacaagtatgttgcaatttatgtatcctctctaccgttgatgaacatttgggttgttcatagtttttgtttattacaaacagtgtcactttgatcagtcttgcaggcatctcttagtgtacatgtgtacagacatatgtgcatgtttctgttgggtatatacctggaagtggggtacctcctgggctcagcgttagcagtactgtctgacagctttccaaagtcgttgtgccagtttccactctaggcagctgtgtaggagactgccagttaccctgtgtcctccccaacacttgttattgtcaggttttggttttgttttgttttttctttttttgagacagagtctatgttgcccaggctggagagaaatggcatgatcttggctcactgcaacctctgcctcctgggttcaagcgattctcctgccttagcctcccgagtagctgggattacaggcgcccgccaccatgcctggctaatttttgtgtttctagtagagacggtgtttcaccatattggccaggctgatctcaaactcctgacctcaggtgatctgcctgcctcggcctctcaaagtgctgggattacaggaatgagccaccacaccaggctttgttttggttttggcctactctggtgagcgttcagtaccatttcattgtgggtttttttgttttttttttttgagacaaggtctcactctgttgccaaggctggagtgcagtggtgcgatcttggctcactgcaaccccgcctcctgggttcaagcgattcttgtgcctcaacctcccaagtagctgggattacaggtgcgcaccaccacacccagctaatttttgtattttttgtagagatgggatttcaccatgttggccaggctggtcactgtggttttgatttgtgtttccctgatgatgaatgaagttgagcaccttttcatgtgcctactggccatttggatatcctctttagactgctctaattttgtccattttagaaaattaggttgtctttttctttttctttttttgagacagagtttcactcttgttgctcaggctggagtgcaatggcgcaatcttcactccctgcaacctacacttcccgggttcaagtgattctcctgcctcagcctcctgagtagctgggattacaggtgtgtgccaccgtgcccggctaattttgaggtttttagtagagacagggtttcgccatgttggccaggctggtctcaaactcctgacctcaggtgatccacctgcctcggcctcccagagtactgggattacaggtgtaagccatggtgcccggccggttgtctttttcttgttgatttataggagttttgtatatgttttggatatgagtcttttgttggttatatctatcccaaacatcttctcccacactatggcttgcctttttactctcttaatagtatattttgaacagaagttctttttttatagtttatattttcttcttttctttctttttaaaatttttttctttcttttttatttttgagataggatctcactctgttacccaggctggagttcagtggctctagtcttcagggatcatggctcactgcagccttgacctcctgggttcaaggactcctcccatgtcagcctcccaagtagctgggagtacaggaacatgctaccatgcctggctaatttttttttggtttttttttgtgtgtgtgtgatggagttttgctatcgttgcccaggctggagtgcaatggcacgatttcagctcaccacaacctctgcctcccaggttcaagcaattctcctgcctcagtcttccgagtagctgggatttcaggcatgcgccaccacgcctggacaattttgtatttttagtagagactgggtttctccatgttggtcaggctggtctcgaactccctacctcaggtgatctgctcgcctcggcctcccaaagtgctgggattacaggcgtgagccaccgggcccggccacctggctaatttttagtttttctgtagagaggaaggtctccctatgttgcccaggatggtctcaaactcctgggctcaagtgatcctcctaccttggcctcccaaagtgctagtattacaggtgtgagccactgtacctggcctgaacagaagttcctaattttgatgaagtctgacttatcaatctttccctttatggttagtgctttctgtgttcagtttaagaaatctttgtctgtcaggccaggtgcggtggctcctgcctataatcccagcactttgggaggccaaggcaggtggatcacctgaggtcaggagttcgagaccagccttgccaacatggtgaaaccctgtctctactaaaaatacaaaaattagccaggcatggtggtgcatgcctgtaatcccagctactcgggaggctgagacaggagaattacttgaacaacccaggaggcggaggttgcagtgagctgagattgagccgctgcactccagcctgggtgacagagatgagactctgtctcaggaaaaaaaaaaaaaaaattgtctctaggtcatgaagatatccttctatttgttatcttgtagaagctttattattctatctttcatatttaggtttatgattcatctggaattgatttttttgtgtgtggatttggtaggggttaaagttcattttttccccatatgaatatactgttgactcaacaaccttaatgcaagaaaaaaaaacctttatttgctgcattgcagtggtatctttgtccaatcaaatcaccatgtaagtgggtctgtttctagactgcatggttttggcttaacttgtagcaatagataaatgaagttatttatccaaagtagattaagtcacatgaaacctgaagaaactaaggaatgagaaaggaaagtcggtatataaatggagtgtgtgaatgtgtgcatgtgtgtttgcatatctgtgtgcatatttgtacaagtatgtatctgtgtgaatgtatgtagatctgtgtatgtaaatattttcttagcatctatttggccaccagggcttttctcctgagtgtgagtgcataagtgcatgtgagcatgcacaagtatctttgtgtatttgaatatcttagcaaccttagcaaatgcatgcgattgtatttgatcttgttagcatccatctgcatgtacctctgtgtagccagaagggttttcttctttgcctcagttagtacccagggcaaaagcttaatgtattctactcagaaagtagttaaataagactgtttctctaatatatattttagttgtaggaattaggaagtagcatcatagatgctcctacactaagctggccctgcttcctatgttaaatatgacacatctgaggccctgggagaggaagtgatttgcccagtctcacacaatgagttagagccagagtgaagtcaaaacccagtctctggatgtacaagcaaggtctttttctagtcccaaatggccttttgtggtggtccagggactgccgggagcagtcgtggaactgcatcatttacagaaggtctgatctttgagtcagagtcacagaagaattgagaatagctgttgggccttgggctgctggactgagatgacatgtggacatcaggatgacaaggcttctgaagcagaggctgggggaaccagaactgctggaccagcacctgggggggggttctggtttcaaacagccctcttagtacagagtctggaggccacctctgaccagctaggtcaccttacactgttccctacagtaggggataatgtaacctttgggttttcccttttgggggaaacttaggaaaccttaggaaccttatgcgaggactcaacctgaggctggaatagctgggaaaacagaactttaggtggaggaagtggcataaaaaagttgaaaagtctggctgggcatgatagctcacacctgtaatcccagcactttgggaggctgaggtgggcagatcacctgaggtcaggagttcgagaccagcctggccaacatagcaaaaccccatctctactaaaaatataaaaaaattagcaggcatagtggcaggtacctgtagtcccagctactcaggaagctgaggcaggagaatcccttgaacccgggaggcggaggttgcagtgaaccgagatcacaccactgcactccagcctgggcaacagagggagactccgactcaaaaaaaaaaaaaaaaaaaaaaaagttgaaaagtgcagaggaatttgagaaaggtatgacctgaaaaggacacagagggaagggaaggaaggggagaacagagagggttataagcaggccagagccggattgtgaagtgcctgtatgcaaggtaggcatttggattctgctctggggagctattgaagtattttgagcaggggagtaatagaatcagatttgtgtttaaagaaaaaaaaaaatcagtctggatgccaagtggacaatgaaatggaggcgagtaaaagaggatcaaaaagaccagttaggaggttgttcctgtgtacaggtgagataagctggtgacttggtcgtggtaatagaaacaaagaaaaggccaggcacagtggctcacgcttgtaatcccagcactttgggaggccaaggtgggtggatcacctgcagttcaggagttcaagaccagcctagccaatatggcaaaaccctgtttctactaaaaatacaaaaatcagctgagtgtggtggtgggcgcctgtaatgccagctacctgggaggctgaggcagaagaatcgattgaacccaggagatggaggttgcagtgagccgagattgtgccactgcactccagcctgggtgacaaattgagattctgtctcaaataaataaataaataaataaaaatagaaatgaagaaaataggtggattccaaagatatggaggacttagtgataggcagtatgtgggggtgaggcagaaggaagtgtccagatttcctgcttgggcaacaggatggatggggaggatcggaagaggagcaggtgtgtgcagaaaaggcattccattttagacatgtggaatctgaattgggagtttactcatgaccacagctctattgcacccgattcttgctttgacaggaatgctccaaaatgggaagaagtttgattcatccagagacagaaacaaacctttcaagttcagaattggcaaacaggaagtcatcaaaggttttgaagagggtgcagcccaggtaggatgaggattcgcattaaaggggatctggggagttggggatctgggatcagcactctgccctccacctccaccttcacccactcacagaccactactgctttgactctacagccagggcatggcaacgccatctggtgtcccctcctggctttgcgtccccacccctctccttgccagcatacctcttttgtgtccctgggggctctcatcccaagcacatccccctaggcttgctcagaactagctgagagagccaggcacggtggctcacacctgtaatcccagcactttgggaggccgaatggggtggatcagttgaggccaggagttcaagactagcctcaccaacatggtgtaaccccgtccctgctgaaaatacaggcgtggtggtgcatgcctgtaatcccagctacttgggaggctgcgacaggagaattacttgaaccggggaggtgaaggttgcagtgagcagagattgtgccactgtactccagcccaggcgatggagtgagactgtctcaaaaaaacaaaacaaaaaaataaactagctgaggtctaccagttgcctgggactgaggtagtggaagagttggggtggagtaggccaagaaaatttttcgttttttcgcttttttgaaaagaatttcagaattacaaaaatattaaagaaatagtacagagttcttctatattctatccagcttccccttcttgcataaccatagtacaattatcaaaaccaggacattcacactgatacaaattacttacttattcaaatttttgattattcaaaattcaaaagtagatttaaatttcaccaattgtcccactaatgctgagtgggttctcaacaactgctgtgatgagccctggttcaagctgttctttcttggtctgtctgtgaagtcctatgatgctcccttacgataggtcttgtttttggtgtttttttttagaaagagtatcactctgtcaccaaggctggactgcagtggcgcaatcttggctcactgcaagctccgcgtcctgggttcacgccattcttctgcctcagcctccctagtagctgggactacaggcgcccgccaccacggccggctaatttttttgtatttttagtagagacggggtttcaccgttgttagccaagatggtctcggtctcctgacctcgtgatctgcccgcctcagcctcccaaagtggtgcgagccaccgtgcccggcctgttttttgttttttatttatttatttattttgagacgtagtctcactctgttgcccaggctagagtgcagtggcacaatctcagctcactgcaacctcctcctcccaggttcaagcaattttcctgccccagcctcccgagtagctgagattacaggtgtgcaccatcaccatcacgcctggctaatttttgtatttttagtacagacggggtctcaccatgtttgccaggctgctctcgaactcctgacctcaggtgatccacctgcctcggcctcccaaagtgctgagattacaggtgtgagccaccacgcccggactttttgtattttttagtagagacagggttttgccatattagccaggctggtcttgaacttctggactcaagtgatctgcccaccttggcttcccaaaagtgctgggattacaggtgtgagccaccacggttggccacaataggtcccccttgccaccttgctggtgactctagtctctaaaccactttaaataactgcccctgtcacctacttgagtatttacgtgtgctattcatacaccctcttttcctaaagaggcctattctttggaagagggtgaactatgaacaaatggaagtgtttcagtcatacacaaattgaataaccagtaatgtttgtcagatgcatgaatttgagaccactctgtgagggttactgccccacagtcacatctctgctgaggcagaatctgcgtttgttaaagctgttagcacgatttcaatgtatcccatgtaaaattcatctgagatcttcagagttaacattgaggatggtttgggaaaatgccatagtcatctaacttttttcttttaaatcaagctgggtcctctttctcctctccccatctgcccccatccctgctagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaactcctgtccatccttattttaggtaggaagtgctctaaggaccacacaagccaggtgcccttgggaaagagtggaaagaaaggagggttccaagtggctaggtgagtgataaatataatagctacaatgtgagcattttacatgctgggccttgttctacatacttttttattttatttatttatttatttatttgagatggagtctcgctctgtcactcaggctggaatgcagtggcacaatcttggctcactgcaacctccgcctcctgggttcaaacgattgtcatgctcaccagcacgcctggctaatttttgtatttttagtagagacagggttttgtcatattggccaggctggtctcaaaactcctgacctcaactgatctacctgccttggcctctcaaagtgatgggattacaggtgtgagccactgtgcctggctatatacttttaaattattaccattgatcctctaagcaaccctgcacagtagatattacctgccgctcatctcaggctcagaatcctcctctgcataactaaagaaatataggctccaaatcttgtagcctagcaatcagatgtgggacttgagcaccttatgtgctcttgcaatctttgtttggactacagccagagggatgagctccactcacccagatggatacagaacactttttgtgtctaaacaaatgaaggtgtgttaagggcttgaagtcgtacactaactcacattgggaagttccttgtgaaaagagtgtgtgattctgagcttgttttcacatacactgcttagtttcacctagatttgttctgacttacattgaggaattacttttgagaagaatgtatgattctgaacttgtttccacatatagtgcttatttcatcaacatttattgtaactaaccagaaacaccagttaggttttaaaatcagcacacttattggtgtaggttatatataggccataggagactgaggcaatatactcaaacatttttcttttttttctttctttttttgagacggagtctcactctgttgcccaggctgaagtgcagtggcatgatctcggctcactgcaagctctgcctcccgggttcacaccattcttctgcctcagcctcccgagtagctgggactacaggtgcccaccaccacacctggctaattttttgtatttttagtagagacggagtttcaccatgttagccaggatggtctcaatctcctgaccttatgatccgcctgcctcggcctcccaaaatgctagcattacaggtgtgagccatcacgcccagcctcaaacatttttctttcagttggtataggatgagaaaaactcctggccatagttggggttattcttttttttttttaatcatttatttattatttttaaaaaatagagatgggggaatctcactatgttgcccaggctggtctcaaactcctggcctcaagctatcttctctcagcctcccaaagtgttgggattatgggtttaaatcactgcactcagccaatacggttttctatcagtgacgacttcgaattgtttcaagattgaggacggaggggctgataacaggtactgttagtgttcctcatagacccactgatacatgtcacatgatgtcatatatatgctatgaggccatgtcatcttggctacatgatctaccttttttgtctccaagaaatcctggctgtattcctttgctgagggtggaggagctaatgaagaagcagtgctttaggatggagaaaacgagagaaaggaactgccttgcattttagtcaccaaagtccctgtgctcacctctattgtgagactagaccagccagagggtatttccttcagaatgtcttggttcctggctttctttgatgactcaaatgcctacaataatttctcagaagtcagcctgcataaaagacatacgcatattttctgctgtgacaccaataagataacaaaagatggcatc
